(12) United States Patent
Sauter et al.

(10) Patent No.: US 8,101,352 B2
(45) Date of Patent: Jan. 24, 2012

(54) DETECTION OF ESR1 AMPLIFICATION IN BREAST CANCER

(75) Inventors: Guido Sauter, Hamburg (DE); Ronald Simon, Kaltenkirchen (DE); Phillip Stahl, Hamburg (DE); Frederik Holst, Hamburg (DE); Khawla Al-Kuraya, Riyadh (SA); Christian Ruiz, Basel (CH)

(73) Assignee: Universitatsklinikum Hamburg-Eppendorf, Hamburg (DE)

( * ) Notice: Subject to any disclaimer, the term of this patent is extended or adjusted under 35 U.S.C. 154(b) by 0 days.

(21) Appl. No.: 12/305,258

(22) PCT Filed: Jun. 26, 2007

(86) PCT No.: PCT/EP2007/056384
§ 371 (c)(1),
(2), (4) Date: Dec. 21, 2009

(87) PCT Pub. No.: WO2008/000749
PCT Pub. Date: Jan. 3, 2008

(65) Prior Publication Data
US 2010/0086915 A1    Apr. 8, 2010

(30) Foreign Application Priority Data

Jun. 26, 2006 (EP) .................................. 06116106

(51) Int. Cl.
*C12Q 1/68* (2006.01)
(52) U.S. Cl. ........................................................ 435/6.1
(58) Field of Classification Search .................... None
See application file for complete search history.

(56) References Cited

U.S. PATENT DOCUMENTS 5,292,638 A    3/1994   Benz et al.
2005/0153319 A1*   7/2005   Housman et al. ................. 435/6

FOREIGN PATENT DOCUMENTS

WO   WO-02/057283    7/2002
WO   WO-2005/028681   3/2005
WO   WO-2006/052731   5/2006

OTHER PUBLICATIONS

Nembrot et al. (Biochem Biophys Res Commun. Jan. 30, 1990;166(2):601-7).*
Sharma et al. (Sharma. Breast (1996), pp. 344-350).*
Koh et al. (Anticancer Res. Nov.-Dec. 1989;9(6):1841-5).*
Al-Kuraya et al. Prognostic relevance of gene amplifications and coamplifications in breast cancer, *Cancer Res.*, 64:8534-40 (2004).
Andersen et al., Immunohistochemical estrogen receptor determination in paraffin-embedded tissue. Prediction of response to hormonal treatment in advanced breast cancer, *Cancer*, 64:1901-8 (1989).
Brandt et al., Double-differential PCR for gene dosage estimation of erbB oncogenes in benign and cancer tissues and comparison to cellular DNA content, *Gene*, 159:29-34 (1995).
Brandt et al., Isolation of blood-borne epithelium-derived c-erbB-2 oncoprotein-positive clustered cells from the peripheral blood of breast cancer patients, *Int J. Cancer*, 76:824-8 (1998).
Cherif et al., Detection of single-copy genes by nonisotopic in situ hybridization on human chromosomes, *Hum. Genet.*, 81:358-62 (1989).
Cowley et al., A comparison of transcriptional activation by ER alpha and ER beta, *J. Steroid Biochem. Mol. Biol.*, 69:165-75 (1999).
Deroo et al., Estrogen receptors and human disease, *J. Clin Invest.*, 116:561-70 (2006).
Diagnostik, *Therapie und Nachsorge des Mammakarzinoms der Frau*, Deutsche Krebsgesellschaft N.V. (Jul. 2004). [German only].
Elston et al., Pathological prognostic factors in breast cancer. I. The value of histological grade in breast cancer: experience from a large study with long-term follow-up, *Histopathology*, 19:403-10 (1991).
Fasco et al., Quantitation of estrogen receptor mRNA and ita alternatively spliced mRNAs in breast tumor cells and tissues, *Anal. Biochem.*, 245:167-78 (1997).
Fritz et al., Microarray-based copy number and expression profiling in dedifferentiated and pleomorphic liposarcoma, *Cancer Res.*, 62:2993-8 (2002).
Gradishar, Tamoxifen—what next?, *Oncologist*, 9:378-84 (2004).
Grunweller et al., RNA interference as a gene-specific approach for molecular medicine, *Curr. Med. Chem.*, 12:3143-61 (2005).
Harvey et al., Estrogen receptor status by immunohistochemistry is superior to the ligand-binding assay for predicting response to adjuvant endocrine therapy in breast cancer, *J. Clin. Oncol.*, 17:1474-81 (1999).
Hyytinen et al., Improved technique for analysis of formalin-fixed, paraffin-embedded tumors fluorescence in situ hybridization, *Cytometry*, 16:93-9 (1994).
Jarvinen et al., Amplification and deletion of topoisomerase IIalpha associate with ErbB-2 amplification and affect sensitivity to topoisomerase II inhibitor doxorubicin in breast cancer, *Am. J. Pathol.*, 156:839-47 (2000).
Kallioniemi et al., Comparative genomic hybridization for molecular cytogenetic analysis of solid tumors, *Science*, 258:818-21 (1992).
Kelloff et al., New science-based endpoints to accelerate oncology drug development, *Eur. J. Cancer*, 41:491-501 (2005).
Kung et al., Efficacy and safety of raloxifene 60 milligrams/day in postmenopausal Asian women, *J. Clin. Endocrinol. Metab.*, 88:3130-6 (2003).
Lancaster et al., BRCA 1 and 2—a genetic link to familial breast and ovarian cancer, *Medscape Womens Health*, 2:7 (1997).
Lawson et al., Low oestrogen receptor alpha expression in normal breast tissue underlies low breast cancer incidence in Japan, *Lancet*, 354:1787-8 (1999).

(Continued)

*Primary Examiner* — Christopher M. Babic
(74) *Attorney, Agent, or Firm* — Marshall, Gerstein & Borun LLP

(57) ABSTRACT

The present invention relates to an in-vitro method of identifying a tumor resulting from a proliferative breast disease as responsive to anti-estrogen treatment. Further, the invention relates to an in-vitro method of identifying a candidate patient with a proliferative breast disease as suitable for anti-estrogen treatment. In a further aspect, the invention provides an in-vitro method of identifying an individual with a non-cancerous proliferative breast disease who is at risk of developing breast cancer. The invention also provides kits for performing the above methods.

19 Claims, 4 Drawing Sheets

OTHER PUBLICATIONS

Mansur et al., Genetic polymorphisms of estrogen receptors in patients with premature coronary artery disease, *Arch. Med. Res.*, 36:511-7 (2005).

Masood et al., Reproducibility of LSI HER-2/neu SpectrumOrange and CEP 17 SpectrumGreen Dual Color deoxyribonucleic acid probe kit. For enumeration of gene amplification in paraffin-embedded specimens: a multicenter clinical validation study, *Ann. Clin. Lab. Sci.*, 28:215-23 (1998).

Matsui et al., P450 aromatase inhibiton assay using a competitive ELISA, *J. Pharm. Biomed. Anal.*, 38:307-12 (2005).

Melnick et al., The theoretical bases of transcriptional therapy of cancer: can it be put into practice?, *J. Clin. Oncol.*, 23:3957-70 (2005).

Modugno et al., Allelic variants of aromatase and the androgen and estrogen receptors: toward a multigenic model of prostate cancer risk, *Clin. Cancer Res.*, 7:3092-6 (2001).

Morris et al., Fulvestrant ('Faslodex')—a new treatment option for patients progressing on prior endrocrine therapy, *Endocr. Relat. Cancer*, 9:267-76 (2002).

Murphy et al., Novel mutations in the estrogen receptor messenger RNA in human breast cancers, *J. Clin. Endocrinol. Metab.*, 81:1420-7 (1996).

Naidu et al., Expression and amplification of cyclin D1 in primary breast carcinomas: relationship with histopathological types and clinico-pathological parameters, *Oncol. Rep.*, 9:409-16 (2002).

Current Status of Test Methods for Detecting Endocrine Disruptors: In Vitro Estrogen Receptor Binding Assays, *National Institutes of Health Publication No. 03-4504* (2002).

Nembrot et al., Estrogen receptor gene amplification is found in some estrogen receptor-positive human breast tumors, *Biochem. Biophys. Res. Commun.*, 166:601-7 (1990).

O'Connell, Genetic and cytogenetic analyses of breast cancer yield different perspectives of a complex disease, *Breast Cancer Res. Treat.*, 78:347-57 (2003).

Omoto et al., Estrogen receptor (ER) beta1 and ERbetacx/beta2 inhibit ERalpha function differently in breast cancer cell line MCF7, *Oncogene*, 22:5011-20 (2003).

Palmberg et al., Androgen receptor gene amplification at primary progression predicts response to combined androgen blockade as second line therapy for advanced prostate cancer, *J. Urol.*, 164:1992-5 (2000).

Pauletti et al., Detection and quantitation of HER-2/neu gene amplification in human breast cancer archival material using fluorescence in situ hybridization, *Oncogene*, 13:63-72 (1996).

Pegram et al., Results of two open-label, multicenter phase II studies of docetaxel, platinum salts, and trastuzumab in HER2-positive advanced breast cancer, *J. Natl. Cancer Inst.*, 96:759-69 (2004).

Peters et al., Estrogen receptor domains E and F: role in dimerization and interaction with coactivator RIP-140, *Mol. Endocrinol.*, 13:286-96 (1999).

Poola et al., Quantitation of estrogen receptor mRNA copy numbers in breast cancer cell lines and tumors, *Anal. Biochem.*, 258:209-15 (1998).

Poola, Molecular assay to generate expression profile of eight estrogen receptor alpha isoform mRNA copy numbers in picogram amounts of total RNA from breast cancer tissues, *Anal. Biochem.*, 314:217-26 (2003).

Press et al., Evaluation of HER-2/neu gene amplification and overexpression: comparison of frequently used assay methods in a molecularly characterized cohort of breast cancer specimens, *J. Clin. Oncol.*, 20:3095-105 (2002).

Puddefoot et al., Non-competitive steroid inhibition of oestrogen receptor functions, *Int. J. Cancer*, 101:17-22 (2002).

Ruiz et al., Tissue microarrays for comparing molecular features with proliferation activity in breast cancer, *Int. J. Cancer*, 118:2190-4 (2006).

Scandinavian Breast Group Trial 9401, Topoisomerase IIalpha gene amplification predicts favorable treatment response to tailored and dose-escalated anthracycline-based adjuvant chemotherapy in HER-2/neu-amplified breast cancer: Scandinavian Breast Group Trial 9401, *J. Clin. Oncol.*, 24:2428-36 (2006).

Schrag et al., Life expectancy gains from cancer prevention strategies for women with breast cancer and BRCA1 or BRCA2 mutations, *JAMA*, 283:617-24 (2000).

Schuur et al., Monoallelic amplification of estrogen receptor-alpha expression in breast cancer, *Cancer Res.*, 60:2598-601 (2000).

Seshadri et al., Cyclin DI amplification is not associated with reduced overall survival in primary breast cancer but may predict early relapse in patients with features of good prognosis, *Clin. Cancer Res.*, 2:1177-84 (1996).

Simon et al., Tissue microarrays, Chapter 26 IN: Roulston et al. (eds.), *Molecular Diagnosis of Cancer*, Humana Press Inc. (2004).

Solinas-Toldo et al., Matrix-based comparative genomic hybridization: biochips to screen for genomic imbalances, *Genes Chromosomes Cancer*, 20:399-407 (1997).

Stierer et al., Immunohistochemical and biochemical measurement of estrogen and progesterone receptors in primary breast cancer. Correlation of histopathology and prognostic factors, *Ann. Surg.*, 218:13-21 (1993).

Tanner et al., Topoisomerase II α gene amplification predicts favorable treatment response to tailored and dose-escalated anthracycline-based adjuvant chemotherapy in *HER-2/neu*-amplified breast cancer: Scandinavian Breast Group Trial 9401, *J. Clin. Oncol.*, 24:2428-36 (2008).

Tavassoli et al., WHO histological classification of tumours of the breast, WHO/IARC Classification of Tumours (2003).

Torhorst et al., Tissue microarrays for rapid linking of molecular changes to clinical endpoints, *Am. J. Pathol.*, 159:2249-56 (2001).

Vona et al., Isolation by size of epithelial tumor cells : a new method for the immunomorphological and molecular characterization of circulating tumor cells, *Am. J. Pathol.*, 156:57-63 (2000).

Wagner et al., Chromosome 8p deletions are associated with invasive tumor growth in urinary bladder cancer, *Am. J. Pathol.*, 151:753-9 (1997).

Wong et al., Detection of circulating tumour cells with the magnetic activated cell sorter, *Br. J. Surg.*, 82:1333-7 (1995).

Wittekind et al., *Tnm Atlas: Illustrated Guide to the Tnm/Ptnm—Classification of Malignant Tumors*, Berlin: Springer Verlag (2005). English translated abstract provided, Abstract Only.

\* cited by examiner

Figure 2A

| | | on array (n) | ESR1 amplification | | | ER expression* | | |
|---|---|---|---|---|---|---|---|---|
| | | | analyzable (n) | amplification | p | analyzable (n) | expression | p |
| Cancers | all | 2197 | 1679 | 31.3% | | 2018 | 76.6% | |
| Histology | ductal carcinoma | 1552 | 1207 | 33.1% | | 1429 | 77.1% | |
| | lobular carcinoma | 312 | 207 | 29.5% | | 275 | 87.6% | |
| | mucinous carcinoma | 69 | 37 | 48.6% | 0.0012** | 61 | 93.4% | <0.0001** |
| | medullary carcinoma | 58 | 48 | 4.2% | <0.0001** | 52 | 17.3% | <0.0001** |
| | tubular carcinoma | 56 | 42 | 28.6% | | 48 | 89.6% | |
| | cribriform carcinoma | 65 | 55 | 32.7% | | 56 | 91.1% | |
| | papillary carcinoma | 30 | 27 | 22.2% | | 28 | 67.9% | |
| | others* | 79 | 56 | 16.1% | | 69 | 34.8% | |
| pT stage | pT1 | 820 | 578 | 34.4% | 0.0416 | 716 | 80.4% | 0.0020 |
| | pT2 | 1023 | 811 | 31.2% | | 948 | 73.2% | |
| | pT3 | 124 | 92 | 23.9% | | 114 | 72.8% | |
| | pT4 | 242 | 189 | 25.4% | | 229 | 80.3% | |
| Nodal stage | pN0 | 950 | 711 | 31.9% | 0.1397 | 849 | 78.1% | 0.1765 |
| | pN1 | 793 | 608 | 27.8% | | 726 | 75.6% | |
| | pN2 | 121 | 90 | 24.4% | | 113 | 70.8% | |
| BRE grade | G1 | 545 | 421 | 35.9% | <0.0001 | 522 | 92.9% | <0.0001 |
| | G2 | 844 | 685 | 34.2% | | 833 | 86.3% | |
| | G3 | 655 | 571 | 24.7% | | 661 | 51.9% | |

* according to Allred

Figure 2B

| Parameter | | p-value |
|---|---|---|
| pT stage | pT1-4 | 0.1294 |
| BRE grade | G1-3 | 0.0028 |
| pN stage | pN0-pN2 | 0.0039 |
| ER expression status | neg/pos (Allred score) | 0.1242 |
| ESR1 amplification status | amplified vs non-amplified | 0.0368 |

DETECTION OF ESR1 AMPLIFICATION IN BREAST CANCER

FIELD OF THE INVENTION

The present invention relates to an in-vitro method of identifying a tumor resulting from a proliferative breast disease as responsive to anti-estrogen treatment. Further, the invention relates to an in-vitro method of identifying a candidate patient with a proliferative breast disease as suitable for anti-estrogen treatment. In a further aspect, the invention provides an in-vitro method of identifying an individual with a non-cancerous proliferative breast disease who is at risk of developing breast cancer. The invention also provides kits for performing the above methods.

BACKGROUND OF THE INVENTION

Breast cancer is the leading malignancy in women, accounting for more than 350,000 deaths per year in western countries. On the molecular level, about 20% of breast cancers are characterized amplification of the gene encoding the HER2 growth factor receptor (Pauletti, G., et al. (1996), Oncogene, 13: 63-72). Amplification of the HER2 gene results in strong over-expression of the receptor protein and, in turn, confers a growth advantage to the tumor cells. Herceptin, a monoclonal antibody targeting the HER2 protein, improves patient survival even in metastatic breast cancers and is regarded as a paradigm for the potential of a new generation of gene specific drugs (Pegram, M. D., et al. (2004), J Natl Cancer Inst, 96: 759-769).

Amplification of genomic DNA is the result of a selection process aiming at facilitating tumor cell growth, e.g. by high level overexpression of genes that otherwise would be growth rate limiting. Amplified genes, therefore, are likely to be vitally important for tumor cells and represent particular attractive targets for new gene specific therapies. In breast cancer, more than 30 regions of amplification have been detected by means of classical comparative genomic hybridization (CGH), see for example, O'Connell, et al. (2003), Breast Cancer Res Treat, 78: 347-357. Numerous important oncogenes have been identified within these amplicons, for example CMYC at chromosome 8q24, EGFR at 7p21, or CCND1 at 11q13. However, it is assumed that the majority of genes which undergo amplification in breast malignancies has not yet been identified. Thus, there is a hope that other amplified genes can be used in diagnosis, estimation of prognosis and treatment of these diseases.

It has been surprisingly found in the course of the present invention that amplification of the ESR1 gene located at 6q25.1 and encoding the alpha isoform of the estrogen receptor appears to be the most frequent gene amplification that is detectable in breast cancer. In the experiments conducted by the inventors, amplification of the ESR1 gene was observed in 31% of the examined tumors. Even more importantly, the present invention provides evidence that amplification of the ESR1 gene is correlated to an enhanced susceptibility of a tumor, such as a breast cancer, to anti-estrogen treatment, e.g. by administration of Tamoxifen. As a consequence, detection of ESR1 amplification is of significant clinical relevance and may be used in diagnosis and estimation of prognosis and also as a tool for making decisions as to the specific treatment protocol to be used with a particular patient suffering from a proliferative breast disease such as breast cancer.

In view of the enormous number of publications dealing with the estrogen receptors and their relationship with breast cancer, it is surprising that ESR1 amplification in breast cancer has not been identified so far. The inability to detect the 6q25.1 amplicon in several hundreds of breast cancer samples analyzed by classical metaphase CGH during the last decade argues for a generally small amplicon size overstraining the classical CGH resolution. Because the experimental noise is often considerable in array hybridization experiments, single spot peaks are frequently seen and artifacts are difficult to distinguish from true amplification events. In order to overcome these shortcomings, the experiments of the present invention specifically focused on small single gene amplifications. By fluorescence in situ hybridization using a probe specific for the ESR1 gene, putative ESR1 amplification events previously seen in the CGH assay were confirmed.

DESCRIPTION OF THE FIGURES

FIG. 2A shows a table demonstrating the association of ESR1 copy number changes and breast cancer phenotype. FIG. 2B shows the contribution of potential prognostic factors to tumor specific survival in breast cancer patients that received Tamoxifen monotherapy (multivariate COX regression model).

SUMMARY OF THE INVENTION

Figure 1:
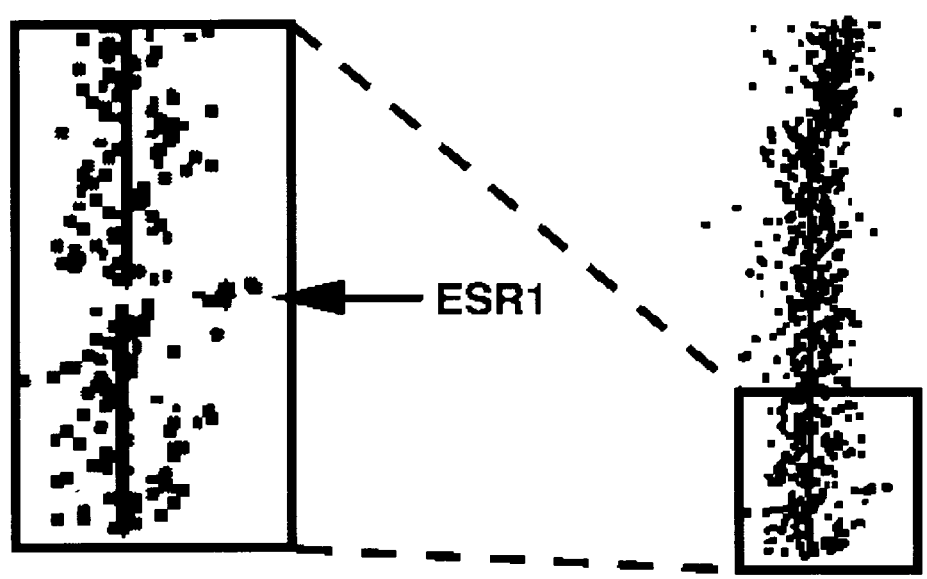
FIG. 1 depicts a plot from the CGH experiment showing amplification of the ESR1 gene as indicated by the arrow.

Estrogens belong to the group of steroid hormones. The three major naturally occurring estrogens in women are estradiol, estriol and estrone. From puberty to menopause, estrogen production mainly takes place in the ovaries. After menopause, when the ovaries no longer produce estrogens, body fat is the primary source for these hormones. Like other steroid hormones, estrogens act as signalling molecules and exhibit their function by binding to estrogen receptors which are present inside cells of those tissues which are targets for estrogen regulation. Two different human estrogen receptors occur which are designated estrogen receptor alpha isoform (or ER-alpha) and estrogen receptor beta isoform (ER-beta). The isoforms are encoded by different genes, ESR1 and ESR2, respectively, which are found at different chromosomal locations, and numerous mRNA splice variants exist for both receptors in both diseased and normal tissue (see for example, Deroo & Korach (2006), Journal of Clinical Investigation 116: 561-570).

Like all steroid receptors, the estrogen receptors (i.e. the alpha and beta isoform) exhibit a modular structure, with discrete regions of the protein (domains) responsible for transcriptional activation, DNA binding, nuclear localization, ligand binding, and dimerization (see Peters and Khan (2003), Mol Endocrin 13(2):286-296). ER-alpha and ER-beta share a high degree of homology in the ligand binding (AF-2) and DNA-binding domains, but differ in the activation function (AF-1) domain. Comparison of the AF-1 domains suggests that the activity on estrogen response elements is much stronger in ER-alpha as compared to ER-beta (Cowley, S. M., et al. (1999), J Steroid Biochem Mol Biol 69: 165-175). Although comparatively little is known about the function and clinical significance of ER-beta, it is generally believed that ER-beta counteracts the function of ER-alpha and leads to a reduction of estrogen-stimulated proliferation (Omoto, Y., et al. (2003), Oncogene 22: 5011-5020).

The human estrogen receptor alpha is encoded by the ESR1 gene which maps to 6q25.1 of human chromosome 6. The nucleotide sequence of SEQ ID NO:1 shows the ESR1 coding sequence as defined by nucleotides 1048135 to 1343855 together with approximately 1 Mb of sequence located upstream (at the 5' end of the sequence) of the coding sequence and approximately 1.38 Mb of sequence located downstream (at the 3' end of the sequence) of the coding sequence. As used herein, the terms "ESR1 gene" and "ESR1 coding sequence" are used interchangeably and refer to the genomic sequence (containing exons and introns) which is transcribed and spliced to the mRNA depicted in SEQ ID NO:2 without promoter and enhancer structures which might be associated to this DNA entity. The ESR1 gene sequence is also available under NCBI GenBank ID NT_025741.14, providing the assembled nucleotide sequence of human chromosome 6. In the sequence portion designated "Human Genome Build 36", the ESR1 gene covers nucleotides 152170379 to 152466099. The ESR1 gene comprises several introns which are spliced out after transcription. The nucleotide sequence of the spliced ESR1 mRNA sequence is depicted in SEQ ID NO:2 and is available under NCBI GenBank ID NM_000125. The corresponding amino acid sequence of the estrogen receptor alpha protein is depicted in SEQ ID NO:3 and is also available under NCBI GenBank ID NM_000125. There are numerous allelic variants of the ESR1 gene, see for example, Modugno et al. 2001, Clin Cancer Res. 7(10):309 or Mansur Ade et al. 2005, Arch Med Res. 36(5):511.

The estrogen receptors (alpha or beta isoform) are normally located in the nucleus of the target cell. According to the accepted model of steroid hormone action, the estrogen receptors are in an inactive state in the absence of hormone. When estrogen passes into the nucleus, the estrogen receptors bind to estrogen. Upon estrogen binding, the receptors form dimers which then bind to estrogen response element DNA sequences directly or indirectly through protein-protein interactions with activator protein 1 (AP1) or SP1 sites in the promoter region of estrogen-responsive genes. This binding results in the recruitment of co-regulatory proteins (co-activators or co-repressors) to the promoter, thereby leading to an increased or decreased gene expression. The altered gene expression can influence cell behavior in different ways, depending on the tissue type involved. In some target tissues, such as breast tissue, the main effect of estrogen in healthy women is to induce cell proliferation. For instance, estrogen causes the proliferation of cells lining the milk glands in order to prepare milk production. Aside from homodimeric receptors consisting of two alpha units or two beta units, mixed dimers may also occur. Different tissues express the two isoforms in different proportions, and therefore have different responses to stimulation by estrogens.

Although the ability to promote proliferation of breast cells lies within the normal functions of the estrogen molecule, it is also associated with an increased risk of developing breast cancer (Lawson J. S., et al. (1999), Lancet 354:1787-1788). Once invasive cancerous breast cells have formed, it is highly undesirable to have signal molecules that trigger proliferation of these cancerous cells. Consequently, immunohistochemical detection of expression of the alpha isoform of the estrogen receptor is routinely performed in order to determine whether breast cancer cells of a given patient express estrogen receptor or not (Andersen, J. and Paulsen, H. S. (1989), Cancer, 64: 1901-1908).

It has been demonstrated that more than two thirds of breast cancers show expression of the alpha isoform of the estrogen receptor at the time of diagnosis (Stierer, M., et al. (1993), Ann Surg, 218: 13-21). These cancers are generally referred to as estrogen-receptor-positive or ER-positive. In the remaining breast cancer cases, no estrogen-receptor alpha protein can be detected in the cells. These cancers are estrogen-receptor-negative or ER-negative. ER-positive breast cancers are currently treated, inter alia, by anti-estrogen therapy using so-called selective estrogen receptor modulators (SERMs) and/or aromatase inhibitors. For example, an estrogen antagonist like Tamoxifen is frequently applied to the patient with ER-positive breast cancer, normally after surgical removal of the tumor.

With the methods according to the present invention, it is now possible to identify a subgroup within the group of ER-positive patients suffering from a proliferative breast disease, such as breast cancer, which show a particular good response to anti-estrogen therapy. It could be demonstrated that tumors of breast cancer patients that show amplification of the ESR1 gene on the genomic level exhibit a clearly enhanced response to anti-estrogen therapy with Tamoxifen. A shown in FIG. 4, the overall survival of these patients is significantly increased compared to patients with tumors not exhibiting ESR1 amplification. These patients are classified as particular suitable for anti-estrogen therapy, for example with Tamoxifen. This finding was unexpected because in prostate cancer, where the mechanism of hormone dependent growth is comparable to breast cancer, amplification of the gene encoding the androgen receptor leads to resistance to anti-hormone therapy (Palmberg C. (2000), J Urol, 164: 1992-1995). The methods of the present invention therefore allow prediction of the responsiveness of a tumor resulting from a proliferative breast disease to anti-estrogen treatment based on the evidence that the ESR1 gene is amplified. Such information can be useful in order to design an appropriate therapy schedule which is more tailored to the nature and molecular characteristics of the tumor. For example, in cases where a tumor shows a particularly responsiveness to anti-estrogen treatment, for example, administration of Tamoxifen, the patient can be subjected to an anti-estrogen monotherapy, without the need to apply a concurrent chemotherapy. Alternatively, where chemotherapy is still part of the therapy, it might be possible to reduce the dosis of the chemotherapeutic agents while maintaining the same treatment results.

Amplification of the ESR1 gene is regularly associated with co-amplification of genomic sequence portions that frame the ESR1 gene on the human chromosome. It has been shown in the present invention that it is possible to spot ESR1 gene amplification events both directly by detecting amplification of the ESR1 sequence and indirectly by detecting amplification of a nucleotide sequence which comprises the ESR1 gene. Thus, according to a first aspect of the invention, an in-vitro method of identifying a tumor which results from a proliferative breast disease as responsive to anti-estrogen treatment is provided. The method comprises the steps of
  a) detecting in a cell sample from said tumor whether a nucleotide sequence portion of the nucleotide sequence of SEQ ID NO:1 or a nucleotide sequence having at least 95% sequence identity to such portion is amplified in the genome of said tumor cells;
  b) classifying said tumor as responsive to anti-estrogen treatment, if the nucleotide sequence portion of SEQ ID NO:1 or a nucleotide sequence having at least 95% sequence identity to such portion is amplified in the genome of said tumor cells.

According to a second aspect of the invention, an in-vitro method of identifying a candidate patient with a tumor resulting from a proliferative breast disease as suitable for anti-estrogen treatment is provided. The method comprises the steps of
   a) detecting in a cell sample from said tumor whether a nucleotide sequence portion of the nucleotide sequence of SEQ ID NO:1 or a nucleotide sequence having at least 95% sequence identity to such portion is amplified in the genome of said tumor cells;
   b) classifying said patient as one that is suitable for anti-estrogen treatment, if the nucleotide sequence portion of the nucleotide sequence of SEQ ID NO:1 or a nucleotide sequence having at least 95% sequence identity to such portion is amplified in the genome of said tumor cells.

Accordingly, the invention also provides a method for treating a patient suffering from a tumor resulting from a proliferative breast disease, such as breast cancer, comprising the detection step a) indicated above, and subjecting the patient to an anti-estrogen treatment, if the nucleotide sequence portion of the nucleotide sequence of SEQ ID NO:1 or a nucleotide sequence having at least 95% sequence identity to such portion is amplified in the genome of said tumor cells. The present invention demonstrates for the first time that ESR1 amplification can not only be detected in breast cancer, but also in a significant part of benign proliferative breast diseases, such as ductal hyperplasia or ductal papillomas. Several genetic alterations in non-malignant breast lesions which are associated with an increased risk of developing cancer have been reported. For example, women with mutations of the BRCA1 and BRCA2 genes have a lifetime risk of breast cancer exceeding 80% and of ovarian cancer approaching 60% (Lancaster et al. (1997), Medscape Womens Health 2(2):7). Accordingly, prevention strategies including Tamoxifen treatment, bilateral prophylactic oophorectomy, or prophylactic contralateral mastectomy, have been shown to gain life expectancy (Schrag et al. (2000), JAMA 283(5):617).

Gene amplifications—like mutations—constitute genetic alterations. However, a gene amplification has so far never been demonstrated in a non-cancerous proliferative breast disease. Generally, amplifications modulate gene activity by massively overexpressing mRNA and resulting protein. In normal breast epithelial tissue, the function of the alpha isoform of the estrogen receptor resides in the reception and transduction of a signal facilitating epithelial cell proliferation. In the present invention, it was found that ESR1 amplification has a similar impact on cell proliferation in non-cancerous and cancerous proliferative breast diseases. Increased proliferation rates increase the risk to acquire additional genetic alterations and, in turn, the risk of developing breast cancer. Thus, ESR1 amplification can indicate a non-cancerous proliferative breast disease with an increased potential for malignant transformation. ESR1 amplification status analysis may serve as a prognostic marker in patients with ductal hyperplasia, ductal papillomas or other non-cancerous proliferative breast diseases described herein.

According to a further aspect, the invention therefore provides an in-vitro method of identifying an individual with a tumor resulting from a non-cancerous proliferative breast disease who is at risk of developing breast cancer. The methods comprises the steps of
   a) detecting in a cell sample from said tumor whether a nucleotide sequence portion of the nucleotide sequence of SEQ ID NO:1 or a nucleotide sequence having at least 95% sequence identity to such portion is amplified in the genome of said tumor cells;
   b) classifying said individual as one that is at risk of developing breast cancer, if the nucleotide sequence portion of the nucleotide sequence of SEQ ID NO:1 or a nucleotide sequence having at least 95% sequence identity to such portion is amplified in the genome of said tumor cells.

The methods according to the invention are in vitro methods which utilize samples comprising breast cells and/or breast tissue. The cells and tissues are derived from a breast region of concern, in particular from a tumor of the breast. The source of the tissue sample may be, for example, solid tissue from a fresh, frozen and/or preserved tissue sample, biopsy or aspirate. Preferably, the samples are derived from a breast biopsy. A breast biopsy involves removing breast cells or breast tissue for further molecular and/or histological examination. For example, breast biopsy samples are normally used to determine whether cancerous cells are present in the breast of a patient. Hitherto, biopsy and subsequent pathological analysis is the only definitive way to confirm, for example, breast cancer. Nevertheless, it is anticipated that the methods of the invention may also be conducted with blood samples. For this purpose, tumor cells are isolated from peripheral blood and subjected to amplification detection. Methods for tumor cell isolation from blood include filtration procedures ("Isolation by size of epithelial tumor cells (ISET)", described in Vona et al. (2000) Am J Pathol 156:57) or immunomagnetic (Brandt et al. (1998), Int J Cancer 76:824) or flow cytometric approaches (Wong et al. (1995), Br J Surg 82:1333). Furthermore, the methods of the invention may also be performed with cells obtained from bone marrow.

In the prior art, different methods of breast biopsy are known, for example, open excisional biopsy, needle biopsy (such as fine needle or core needle biopsy), or vacuum-assisted biopsy. These biopsy methods are well known in the art and have been described in numerous publications and standard textbooks (see for example "Diagnostik, Therapie and Nachsorge des Mammakarzinoms der Frau", Interdisziplinäre Leitlinie der Deutschen Krebsgesellschaft, published in June 2004). For example, open excisional biopsy (also referred to as open biopsy) is a surgical procedure, in which the tumor or lump is removed, either partly or completely, from the patient's breast and is further examined, for example, tested for malignancy. An open biopsy can be performed under local or general anesthesia. Prior to surgery, a radiologist often first marks the region of concern with a wire, thereby enabling the surgeon to find the location.

Fine needle biopsy is a percutaneous procedure in which fluid and/or small cell clusters are removed by use of a syringe equipped with a fine gauge needle (normally 20-25 gauge). In comparison, the needles used in core needle biopsy are somewhat larger (commonly 16-10 gauge), so that larger portions of breast tissue can be collected. In case the breast tissue region of concern, for example the tumor, is palpable, needle biopsy can be performed without guidance means. Otherwise, computer-based stereotactic mammography or ultrasound image guidance means can be used to identify the area of concern. Typically, more than one, for example three to five, separate core needle insertions are performed to obtain a sufficient amount of breast tissue.

Like needle biopsy, vacuum biopsy also is a minimally invasive procedure which is based on insertion of a needle into a breast tissue suspected to be abnormal. However, unlike core needle insertion which involves several separate needle insertions to acquire multiple samples, the special biopsy probe used during vacuum-assisted biopsy is inserted only once into the breast through a small skin nick made in the skin of the patient's breast. Vacuum-assisted breast biopsy systems are well known to the person working in the relevant technical field and can be obtained from different manufactures (e.g. the Mammotome biopsy system available from Ethicon Endo-Surgery, Germany).

In general, the samples to be examined are obtained from a patient suffering from a proliferative breast disease. A proliferative breast disease refers to any state of the breast tissue which is associated with an abnormal and/or uncontrolled cell proliferation. In a proliferative breast disease, a tumor is formed in the breast, i.e., an abnormal mass of cells, that results from excessive cell division and performs no useful body function. Tumors are distinguished in benign tumors and malignant tumors. Accordingly, the proliferative breast disease which leads to tumor formation may be a benign or a malignant disease.

Malignant tumors are generally cancerous which means that the patient is afflicted with breast cancer. Cancer has the potential to invade and destroy neighboring tissues and create metastases. The main types of breast cancer are invasive ductal carcinoma, invasive lobular carcinoma, papillary carcinoma, mucinous carcinoma, medullary carcinoma and tubular carcinoma. The diagnosis and classification of cancers is well known in the art and discussed in numerous publications (see, for example, Tavassoli, F. A., et al. (2003), World Health Organization: Tumours of the Breast and Female Genital Organs, WHO/IARC Classification of Tumours). According to one particular aspect of the invention, the proliferative breast disease which leads to the formation of a tumor is breast cancer.

Benign tumors are characterized in that they do not invade neighboring tissues and do not spread metastases. Normally, benign tumors do not recur after surgical removal of the tumor tissue. As used herein, benign tumors result from non-cancerous proliferative breast diseases. Such non-invasive diseases also comprise pre-cancerous conditions which are known to frequently result in a cancerous disease at a later stage. According to a further aspect of the invention, the proliferative breast disease is selected from the group of benign diseases consisting of ductal hyperplasia, preferably atypical ductal hyperplasia, papillomas, preferably ductal papillomas, sclerosing adenosis, mastopathy, Phylloides tumor, fibroadenoma, ductal carcinoma in situ (DCIS), lobular carcinoma in situ (LCIS), and apocrine metaplasia. These conditions are known in the field of medicine and are moreover described in detail in standard textbook and numerous publications (see, for example, Tavassoli, F. A., et al. (2003), World Health Organization: Tumours of the Breast and Female Genital Organs, WHO/IARC Classification of Tumours).

A ductal carcinoma in situ (DCIS) is an early form of breast cancer, which is sometimes referred to as pre-cancerous, intraductal or non-invasive cancer. In DCIS, cell proliferation has occurred inside the milk ducts and the cells have not (yet) developed the ability to spread through the breast or outside the breast. There are numerous different types of DCIS, including the comedo type of DCIS that is characterized by necrotic cells inside the breast ducts, and the non-comedo types that are further classified according to the growth pattern of tumor cells inside the ducts into solid DCIS, cribriform DCIS, and others (Tavassoli, F. A., et al. (2003), World Health Organization: Tumours of the Breast and Female Genital Organs, WHO/IARC Classification of Tumours). Normally, if DCIS is not properly treated, the cells may eventually develop the ability to spread from the ducts into the surrounding breast tissue and become cancerous.

A lobular carcinoma in situ (LCIS) refers to a proliferation of lobules cells, i.e. cells of the milk-producing glands in the back of the breasts located at the end of the ducts. LCIS is also considered as a pre-malignant tissue state and has been linked to a slightly increased risk of developing breast cancer in the future. Like DCIS, LCIS is a non-invasive cell proliferation which means that it has not yet spread into the surrounding tissues. In most cases of LCIS, the patient will never develop invasive cancer.

The term mastopathy describes various types of proliferative diseases of the breast. According to the definition published by WHO (1984), mastopathy is the fibrocystic disease (FCD) of the breast which is characterized by a disbalance between epithelial and connective tissue growth with high proliferative and regressive changes of the breast tissue.

Sclerosing adenosis (also designated adenofibrosis, fibrosing adenosis) is a benign condition whereby extra tissue grows within the breast lobules. It frequently causes breast pain. Usually the changes are microscopic, but adenosis can produce lumps, and it can show up on a mammogram, often as calcifications.

Hyperplasia is a benign breast condition caused by increased growth in the size and number of normal cells within a part of the breast. It can occur in the ducts (ductal hyperplasia) or the lobes (lobular hyperplasia). Hyperplasia may occur as atypical ductal hyperplasia or atypical lobular hyperplasia. A diagnosis of atypical ductal hyperplasia or atypical lobular hyperplasia means that the cells have developed an unusual pattern (see Tavassoli, F. A., et al. (2003), World Health Organization: Tumours of the Breast and Female Genital Organs, WHO/IARC Classification of Tumours). An apocrine metaplasia is a benign breast condition occurring in patients with fibrocystic disease.

An intraductal papilloma is a benign wart-like lump that forms within a duct just behind the areola. Intraductal papillomas can be in both breasts at the same time and are sometimes discovered following breast surgery. Women reaching the menopause are more likely to have a single intraductal papilloma, while younger women often have more than one. Papillomatosis describes multiple papillary lesions within the breast ducts.

Benign phylloides tumors are a rare type of breast lump that are most commonly found in pre-menopausal women between the ages of 40 and 50. Although unusual, a benign phyllodes tumor recurs after it has been removed, and may (rarely) develop into a borderline malignant or malignant form.

Fibroadenomas are the most common benign tumors of the female breast. They usually comprise of connective tissue, inter alia from encapsulated gland tissue. They develop at any age but are more common in young women, often teenagers, and are mistaken for cancer. They may be excised but frequently recur.

According to the invention, it was found that individuals with a proliferative breast disease associated with a tumor having an amplified ESR1 gene in the genome of the tumor cells are particularly suitable for anti-estrogen therapy, for example, by administration of Tamoxifen. The tumors of these patients have shown to be particularly responsive to anti-estrogen therapy. For the purpose of the present invention, "responsive" in the context with a tumor or a patient means that a beneficial clinical reaction to the particular applied treatment is obtained, which leads to an improvement of the disease state with respect to said tumor or said patient. Preferably, the beneficial clinical reaction is stronger when compared to tumors of patients without ESR1 amplification (for example, ER-positive lacking amplification of the ESR1 gene or ER-negative) being subjected to the same treatment.

In relation to a tumor, the beneficial clinical reaction may comprise reduction of the tumor size, stabilization of the tumor size by slowing of growth and/or reduction of the tendency to spread metastases (in case of a malignant tumor).

Preferably, a tumor which is responsive to anti-estrogen treatment will be reduced in size during or subsequent to therapy. In relation to a particular patient with a non-cancerous proliferative breast disease, the clinical reaction may also comprise the reduction of the risk of developing breast cancer. In relation to a particular patient with breast cancer the clinical reaction may also comprise delay or slowing of the disease progression, and in particular prolonging survival of the patient as compared to survival if not receiving any treatment. A patient who is responsive to anti-estrogen treatment as described above is considered suitable for anti-estrogen treatment.

An "anti-estrogen treatment" or "anti-estrogen therapy" means any measure that targets to interfere with the naturally occurring interaction between estrogen (estradiol, estriol and estrone, and preferably estradiol 17-beta) and the estrogen receptor, preferably the alpha isoform of the estrogen receptor. Specifically, anti-estrogen treatment or anti-estrogen therapy comprises measures which result in blocking the signal-transducing function of the estrogen receptor, which effects the estrogen-induced reactions, such as cell proliferation. Such measures comprise, for example, the administration of active agents or drugs that act by competitive inhibition of estrogen binding to an estrogen receptor, preferably the alpha isoform of the receptor. When administered in an therapeutically effective amount, these agents or drugs bind to the estrogen receptor, preferably the alpha isoform of the receptor, thereby blocking estrogen from binding to this receptor. According to the present invention, these compounds are referred to as "estrogen antagonists" (see below). Aside from estrogen antagonists, other current anti-estrogen strategies include destabilization and degradation of an estrogen receptor, preferably the alpha isoform, by administering a therapeutically effective amount of a selective estrogen receptor downregulator (e.g. Fulvestrant) or disruption of estrogen synthesis by administering a therapeutically effective amount of an aromatase inhibitor (e.g. Anastozole, Exemestan).

The term "therapeutically effective amount" refers to an amount of a drug effective to treat a disease or disorder in a mammal, preferably a human. In the case of a cancerous or non-cancerous proliferative breast disease, a therapeutically effective amount of a drug normally inhibits (i.e. slows to some extent and preferably stops) tumor growth and/or reduces tumor size. In the case of breast cancer, it may also inhibit (i.e. slow to some extent and preferably stop) cancer cell infiltration into peripheral organs and inhibit (i.e. slow to some extent and preferably stop) the development of tumor metastases. Furthermore, it may kill existing breast cancer cells. A therapeutically effective amount of a drug may also relieve one or more of the symptoms associated with a proliferative breast disease, such as breast cancer. For therapy, efficacy of the drug administration can be measured, for example, by assessing the time to disease progression (TTP) and/or determining the response rate (RR). Methods for determining the efficacy of therapy are dependent on the particular disorder and moreover well-known to the person skilled in the art (Kelloff G. F. et al. (2005) Eur J Cancer 41: 491-501). The optimum dose and treatment regimen for the particular agent administered as an anti-estrogen therapeutic are described in detail in the state of the art for several anti-estrogen drugs. For example, with respect to Tamoxifen, a therapeutically effective dosis may be about 10, 20, 30, 40, 50, 60, 70, 80, 90 and 100 mg/per day for a period of one to several years for example 2-5 years. A dosis of 60 mg/per day for a period of 5 years is reported in the literature (Kung et al. (2003), J Clin Endocrinol Metab, 88(7):3130).

According to a preferred embodiment of the invention, the anti-estrogen treatment mentioned in the above methods comprises administration of an estrogen antagonist. According to the present invention, the term "estrogen antagonist" refers to a compound that binds to an estrogen receptor, and preferably to the alpha isoform of the estrogen receptor, (either in homodimeric or heterodimeric form), thereby inhibiting or substantially reducing the effect of the respective agonist (estrogen). The estrogen antagonist can be a competitive or non-competitive antagonist. A competitive estrogen antagonist competes with estrogen (or other agonists) for an estrogen receptor. By binding of the competitive estrogen antagonist to an estrogen receptor, the agonist estrogen is blocked from binding to the receptor. An example for such a competitive estrogen antagonist is Tamoxifen. In comparison, non-competitive antagonists antagonize the estrogen receptors by other means. For example, trilostane (Modrenal, Bioenvision) binds to the AF-1 domain of ER-alpha and ER-beta receptors in a non-competitive manner which is presumed to be allosteric. The AF-1 domain is involved in protein-protein interactions (but not estrogen binding) and trilostane binding thus contributes to modulation of receptor dimerization which is a prerequisite for activation (Puddlefoot J. R. et al. (2002), Int J Cancer 101: 17-22). Competitive or non-competitive estrogen antagonists can be found by common estrogen receptor binding assays, such as those described in the National Institutes of Health (NIH) publication no. 03-4504 (2002) including the protocols provided in the appendix.

According to a particularly preferred embodiment of the invention, the estrogen antagonist is selected from the group consisting of Tamoxifen (purchasable e.g. as Novaldex from Astra Zeneca, or from other manufactures, for example under the trade names Jenoxifen, Kessar, Nourytam, Tamobeta, Tamofen, Tamokadin, Tamoxasta, Tamox-GRY, Tamoxifen AL, Tamoxifen-biosyn, Tamoxifen cell pharm, Tamoxifen Heumann, Tamoxifen Hexal, Tamoxifen medac, Tamoxifen-ratiopharm, Tamoxigenat, Tamoximerck, Tamoxistad, Zemide, and the like), Raloxifene (purchasable e.g. as Revista from Eli Lilly), Clomifene (purchasable e.g. as Clomhexal from Hexal), Toremifene (purchasable as Fareston from GTx Inc.), Trilostane (purchasable as Modrenal from Bioenvision, UK only) or functional derivatives thereof. According to a particularly preferred embodiment of the invention, the estrogen antagonist is Tamoxifen or a functional derivative thereof. Functional derivates are generally obtained from the above compounds by chemical modification. In the case of Tamoxifen, such derivates comprise for example 4-hydroxytamoxifen and 4-hydroxy-N-desmethyl-tamoxifen (Endoxifen).

Alternatively, the anti-estrogen treatment may comprise the administration of an agent which interferes with estrogen synthesis. By inhibiting, blocking or reducing the production of estrogens, a decrease in binding of estrogen (such as estradiol) to the estrogen receptors, preferably the estrogen receptor alpha, can be achieved. Agents which interfere with estrogen synthesis comprise, for example, aromatase inhibitors. Aromatases belong to the group of enzymes which comprise cytochrome P450 and catalyze the aromatization of androgens to estrogens, a key step in the production of estrogens. The inhibition of the aromatase enzyme results in reduced estrogen levels (hypoestrogenism). Aromatase inhibitors comprise compounds such as Anastrozole (purchasable as Arimidex from Astra Zeneca), Letrozole (purchasable as Femara from Novartis Pharmaceuticals), Formestan (purchasable as Lentaron from Novartis) and Exemestane (purchasable as Aromasin from Pharmacia). Aromatase inhibitors may be identified by common enzyme inhibition assay using the aromatase enzyme. As an example such an assay is described in Matsui et al (2005), J Pharm Biomed Anal, 38(2):307-12.

According to another aspect, the anti-estrogen treatment comprises administration of an agent which downregulates expression of an estrogen receptor, preferably the estrogen receptor alpha. Preferably, the agent which downregulates expression of an estrogen receptor is Fulvestrant or a functional derivative thereof. Fulvestrant may be obtained under the name Faslodex from Astra Zeneca. Fulvestrant is an estrogen receptor antagonist which blocks estrogen binding to an estrogen receptor, preferably to the estrogen receptor alpha. Additionally, it induces downregulation of the receptor (Morris, C. and Wakeling, A., Endocr Relat Cancer (2002), 9(4): 267-76; Gradishar, W. J., Oncologist. (2004), 9(4): 378-84). Other compounds to trigger downregulation of the estrogen receptor may include small interfering RNAs (siRNAs), targeting specific (e.g. ER) mRNA (see Grunweller et al. (2005), Current Medicinal Chemistry 12(26), 3143-3161), or other modifiers of transcription as reviewed in Melnick et al. (2005), JCO 23(17), 3957-3970).

The anti-estrogen treatment may be performed as a monotherapy or in a combination therapy together with chemotherapy and/or radiation. Preferably, the anti-estrogen treatments are to be performed as a monotherapy. Anti-estrogen therapy may also be performed as an adjuvant therapy in patients afflicted with breast cancer in order to prevent metastases. Anti-estrogen therapy can also be useful for prophylactic treatment of patients at high risk of developing breast cancer in order to prevent cancer development.

Normally, tumors of the breast, such as carcinomas, are removed by surgical means in a first therapeutic step which is followed most cases by an adjuvant therapy. At present, several surgical approaches have been established, including lumpectomy with and without subsequent radiation therapy and modified radical mastectomy. A lumpectomy is the removal of the primary breast tumor and a small amount of surrounding tissue. Usually, most of the axillary lymph nodes are also removed. A modified radical mastectomy is the removal of the whole breast, most of the axillary lymph nodes, and often the lining over the chest muscles. The smaller of the two chest muscles is sometimes taken out to help in removing the lymph nodes. Where surgical removal of the tumor is not possible, for example in cases where invasion of the healthy tissue is in a too advanced state, chemotherapy is often employed to reduce the tumor size before lumpectomy.

The principal purpose of adjuvant therapy is to eradicate cancer cells that may have spread from the tumor located in the breast and remain after surgical removal. Thus, treatment is normally performed systemic, for example, by oral uptake or injection into the bloodstream which allows the agent to circulate through the body. Whether a patient has to be treated with an adjuvant therapy is dependent on the individual risk of the patient to develop metastases at a later stage of the disease and several other factors, such as tumor size, histological type of the tumor as well as the grade of aggressiveness of the disease. On the basis of these factors, patients are attributed to a low, mid or high risk to develop metastases. Most frequently, adjuvant therapy for breast cancer comprises anti-estrogen therapy or chemotherapy, either alone or in combination.

In the context of an adjuvant therapy, chemotherapy is commonly performed in accordance with the so-called CNF scheme, using the substances cyclophosphomid, metotrexat and 5-fluoruracil. Alternatively, chemotherapeutic regimens based on anthracycline-containing agents are also available. Other frequently used chemotherapeutic agents include alkylating agents, e.g. ethylenimines and methylamelamines, such as thiotepa, altretamine, triethylenemelamine, trietylenephosphoramide, triethylenethiophosphaoramide and trimethylolomelamine; alkyl sulfonates such as busulfan and piposulfan; nitrogen mustards such as ifosfamide, chlorambucil, estramustine, chlornaphazine, cholophosphamide, mechlorethamine, mechlorethamine oxide hydrochlonde, novembichin, phenesterine, prednimustine, trofosfamide; nitrosureas such as fotemustine, lomustine, carmustine, chlorozotocin, nimustine, ranimustine; aziridines such as carboquone, benzodopa, meturedopa, uredopa; purine analogs such as 6-mercaptopurine, fludarabine, thioguanine; pyrimidine analogs such as ancitabine, azacitidine, 6-azauridine, carmofur, cytarabine, dideoxyuridine, doxifluridine, enocitabine, floxuridine, 5-FU; and nitrosureas such as carmustine, chlorozotocin, fotemustine, lomustine, nimustine, ranimustine and the like.

However, due to the mainly unspecific mode of action of the respective agents, chemotherapy is a severe treatment with considerable side effects for the patient. Thus, it is highly desirable to identify patients which can effectively treated without or with low-dose chemotherapy. In this context, it is of critical relevance to identify patients which exhibit an enhanced clinical response to anti-estrogen therapy, such as administration of Tamoxifen. Thus, in one aspect the present invention provides a suitable means for identifying a subgroup of estrogen receptor-positive patients which show an enhanced response to anti-estrogen treatment and, therefore, are suitable to be subjected to treatment protocols which are based on the administration of anti-estrogens, either without the need for concurrent chemotherapy or in combination with low-dose chemotherapy. Therefore, the invention contributes to a better prognosis as well as to an improved overall condition of the patient during treatment. In this manner, effective treatment can be conducted in a way that is much less associated with the unpleasant and health-threatening effects of chemotherapy and at the same time maintain a high level of medical effect.

The invention also provides a suitable method for the long-term surveillance of the responsiveness of a tumor or patient to anti-estrogen treatment, in which the method for identifying a tumor as responsive to anti-estrogen treatment as described herein is performed sequentially, for example, twice within a period of 3, 6, 9, 12 or 18 month in order to monitor if changes to the amplification status have occured during a particular treatment regimen, for example treatment with Tamoxifen or another anti-estrogen drug. The method will be particularly suitable to evaluate whether a given tumor resulting from a proliferative breast disease develops resistance against the anti-estrogen treatment.

Tumors cells with low level amplification, with normal ESR1 gene copy numbers, or cells with a loss of ESR1 might not respond optimal to anti-estrogen treatment or even escape such treatment. Such cells are likely to have a selection advantage under anti-estrogen treatment and might be a source for the development of hormone refractory (resistant) tumors. Such an effect is known for topoisomerase 2 alpha, the molecular target of anthracycline therapy. Studies carried out in vitro suggested that cell lines without TOP2A aberrations or those with TOP2A deletion are less sensitive to anthracycline therapy than cell lines with TOP2A amplification or overexpression (Järvinen et al. (2000), Am J Pathol 156:839). Only recently, this observation has been confirmed in a clinical study including 391 breast cancer patients (Scandinavian Breast Group Trial 9401 (2006), J Clin Oncol.

24(16):2428). Accordingly, monitoring of changes in the ESR1 amplification status in sequential biopsies from breast cancer patients could be a potential marker for prediction of response to anti-estrogen treatment.

The methods of the present invention are based on the predictive impact of ESR1 gene amplification. ESR1 amplification can be conveniently detected by means which directly target the ESR1 coding sequence provided by nucleotides 1048135 to 1343855 in SEQ ID NO:1 or at least a part of this coding sequence. Furthermore, ESR1 amplification can also be confirmed by detecting amplification of a sequence portion of SEQ ID NO:1 which is located outside of the ESR1 coding sequence. Several polymorphisms exist in the human sequence of the ESR1 gene. Moreover, non-coding regions within the ESR1 gene might deviate to some extent between distinct individuals. Thus, although the present invention mainly refers to nucleotide sequence portions of SEQ ID NO:1 as a reference, it is clear that also nucleotide sequences having substantial sequence identity to nucleotide sequence portions of SEQ ID NO:1 may be equally used in the context of the invention. Preferably, such nucleotide sequence shares at least 70, 75, 80, 85, 90, 91, 92, 93, 94, 95, 96, 97, 98, 99 or even 99.5 % sequence identity to a nucleotide sequence portion of SEQ ID NO:1. Preferably, such nucleotide sequence shares at least 95% sequence identity to a nucleotide sequence portion of SEQ ID NO:1.

Generally, the amplification of a specific gene leads to the co-amplification of genomic sequences which are located 5' or 3' of said gene. Hence, the chromosomal fragment which is duplicated during amplification regularly not only comprises the sequence of a single gene, but also additional genomic sequences which can be used as a marker to confirm ESR1 amplification. As described in example 6, a sequence range having a size of approximately 2.7 Mb (provided in SEQ ID NO:1) which contains the ESR1 coding sequence was found to be suitable for confirming amplification of the ESR1 coding sequence. Specifically, it was found that the sequences of SEQ ID NO:1 which are located outside the ESR1 coding sequence are only amplified, if the ESR1 coding sequence is also amplified, i.e. they are co-amplified with the ESR1 coding sequence. This means that in cases where amplification of a sequence portion of SEQ ID NO:1 (or a related nucleotide sequence having, for example, at least 95% sequence identity to such portion) is detected, for example, amplification of a sequence located at the very 5' or 3' end of the sequence of SEQ ID NO:1, amplification of ESR1 is to be assumed. Thus, ESR1 amplification can be confirmed by detecting amplification of any sequence portion of SEQ ID NO:1 (or a nucleotide sequence having, for example, at least 95% sequence identity to such portion) which is either located inside or outside of the ESR1 coding sequence.

A nucleotide sequence portion located outside the ESR1 coding sequence which can be selected for confirming ESR1 amplification may be located in the region extending from position 1 to position 1048135 of the sequence shown in SEQ ID NO:1. For example, the nucleotide sequence portion may be located between nucleotides 100000 to 1048135, 200000 to 1048135, 300000 to 1048135, 400000 to 1048135, 500000 to 1048135, 600000 to 1048135, 700000 to 1048135, 750000 to 1048135, 760000 to 1048135, 770000 to 1048135, 780000 to 1048135, 790000 to 1048135, 800000 to 1048135, 810000 to 1048135, 820000 to 1048135, 830000 to 1048135, 840000 to 1048135, 850000 to 1048135, 860000 to 1048135, 870000 to 1048135, 880000 to 1048135, 890000 to 1048135, 900000 to 1048135, 910000 to 1048135, 920000 to 1048135, 930000 to 1048135, 940000 to 1048135, 950000 to 1048135, 960000 to 1048135, 970000 to 1048135, 980000 to 1048135, 990000 to 1048135, 1000000 to 1048135, and even more preferably between 1010000 to 1048135, 1020000 to 1048135, 1030000 to 1048135, 1040000 to 1048135, 1041000 to 1048135, 1042000 to 1048135, 1043000 to 1048135, 1044000 to 1048135, 1045000 to 1048135, 1046000 to 1048135, 1047000 to 1048135, 1048000 to 1048135 of the sequence shown in SEQ ID NO: 1. Likewise, the nucleotide sequence portion may be located between nucleotides within the region extending from position 1343855 to 2725892 of the sequence shown in SEQ ID NO: 1. For example, the nucleotide sequence portion may be located between nucleotides 1343855 to 1344000, 1343855 to 1345000, 1343855 to 1346000, 1343855 to 1347000, 1343855 to 1348000, 1343855 to 1349000, 1343855 to 1350000, 1343855 to 1351000, 1343855 to 1352000, 1343855 to 1353000, 1343855 to 1354000, 1343855 to 1355000, 1343855 to 1356000, 1343855 to 1357000, 1343855 to 1358000, 1343855 to 1359000, 1343855 to 1360000, 1343855 to 1370000, 1343855 to 1380000, 1343855 to 1390000, 1343855 to 1400000, 1343855 to 1410000, 1343855 to 1420000, 1343855 to 1430000, 1343855 to 1440000, 1343855 to 1450000, 1343855 to 1460000, 1343855 to 1470000, 1343855 to 1480000, 1343855 to 1490000, 1343855 to 1500000, 1343855 to 1510000, 1343855 to 1520000, 1343855 to 1530000, 1343855 to 1540000, 1343855 to 1550000, 1343855 to 1560000, 1343855 to 1570000, 1343855 to 1580000, 1343855 to 1590000, 1343855 to 1600000, 1343855 to 1610000, 1343855 to 1620000, 1343855 to 1630000, 1343855 to 1640000, 1343855 to 1650000, 1343855 to 1660000, 1343855 to 1670000, 1343855 to 1680000, 1343855 to 1690000, 1343855 to 1700000, 1343855 to 1800000, 1343855 to 1900000, 1343855 to 2000000, 1343855 to 2100000, 1343855 to 2200000, 1343855 to 2300000, 1343855 to 2400000, 1343855 to 2500000 or 1343855 to 2725892 of the sequence shown in SEQ ID NO: 1. Of course, it is also possible that the nucleotide sequence portion covers a part of the ESR1 coding sequence and extends into the flanking region framing ESR1.

If amplification of ESR1 is tested by detecting amplification of a sequence portion of SEQ ID NO:1 which is located outside of the ESR1 coding sequence (or a nucleotide sequence having, for example, at least 95% sequence identity to such portion) and no amplification of the selected sequence portion can be detected in a sample, this does not necessarily allows the conclusion that no ESR1 amplification is present in the tested cells. In these cases, the amplicon (i.e. the amplified genomic sequence entity consisting of the ESR1 gene and flanking regions) in the chromosome might be smaller in size, so that further detection assays using nucleotide sequence portions of SEQ ID NO:1 (or nucleotide sequences having, for example, at least 95% sequence identity to such portions) which are in closer vicinity to the ESR1 gene or which are directly derived from the ESR1 gene should be performed. The person of skill will have no problems to determine flanking regions on the 5' end and at the 3' end of the ESR1 gene, respectively, which are obligatory co-amplified in each ESR1 amplification event. Thus, a "minimum" amplicon can be readily determined by the person skilled in the art, simply by screening a high number of tumor cell samples for ESR1 amplification, for example by FISH using a probe which directly binds to the ESR1 coding sequence, and subsequently determining the 5' and 3' ends of the Identified amplicons. Once in receipt of such minimum amplicon, it is possible not only to positively confirm an ESR1 amplification on the basis of an amplified sequences outside the coding sequence, but also to exclude ESR1 amplification on the basis of such sequences in case the test result should be negative. In a method using the minimum amplicon, essentially all tumor cells which exhibit ESR1 amplification will be identified. Thus, according to a preferred aspect, a nucleotide sequence portion of the nucleotide sequence of SEQ ID NO:1 (or a nucleotide sequence having, for example, at least 95% sequence identity to such portion) for use in the detecting step is chosen which is obligatory co-amplified with the ESR1 coding sequence.

An alternative possibility to establish a method which identifies all ESR1-amplified tumor cells is to select the ESR1 coding sequence for amplification analysis. Thus, according to a preferred embodiment of the invention, the nucleotide sequence portion of SEQ ID NO:1 comprises at least a part of the ESR1 coding sequence ranging from nucleotide positions 1048135 to 1343855 of SEQ ID NO:1. Alternatively, a nucleotide sequence having the above described sequence identity to such portion, preferably at least 95%, may also be used. According to this particular embodiment, amplification of at least a part of the ESR1 gene is directly tested. The sequence portion can be selected to include a part of the coding sequence of ESR1 and a part of the flanking regions from the 3' or 5' end of the ESR1 coding sequence. The selected nucleotide sequence portion of SEQ ID NO:1 may also comprise the complete ESR1 coding sequence, as provided by nucleotide positions 1048135 to 1343855 of SEQ ID NO:1, for example, as a probe to be used in FISH assays. According to a further preferred embodiment of the invention, the nucleotide sequence portion of SEQ ID NO:1 is located within the ESR1 coding sequence ranging from nucleotide positions 1048135 to 1343855 of SEQ ID NO:1. Again, nucleotide sequence having, for example, at least 95% sequence identity to such portions are also included according to the invention.

All methods of the present invention comprise the step of detecting in a cell sample from a tumor whether a nucleotide sequence portion of the nucleotide sequence of SEQ ID NO:1, for example the ESR1 coding sequence, or a nucleotide sequence having, for example, at least 95% sequence identity to such nucleotide sequence portion is amplified in the genome of the tumor cells. As used herein, a "nucleotide sequence portion of SEQ ID NO:1" means a segment of the genomic DNA as depicted in SEQ ID NO:1 consisting of at least 10 contiguous nucleotides, preferably of at least 20, 30, 40, 50 or 100 nucleotides, and most preferably of at least 50000, 100000, 150000 or more nucleotides of the sequence of SEQ ID NO:1. The size of the nucleotide sequence portion used for detecting amplification will depend on the method of detection of said sequence portion (see below). For example, if FISH assays are used for amplification detection, the selected sequence portion will correspond to the length of the probe and will preferably have a size of several kilobases, for example 40, 50, 60, 70, 80 100, 120, 140, 160, 180, 200, 300 or 400 kilobases. In comparison, if amplification detection will be performed by PCR, the sequence portion will correspond to the size the PCR product obtained by using specific primers, for example 50, 100, 150, 200, 300, 400 or 500 nucleotides. If amplification detection is performed by Southern Blotting, the nucleotide sequence portion to be selected can be in the range of 30, 40, 50, 60 nucleotides which corresponds to a common DNA probe regularly used in Southern Blotting.

An identity of 95% means that when aligning corresponding nucleotide sequences (whereas the use of gaps is allowed for proper alignment of corresponding nucleotides) only 5 nucleotides over a length of 100 nucleotides should be different. Preferably, nucleotide sequence portions having a size sufficiently large to exclude false-positive detection of amplification, for example by unspecific hybridization, are used.

As used herein, detecting whether a selected nucleotide sequence portion of the nucleotide sequence of SEQ ID NO:1 or a nucleotide sequence having substantial sequence identity thereto is amplified means that it is examined whether the nucleotide sequence portion of SEQ ID NO:1 or a nucleotide sequence having substantial sequence identity to such portion occurs in an increased copy number in the genome of a tested tumor cell relative to the genome of a normal cell with a balanced caryotype, preferably a normal diploid somatic cell of the same individual. Diploid organisms, such as mammals, usually have two copies (allels) of a given genomic nucleotide sequence, such as a gene sequence, in their somatic cells. Hence, a balanced caryotype of a somatic mammalian cell regularly comprises two copies of a given nucleotide sequence, for example of the ESR1 gene.

If the nucleotide sequence portion of SEQ ID NO:1 or a nucleotide sequence having, for example, at least 95% sequence identity to such portion is amplified in the cell sample, more copies of said nucleotide sequence portion or its related sequence are present in the genome of a tested cell when compared to a normal cell with a balanced caryotype. Thus, in cases where the selected nucleotide sequence portion is amplified in the genome of a cell, the copy number of said nucleotide sequence portion exceeds 2. For example, the copy number of said nucleotide sequence portion may be 3, 4, 5, 6, 7, 8, 9, 10, 11, 12, 13, 14, 15, 20, 30, 40, 50 or even up to 100 copies per cell. The copy number of said nucleotide sequence portion can also be decreased relative to the balanced caryotype of a somatic mammalian cell, which means that the cells have lost one or both copies of the nucleotide sequence portion from the relevant chromosome, for example from human chromosome 6. In cases where the nucleotide sequence portion has not been amplified, 2 copies of said sequence should be present per cell.

Typically, amplification of a gene, a gene fragment, or a larger portion of a chromosome comprising more than one gene is determined by assessing the number or intensities of signals obtained (depending on the specific detection method) for the gene, fragment or portion of interest relative to the number or intensities of signals of a reference sequence from the same DNA sample. For example, a sequence for which the copy number is known (i.e. from a gene or a non-coding DNA stretch which does not undergo amplification events) may be used as a reference. The nature of the reference sequence will depend on the specific method of determining the amplification event, e.g. PCR, Southern-Blot, FISH and the like (see below). For example, in fluorescence in situ hybridization assays, the sequence of the centromere of human chromosome 6 or 17 might be conveniently used as an intrinsic reference. Alternatively, if PCR approaches are used for assessing the copy number, reference genes may comprise one or more of the genes commonly used as "housekeeping genes" such as genes encoding human albumin glyceraldehyde 3-phosphate dehydrogenase (GAPDH), (β-actin, β-2 microglobulin, hydroxymethylbilane synthase, hypoxanthine phosphoribosylm transferase I, ribosomal protein L13a, succinate dehydrogenase complex (subunit A), TATA box binding protein, ubiquitin C, β-Globin (HBB), Phosphoglycerate kinase 1 (PGK1), Ribosomal protein L4 (RPL4), Large ribosomal protein P0 (RPLP0), Eukaryotic elongation factor 1 (EEF1A1), Eukaryotic translation elongation factor 1 (EEF1G), Succinate dehydrogenase complex A (SDHA), Muscleblind-like 2 (MBNL2), 28S Ribosomal RNA (28S), 18S Ribosomal RNA (18S), and the like. In cases, where an internal reference is simultaneously tested with the cells or DNA of the test samples, e.g. a normal somatic cell with a balanced caryotype, it may not be necessary to determine the specific number of copies of the ESR1 gene as long as it is shown that significantly more detection signals (which are correlated to the copy number of the ESR1 gene) are obtained in the test sample relative to the control sample.

The amplification of the nucleotide sequence portion of SEQ ID NO:1 (or the nucleotide sequence having, for example, at least 95% sequence identity to such portion) can be detected according to methods well-known in the art. The amplification is generally determined by analysis of the genomic DNA of a cell sample. The genomic DNA may be isolated and/or purified before determining the amplification status as usually required for PCR-based methods. For purification, commercially available kits, such as the QIAgen Genomic tip system (QIAgen, Hilden, Germany), may be employed. Other methods for purifying genomic DNA from different, types of cells, such as cells from human tissues are discussed in Sambrook, J. et al. (2001); Molecular Cloning: A Laboratory Manual (Third Edition), Cold Spring Harbor Laboratory Press. On the other hand, if cytogenic methods like fluorescence in situ hybridization (FISH) or immunohistochemistry are used, complete cells or tissue portions may be employed without the need to isolate the DNA in an initial step.

Several methods of identifying gene amplification events and/or determining the copy number of a DNA entity (such as a gene) have been described in the art. According to the present invention, detecting whether said nucleotide sequence portion of SEQ ID NO:1 (or a nucleotide sequence having, for example, at least 95% sequence identity to such portion) is amplified comprises DNA analysis using a probe which hybridizes to said nucleotide sequence portion (or to a nucleotide sequence having, for example, at least 95% sequence identity to such portion). Most preferably, the probe hybridizes to the ESR1 coding sequence ranging from nucleotide positions 1048135 to 1343855 of SEQ ID NO:1 or a part thereof (or to a nucleotide sequence having, for example, at least 95% sequence identity to such portion). As used herein, "hybridization" in the context with a primer or probe means that the primer or probe forms a non-covalent interaction with the target polynucleotide, e.g. the ESR1 gene in the genomic DNA of the cell to be tested or a flanking region thereto which is located on the same amplicon like the ESR1 gene. Preferably, the hybridization is a specific hybridization. As used herein, a specific hybridization of a probe or primer means that the probe or primer substantially only hybridizes with the target DNA sequence to which it shows complementarity and substantially not to unrelated sequences. Specific hybridization of a probe or primer occurs when the level of sequence identity between the probe or primer and the target sequence is sufficiently high. Generally, nucleotide sequences which share about 50, 60, 70 or 80%, more preferably 90 or 95, 96, 97, 98, or 99% sequence identity will specifically hybridize.

A specifically hybridized probe or primer remains hybridized to its target sequence under stringent conditions. As used herein, "stringent conditions" are conditions of temperature and salt that lead to an environment in which substantially only allows a primer or probe to remain hybridized to the target sequence in the case of a substantial sequence identity between the probe or primer and the target sequence. Stringent conditions are sequence dependent and are different under environmental parameters. Generally, stringent conditions are selected to be about 5° C. to 20° C. lower than the thermal melting point for the specific sequence at a defined ionic strength and pH. The thermal melting point is the temperature (under defined ionic strength and pH) at which 50% of the target sequence hybridizes to a perfectly matched (i.e. perfectly complementary) probe. For example, stringent conditions may include hybridization at a temperature ranging from 42° to 65° C. The hybridization solution and washing buffers used may be of high ionic strength, for example 6 times SSC buffer with or without the addition of SDS or other detergents.

Conditions for nucleic acid hybridization and calculation of stringencies can be found in Sambrook, J. et al. (2001); Molecular Cloning: A Laboratory Manual (Third Edition), Cold Spring Harbor Laboratory Press and Haymes, B. D. et al. (1985) in Nucleic Acid Hybridization, A Practical Approach, IRL Press, Washington, D.C. Moreover, computer programs are available for assisting the constructions of optimal probes and primers, for example, InforMax by Vector NTI (distributed by Invitrogen) or Premier Biosoft by Primer Premier.

A nucleic acid probe or primer used for the detection of the amplification of a nucleotide sequence portion of SEQ ID NO:1 or a nucleotide sequence having, for example, at least 95% sequence identity to such portion may be a perfect complement of the selected sequence portion or a part thereof (e.g. a sequence within the ESR1 coding sequence or a sequence located in a genomic region flanking ESR1) or may be substantially complementary thereto. A "perfect" complementary probe or primer means that every nucleotide of the probe or primer molecule is complementary to the nucleotide at the corresponding position of the target sequence. A probe or primer is "substantially complementary" to a target sequence if one or more nucleotides in the primer or probe are not complementary to the corresponding nucleotide in the target sequence, whereas a sufficient number of complementary nucleotides exist, so that the specific hybridization can occur.

Specific hybridization of a probe to the corresponding nucleotide sequence portion enables detection of the number of copies of said nucleotide sequence portion in a sample, such as a tissue sample. For this purpose, the probe will comprise a detectable label. Numerous different substances are available in the art for labeling a DNA probe, including compounds or composition detectable by spectroscopic, photochemical, biochemical, immunochemical, electrical, optical or chemical means. The labeling is intended to encompass direct labeling of the probe by coupling (i.e., physically linking) a detectable substance to the probe, as well as indirect labeling of the probe by reactivity with another reagent that is directly labeled. Examples of indirect labeling include end-labeling of a DNA probe with biotin such that it can be detected with fluorescently labeled streptavidin. Alternatively, the probes may be labeled with digoxigenin which can be detected with an anti-digoxigenin antibody which in turn can be labeled or recognized by a labeled secondary antibody. Detectable labels for use in the present invention include magnetic beads (e.g., Dynabeads), fluorescent dyes (such as fluorescein, texas red, rhodamine, CY3, CY5, Alexa dyes, green fluorescent protein, and others), radiolabels (e.g., $^{3}$H, $^{125}$I, $^{35}$S, $^{14}$C, or $^{32}$P), enzymes (e.g., horse radish peroxidase, alkaline phosphatase and others commonly used in an ELISA), and colorimetric labels such as colloidal gold (e.g., gold particles in the 40-80 nm diameter size range scatter green light with high efficiency) or colored glass or plastic (e.g., polystyrene, polypropylene, latex, etc.) beads. Numerous other systems and compound s for labeling DNA probes are known in the art.

According to the invention, detecting whether the nucleotide sequence portion of SEQ ID NO:1, for example a sequence located within the coding sequence of ESR1, or a nucleotide sequence having, for example, at least 95% sequence identity to such portion is amplified may comprise Southern-Blotting. Southern blotting is a well established method for locating a particular DNA sequence within a complex mixture. DNA, such as genomic DNA, is digested with a restriction enzyme and separated by gel electrophoresis in an agarose gel. Subsequently, the DNA is transferred from the agarose gel onto a membrane (such as a nylon or nitrocellulose membrane) which is incubated with a labeled DNA probe specific for the sequence to be detected. The location of DNA fragments derived from the genomic DNA that hybridizes with the probe can be displayed by detecting the label. If the ESR1 gene is amplified, at least two fragments (of the same or different size) should be detected in Southern blotting. The probes used in Southern blotting are usually indirectly labeled with molecules that can be detected by systems that provide for an enhanced signal intensity (such as digoxigenin detection by an anti-digoxigenin antibody or biotin detection by horseradish peroxidase-conjugated streptavidin and subsequent exposure to a chemiluminescent substrate). Alternatively, Southern blotting probes are often radiolabled which produces a strong signal. As a consequence, probes used in Southern blotting may be of considerably short length when compared to other hybridization approaches (see below). Usually, the probe used in Southern blotting will have the size of 15-20 bp, more preferably up to 25, 30, 35, 40, 45, 50, 55, 60 or 65 bp.

According to a particularly preferred aspect, detecting whether the nucleotide sequence portion of SEQ ID NO:1, for example a sequence located within the coding sequence of ESR1, or a nucleotide sequence having, for example, at least 95% sequence identity to such portion is amplified comprises fluorescent in-situ hybridization (FISH). Protocols for conducting FISH analysis with labeled probes are available in the art (see, for example, Cherif et al. (1989) Hum Genet. 1989 March;81(4):358 or Hyytinen et al. (1994) Cytometry 16(2): 93). In such an in-situ hybridization assay, the cells or tissues to be examined are normally fixed to a solid support, such as a glass slide. Cells may be intact in case of touch preparations of surgical samples or truncated in case of tissue sections. Subsequently, the cells are typically denatured with heat or alkali. The cells are then contacted with a hybridization solution at a moderate temperature to permit annealing of labeled probes specific to the nucleic acid sequence encoding the protein. The probes are typically labeled, e.g., with one or more fluorescent reporters. The targets are then washed at a predetermined stringency or at an increasing stringency until an appropriate signal to noise ratio is obtained. When the fluorescence-labeled nucleic acid probes are hybridized to cellular DNA targets, the hybridized probes can be viewed directly using a fluorescence microscope. By using multiple nucleic acid probes with different fluorescence colors, simultaneous multicolored analysis (i.e., for different genes or sequences) can be performed in a single step on a target cell. Fluorochrome-directly labeled nucleic acid probes eliminate the need for multi-layer detection procedures (e.g., antibody-based system) which allows for fast processing and also reduces non-specific background signals. The fluorochrome-directly labeled nucleic acid probes used in FISH assays are usually longer than those used in Southern-blotting. Conventional fluorescence in situ hybridization (FISH) commonly uses cloned genomic probes for hybridization to fixed, denatured chromosomes. These genomic probes are generally large and most often cloned into vectors, such as cosmids, yeast, or bacterial artificial chromosomes that accept genomic inserts having a size of up to several 100 kilobases. According to the invention, the FISH probe may have a size of 1, 5, 10, 20, 30, 40, 50, 60 or up to 100 kb, or even of 200, 300 or 400 kb. FISH probes may be directly labeled (e.g. by fluorescent dyes) or indirectly labeled (e.g. by a hapten, such as digoxigenin or biotin). According to the invention, it is most preferred to use fluorescent labels, so that the result of the hybridization to the genomic DNA of the test sample (e.g. cells of tissue derived from biopsy) can directly be observed. As a intrinsic reference, the sequence of the centromere of human chromosome 6 or 17 might be conveniently used in FISH assays (see examples). Labeling kits for fluorescence labeling may be obtained from different manufacturers, such as the SpectrumO-range- SpectrumGreen-, and Spectrum-Red-labeling kit purchasable by Vysis Inc., Downer's Grove, Ill., USA. FISH assays have found widespread use in the detection of gene amplification events, for example in the context of detection of the erb-B2 (HER-2/neu) gene encoding the orphaned receptor tyrosine kinase Erb-B2 (also referred to as HER-2 or neu) which is reported to be a frequently amplified oncogene in breast cancer. See, for example, the publications of Masood et al. (1998), Ann Clin Lab Sci. 28(4):215, Press et al. (2002) J Clin Oncol. 2002 20(14):3095, all of which are included by reference.

A further alternative to detect a potential amplification of the nucleotide sequence portion of SEQ ID NO:1, for example a sequence located within the coding sequence of ESR1, or a nucleotide sequence having, for example, at least 95% sequence identity to such portion involves Comparative Genomic Hybridization (CHG). This cytogenetic method allows the entire genome to be scanned in a single step for copy number aberrations in chromosomal material. CGH is described in detail, for example in Kallioniemi O., et al. (1992), Science 258: 818-821 (conventional CGH) or Solinas-Toldo S., et al., (1997), Genes Chromosomes Cancer 4: 399-407 (matrix CGH). In CGH, the complete genomic DNA of a cell or cell population to be examined, such as a tumor cell (test DNA), is used as a probe in a hybridization assay, typically against the genomic DNA of normal healthy cells (reference DNA). Test and reference DNA are differently labeled and co-hybridized on a target matrix which comprises of metaphase chromosome spreads from healthy individuals (conventional CGH) or of an array of defined DNA sequences (cloned human genome fragments of several Kilobases or oligonucleotides; array- or matrix-CGH). It may also be possible to perform CGH without simultaneous co-hybridization of a reference DNA, e.g. when using so-called GeneChips (Affymetrix Santa Clara, Calif.).

Chromosomal regions which have been gained or lost when compared to the balanced caryotype control DNA can be detected by their increased or decreased staining relative to the general staining of the reference genomic DNA. Regions in an increased copy number give rise to a stronger signal compared to the control DNA. One may also, as a negative control, test a reference DNA from a healthy tissue, preferably tissue of the same part of the body (e.g. healthy breast tissue). The reference DNA may be derived from the donor of the tumor tissue or from another healthy donor. The alterations are classified as DNA gains and losses and reveal a characteristic pattern that includes copy number changes at chromosomal and subchromosomal levels. The use of CGH for analysis of solid tumors has revealed a number of recurrent chromosomes copy number aberrations including amplifications that had not been detected previously. For example, by use of CGH amplifications at chromosome 3q26-27 and 20q13 in various tumors were detected and led to the identification of target genes, such as PIK3CA and ZNF217 which are amplified in ovarian cancer and breast cancer, respectively.

As used herein, the term CGH comprises matrix CGH, array CGH and any other method of comparative genome hybridization using isolated labeled DNA and complementary DNA fixed on a solid surface. Most conveniently, CGH methods are conducted by use of array-based hybridization formats. Arrays typically comprise a multiplicity of different probe or target nucleic acids attached to one or more surfaces. Preferably, the surface is a solid surface, such as polyethylene, polypropylene, polystyrene, nitrocellulose, nylon, glass, quartz, silicones, polyformaldehyde, cellulose, or cellulose acetate. In a preferred embodiment, the multiplicity of nucleic acids (or other moieties) is attached to a single contiguous surface or to a multiplicity of surfaces juxtaposed to each other. In an array format a large number of different hybridization reactions can be run simultaneously. Arrays, particularly nucleic acid arrays can be produced according to a wide variety of methods known to the person of skill, for example by spotting using a pipette or by oligonucleotide synthesis technology. Methods for preparing arrays are described, for example, in Xing, W. L. and Cheng, J. (eds.) Biochips. Technology and Applications, Springer, Berlin 2003.

Aside from hybridization-based assays using labeled probes, amplification of the nucleotide sequence portion of SEQ ID NO:1, for example a sequence located within the coding sequence of ESR1, or a nucleotide sequence having, for example, at least 95% sequence identity to such portion can also be detected by PCR-based methods. Thus according to a further preferred aspect, detecting whether the selected nucleotide sequence portion of SEQ ID NO:1 is amplified comprises a PCR, preferably a quantitative PCR (qPCR). Preferably, the PCR uses at least one primer which hybridizes to the ESR1 coding sequence ranging from nucleotide positions 1048135 to 1343855 of SEQ ID NO:1 or a part thereof.

Protocols for qPCR are known to the person skilled in the art and can be found, for example, in Bartlett and Stirling (2003), PCR Protocols (Methods in Molecular Biology), 2nd edition, Humana Press, Totowa, N.J., USA. Quantitative PCR is a method for multiplying nucleic acid molecules which additionally allows for a quantification of the PCR product. Quantification can be achieved by comparison, after termination of the PCR, of the signal obtained from the product with a standard curve previously generated with control samples from an exogenous sequence of known concentration and/or copy number (see, for example, Bustin, S. A. (2004), A-Z of Quantitative PCR (IUL Biotechnology, No. 5) (Iul Biotechnology Series) International University Line, La Jolla, USA).

Alternatively, an internal standardization using an endogenous housekeeping gene or sequence for calibration purposes may be used as well. In this method, two different genomic sequences are simultaneously co-amplified using two sets of primer pairs in one reaction tube. One sequence belongs to a single copy gene that does not undergo DNA amplifications and serves as an intrinsic reference to measure the relative DNA copy number difference of the test sequence (e.g. the nucleotide sequence portion selected from SEQ ID NO:1 or a nucleotide sequence having, for example, at least 95% sequence identity to such portion). Because in a PCR reaction the amount of DNA product is doubled with each cycle, the total DNA yield at the end of the reaction depends on the amount of template DNA that was initially present in the sample. If the test gene is amplified there will be abundant PCR product of the test gene as compared to the reference gene after PCR. The ratio between the amounts of PCR products of the reference gene and the test gene reflects the copy number difference between the two genes in the tissue sample. Such PCR approach has been described, for example, as double differential polymerase chain reaction (ddPCR) by Brandt B., et al. (1995), Gene 159: 29-34.

Another possibility for quantification resides in the use of a competitive PCR which utilizes an exogenously added standard composed of neutral DNA fragments, flanked by a common target sequence with target specific primers. In this PCR, one set of primers (directed to the target sequence or gene) is used to amplify both the target sequence or gene and the neutral DNA fragment. The neutral DNA fragments compete with the target DNA for the same reagents and thus act as an internal standard. The internal standard is designed to generate a PCR product of a different size than the target gene. The quantitative competitive PCR targets two templates competing for the same primers in the same reaction. By knowing the amount of internal standard added to the reaction, one can determine the amount of target DNA present, in this case the nucleotide sequence selected from SEQ ID NO:1 or a nucleotide sequence having, for example, at least 95% sequence identity to such portion. Different methods and devices may be utilized to determine the amount of PCR products, including gel electrophoresis, capillary electrophoresis, or real time PCR systems.

According to a particular preferred embodiment, detecting whether the selected nucleotide sequence portion of SEQ ID NO:1 is amplified comprises real-time PCR. If real time PCR methods are used, the amount of DNA product may be detected online during the PCR using sequence unspecific fluorescence dyes (e.g. SybrGreen) or sequence specific fluorescence labeled probes (Taqman probes, FRET probes, molecular beacons). Real time quantitative PCR methods are well known to the person of skill and have been described in great detail in the prior art. For an overview, see Bartlett and Stirling (2003), PCR Protocols (Methods in Molecular Biology), 2nd edition, Humana Press, Totowa, N.J., USA.

For the PCR-based methods according to the invention, the oligonucleotide primers used for generating the PCR product are derived from the sequence provided in SEQ ID NO:1 or a nucleotide sequence having, for example, at least 95% sequence identity to such portion. According to a preferred embodiment, at least one primer used in the PCR hybridizes to the ESR1 coding sequence ranging from nucleotide positions 1048135 to 1343855 of SEQ ID NO: 1 or a part thereof. Thus, the primers will generate a product which is located within the ESR1 coding sequence or extends from the ESR1 encoding sequence into the flanking regions. According to a further preferred embodiment, both primers hybridize to the ESR1 coding sequence, which means that the resulting PCR product (i.e. the nucleotide sequence portion selected from SEQ ID NO:1 or a nucleotide sequence having, for example, at least 95% sequence identity to such portion) is completely located within the ESR1 coding sequence.

According to a further preferred embodiment of the invention, the amplification status of the ESR1 gene can be indirectly detected by immunohistochemistry (IHC) using an antibody directed against the estrogen receptor alpha. Immunohistochemical detection of ER expression is performed on tissue sections from proliferative breast disease. A pathologist is required to analyze staining and to distinguish physiological from non-physiological ER expression. Physiological ER expression (normal ESR1 copy number) is characterized by an inhomogeneous staining pattern with different cell nuclei showing different staining intensities. In addition, ER staining is not found in all cell nuclei. In contrast, ESR1 amplified cells exhibit a homogeneous diffuse and uniformly strong staining in all cell nuclei of the proliferative disease.

The invention also relates to an in-vitro method of determining the responsiveness of metastases of a primary tumor which results from breast cancer to anti-estrogen treatment is provided. The method comprises the steps of
a) detecting in a cell sample from said tumor whether a nucleotide sequence portion of the nucleotide sequence of SEQ ID NO:1 or a nucleotide sequence having at least 95% sequence identity to such portion is amplified in the genome of said tumor cells;
b) classifying said metastases as responsive to anti-estrogen treatment, if the nucleotide sequence portion of the nucleotide sequence of SEQ ID NO:1 or a nucleotide sequence having at least 95% sequence identity to such portion is amplified in the genome of said tumor cells.

The present invention demonstrates that no differences between primary breast cancers and their metastases in terms of their ESR1 amplification status exists. All metastases examined in this regard showed ESR1 amplification when derived from a primary tumor showing ESR1 amplification. Similarly, no metastase was observed that exhibited ESR1 amplification when derived from a primary tumor not showing ESR1 amplification. Thus, the ESR1 amplification status of the primary tumor is representative for its metastases. This finding is of importance because adjuvant anti-estrogen treatment targets residual tumors cells and metastases rather than the primary tumor that usually has been surgically removed from the body.

According to a further aspect of the invention, kits are provided, which are suitable for conducting one of the methods explained above. Specifically, the kits include means and reagents for detecting whether a nucleotide sequence portion of SEQ ID NO:1 or a nucleotide sequence having, for example, at least 95% sequence identity to such portion is amplified in a cell sample (or a blood or bone marrow sample). For example, the kit can comprise one or more probes which hybridize to a nucleotide sequence portion of the nucleotide sequence of SEQ ID NO:1 or a nucleotide sequence having, for example, at least 95% sequence identity to such portion. In particular, the probe hybridizes to the ESR1 coding sequence ranging from nucleotide positions 1048135 to 1343855 of SEQ ID NO:1 or a part thereof. Moreover, the kit can comprise further reagents for labeling the probes to allow for the detection of the nucleic acid hybridization complexes. Preferably, reagents for visualizing the complex formed between one or more probes and the target sequence are also provided. According to a further preferred embodiment of the invention, a kit for PCR-based detection methods is provided. Such kit may comprise oligonucleotide primers for generating a PCR product having a sequence comprised by the sequence of SEQ ID NO:1 or a nucleotide sequence having, for example, at least 95% sequence identity to SEQ ID NO:1. Preferably, the kit comprises at least one primer which hybridizes to the ESR1 coding sequence ranging from nucleotide positions 1048135 to 1343855 of SEQ ID NO:1 or a part thereof. It may also comprise one or more polymerase enzymes, buffers, nucleotides and/or dyes suitable for PCR-based reactions, in particular for quantitative PCR or quantitative real-time PCR reactions. Typically, the oligonucleotide primers are about 10 nt, 50 nt, or 100 nt in length, preferably about 15 nt to 40 nt in length. The oligonucleotide primer exhibits a identity to a portion of the sequence shown in SEQ ID NO:1 or a nucleotide sequence having, for example, at least 95% sequence identity to such portion that is sufficient to allow for amplification of the sequence. Typically, the oligonucleotide primer contains at least 6, more usually 8, 10, 15, 20, 30, 40, 45 or 50 contiguous nucleotides of a nucleotide sequence portion of the sequence shown in SEQ ID NO:1 or a nucleotide sequence having, for example, at least 95% sequence identity to such portion, and in particular of the sequence ranging from nucleotide positions 1048135 to 1343855. Oligonucleotide primer or probes may be chemically synthesized.

According to a further aspect, the invention relates to the use of an anti-estrogen compound for the preparation of a medicament for the treatment of a patient having a tumor resulting from a proliferative breast disease, wherein the tumor cells have an amplified ESR1 gene in their genomic DNA, i.e. the genome of the tumor cells exhibit an amplified ESR1 gene. According to a preferred embodiment, the proliferative breast disease is breast cancer. The invention therefore provides, amongst other, a medicament for treating a subgroup of ER-positive breast cancer patients which show an significant increased reaction to anti-estrogen treatment, such as Tamoxifen. As used herein, an anti-estrogen compound is any compound that targets to interfere with the naturally occurring interaction between estrogen and an estrogen receptor, preferably the estrogen receptor alpha. Administration of an anti-estrogen compound results in blocking the signal-transducing function of the estrogen receptor, which effects the estrogen-induced reactions, such as cell proliferation. The anti-estrogen compound may act by competitive inhibition of estrogen binding to an estrogen receptor, preferably the estrogen receptor alpha. When administered in an therapeutically effective amount, anti-estrogen compounds bind to an estrogen receptor, preferably the estrogen receptor alpha, thereby blocking estrogen from binding to the receptor. Anti-estrogen compounds comprise estrogen antagonists, estrogen receptor down-regulators or aromatase inhibitors as described above.

According to a further preferred embodiment, the anti-estrogen compound is an estrogen antagonist as defined above. The estrogen antagonist to be used for preparing the medicament is preferably selected from the group of consisting of Tamoxifen, Raloxifene, Clomifene, Toremifene, Trilostane or functional derivatives thereof. Most preferably, the estrogen antagonist is Tamoxifen or a functional derivative thereof. Alternatively, the anti-estrogen compound to be used for preparing the medicament is an agent which interferes with estrogen synthesis, preferably an aromatase inhibitor. The aromatase inhibitor can be selected from the group of Anastrozole, Letrozole, Formestan, Exemestane or functional derivatives thereof. The estrogen antagonist to be used for preparing the medicament can also be an agent which downregulates expression of an estrogen receptor, preferably the estrogen receptor alpha, such as Fulvestrant or a functional derivative thereof. The compounds can be used according to dosis regimens well known in the art.

The invention will become more evident by the following examples which are solely meant to illustrate the invention, and not intended to limit the invention.

EXAMPLES

Contingency table analysis and Chi-square tests were used to study the relationship between histologic tumor type, grade, stage and gene amplification. Survival curves were plotted according to Kaplan-Meier. A log rank test was applied to examine the relationship between gene amplifications and patient survival.

1. Example 1

Determination of ESR1 Amplification by Array CGH

1.1 Tissues

For array CGH experiments, 30 fresh frozen tissue samples were collected from surgery specimens from the cantonal hospital Basel, Switzerland. All samples were classified by a pathologist as histological grade 3 according to Elston and Ellis (BRE); see Elston, C. W. and Ellis, I. O. (1991), Histopathology 19: 403-410.

1.2 DNA Isolation

For array CGH experiments, genomic DNA was extracted from three punched tissue cylinders (diameter 0.6 mm) from each of the 30 fresh frozen tumor samples according to the manufacturer's instructions of the QIAmp DNA Mini Kit (Qiagen, Hilden, Germany).

1.3 Array-CGH

The extracted DNA obtained from the 30 fresh frozen tumor samples was processed as described in the GeneChip Mapping 10K 2.0 Assay Manual (Affymetrix, Santa Clara, Calif.). All other necessary reagents were provided with the GeneChip Human mapping 10 k Xba assay kit (Affymetrix, Santa Clara, Calif.), and all experimental steps were conducted as described in the GeneChip Mapping 10K 2.0 Assay Manual. Briefly, 250 ng of the DNA were digested with the XbaI restriction enzyme, ligated to an adapter and amplified by PCR. The resulting PCR products were fragmented, end-labeled and hybridized to the GeneChip Human Mapping 10K Array Xba 142 2.0. After hybridization, the microarray chip was washed and stained on an Affymetrix fluidics station. The chips were scanned using the Affymetrix GeneChip scanner 3000.

1.4 Data Acquisition and Analysis

Raw data from the scanned CGH arrays was acquired using the GeneChip Operating Software (Affymetrix). Quality of the data was checked as described in the GeneChip Mapping 10K 2.0 Assay Manual (Affymetrix, Santa Clara, Calif.). Only 22 of the samples passed these quality controls and were used for further data analysis. The data files were imported into the dChip software (Harvard, Boston), and pre-processing and normalization were performed as recommended in the user manual of the software. The resulting signal intensities were imported into Excel. Quartiles were calculated from all signal intensities belonging to one SNP. An average value was calculated from all values lying within the $2^{nd}$ and $3^{rd}$ quartile. This specific value was used as denominator for the calculation of the ratio of each SNP signal of each sample. The resulting ratios were logged (log base 2) and imported into the R suite (R Development Core Team). Using the DNAcopy package (E. S. Venkatraman and A. B. Olshen) of the BioConductor suit of R, change-points in the data were calculated and visualized. Regions with an elevated copy number were classified as amplified regions.

1.5 Results

Amplifications of genomic DNA portions of the tumor cells which include a chromosomal locus comprising the ESR1 gene were identified in 2 (9%) of the 22 successfully analyzed samples. The results of the CGH analysis can be seen in FIG. 1.

2. Example 2

Fluorescence In Situ Hybridization (FISH)

2.1 The general results obtained by CGH were verified by fluorescence in situ hybridization (FISH) using existing tissue microarrays. A breast cancer Prognosis Tissue Microarray containing more than 2517 breast tissues was analyzed. The composition and preparation of this Tissue Microarray (TMA) has been described in detail before (Ruiz, C., et al. (2006), Int J Cancer, 118: 2190-2194; Simon, R., et al. (2004), In: Molecular Diagnosis of Cancer; Roulston J. E., Bartlett J. M. S. (eds.) Humana Press Inc). The type of adjuvant treatment was known for 420 patients. A subset of 261 patients received anti-hormonal treatment by Tamoxifen derivates as the only therapy regimen after surgical removal of the tumor.

2.2 To study ESR1 amplification in non-malignant breast tissues, a second TMA was analyzed containing 73 samples of normal breast tissue and 186 pre-malignant breast tissues, including DCIS (n=62), LCIS (n=10), apocrine metaplasia ((n=14), intraductal hyperplasia (n=27), atypical intraductal hyperplasia (n=5), mastopathy (n=22), papilloma (n=31), and sclerosing adenosis (n=15) (Ruiz, C., et al. (2006), Int J Cancer, 118: 2190-2194).

Additionally, in order to address potential heterogeneity of ESR1 amplification between primary breast tumors and metastases, a third TMA was analyzed containing 815 tissue samples from 160 breast cancer patients. Primary tumors and corresponding metastases were included from 58 patients. Of the remaining 102 patients, no primary tumors (but multiple different metastases) were available. There were 5.0 metastases (range 1-15) on average per patient. Most metastases originated from the lungs (n=106), the liver (n=95), or the bone marrow (n=86). The site of origin had not been recorded in 125 samples.

2.3 The TMA sections were treated according to the Paraffin Pretreatment Reagent Kit protocol (Vysis, Downers Grove, Ill.) before hybridization. FISH was performed with a digoxigenated BAC probe (BAC RP11-450E24, RZPD, Germany) covering part of the ESR1 gene. The sequence of the probe corresponded to the sequence ranging from nucleotide 1.064.232 to nucleotide 1.203.918 of SEQ ID NO:1. As a reference, a Spectrum-Orange labeled chromosome 6 centromeric probe (CEP6) purchased from Vysis was used. Hybridization and posthybridization washes were according to the "LSI procedure" (Vysis). Probe visualization using fluorescent isothiocyanate (FITC)-conjugated sheep anti-digoxigenin (Roche Diagnostics, Rotkreuz, Switzerland) was as described (Wagner, U., et al. (1997), Am J Pathol, 151: 753-759). Slides were counterstained with 125 ng/ml 4',6-diamino-2-phenylindole in an antifade solution. Two different approaches were applied to define amplification. For a first rapid evaluation of the array, signal numbers were estimated for each tissue spot applying predefined criteria: Amplification was defined as presence of more gene signals than centromere signals. All tumors not meeting these criteria were considered non-amplified. In a second more refined analysis FISH signal numbers of the ESR1 gene and centromere 6 were counted in each tissue spot. In accordance to the definition that is recommended for routine diagnostic detection of HER2 amplification in breast cancer (Pathvysion Kit, Abbott Laboratories, North Chicago, Ill., USA), ESR1 copy number changes were subsequently rated according to the ratio of the ESR1 to centromere 6 signal numbers. Amplification was defined as presence of at least two times more ESR1 signals as Cen6 signals (ratio≧2). All other samples were regarded as non-amplified.

2.4 Results

FISH analysis of ESR1 was successful in 1679/2197 (76%) arrayed breast cancer tissues. FISH analysis failed in 518 cases either due to lack of tumor cells in the tissue spot or because of complete loss of tissue spots. When defining amplification as more ESR1 gene signals relative to centromere 6 signals, ESR1 amplification was present in 526/1679 (31%) analyzable tissue samples. ESR1 amplifications were significantly associated with low-stage (pT1, p=0.0416) and low-grade (G1, p<0.0001) tumors. Medullary cancers had a significant lower fraction of amplified tumors (4.2%, p<0.0001) as compared in ductal (32%), lobular (30%), tubular, and cribriform (28%) cancers. In contrast, mucinous cancers showed particularly high rates of ESR1 amplifications (48.6%, p=0.0012). If the definition of amplification was based on the ESR1 to Cen6 signal number ratio, ESR1 amplification (ratio≧2) was found in 20.6% of samples. The same associations between ESR1 amplification and tumor phenotype or patient prognosis were found using this definition of amplification. All associations of ESR1 copy number changes to breast cancer phenotype are summarized in the table provided in FIG. 2A. Using the same breast cancer TMA, amplifications of CCND1 in 20.1%, HER2 in 17.3%, MDM2 in 5.7%, CMYC in 5.3%, and EGFR in 0.8% of the tumors were found previously (Al-Kuraya, K., et al. (2004); Cancer Res, 64: 8534-8540).

Furthermore, by use of the second array containing samples from normal and pre-malignant tissues, ESR1 amplification was found in 15/40 (37%) DCIS, 2/3 (67%) LCIS, 10/23 (43%) papillomas, 3/11 (27%) intraductal hyperplasias, 1 of 2 atypical intraductal hyperplasias, 1/13 (8%) cases with mastopathy, 1/7 (14%) sclerosing adenoses, and 1/30 (3%) histologically normal breast tissue.

A preliminary analysis of the first 50 patients of the third array did not argue for major differences between primary breast cancers and metastases. ESR1 amplification was found in 15/50 (30%) patients. For 20 of these patients, both the primary tumor and at least one metastasis (average 4 metastases, range 1-8) was analyzable. ESR1 amplification was seen in 5 of these primary tumors. All matched metastases (n=20) also showed ESR1 amplification. Of the remaining 15 primary tumors without ESR1 amplification, none of the matched metastases (n=56) had ESR1 amplification.

3. Example 3

Immunohistochemistry 3.1 Immunohistochemical detection of the estrogen receptor alpha protein was performed using the above described TMAs and antibody NCL-L-ER-6F11 as a primary antibody (Novocastra, Newcastle, UK). The TMA slides were deparaffinized and incubated in a pressure cooker at 120° C. for 12 min in pH 6 citrate buffer (Retrievit 6 #BS-1006-00, BioGenex, San Ramon, Calif.). After blocking of endogeneous peroxidase, pre-diluted (1:1000) primary antibody was applied and the slides were incubated overnight at 4° C. The Vectastain ABC Elite system was used for detection of antibody binding. IHC scoring was performed according to the Allred score (Harvey, J. M., et al. (1999), J Clin Oncol, 17: 1474-1481). In brief, intensity of the estrogen receptor staining was recorded in a 4-step scale (0-3) and the fraction of ER positive tumor cells in a 5-step (1-5) scale. Combination of both parameters results in an 8-step score, where all samples with score>2 are regarded as ER positive.

3.2 Results

Immunohistochemical detection of ER expression was successful in 2018/2197 (92%) breast cancers. Like ESR1 amplification, ER expression was linked to low stage (pT1, p=0.002) and low grade (pT1, p<0.0001) cancers. Malignant tumors are classified according to the degree of malignancy of the cell (histological grade, G) and the extension of the tumor (tumor stage, pT). Criteria for the definition of grade are described in Elston, C. W. and Ellis, I. O. (1991), Histopathology 19: 403-410. Criteria for the definition of tumor stage are described in Wittekind C. et al. (2005) Tnm Atlas: Illustrated Guide to the Tnm/Ptnm-Classification of Malignant Tumors. Springer Medizin Verlag Heidelberg. ER expression was also less frequent in medullary (p<0.0001) but more frequent in mucinous cancers (p<0.0001; table 1).

Figure 3:
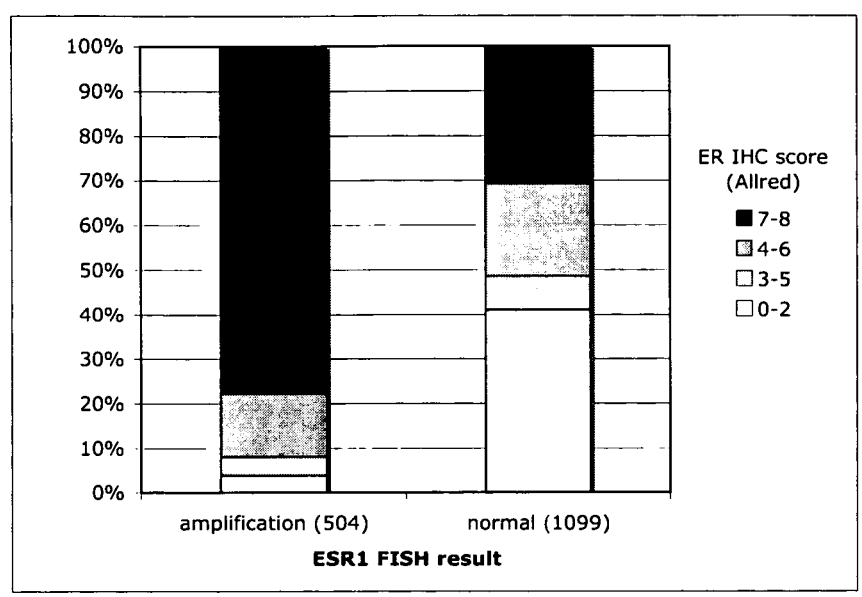
FIG. 3 demonstrates the relationship between ER protein expression and ESR1 amplification.

Relationship between ESR1 amplification and ER protein expression data from a previous unpublished immunohistochemistry experiment were compared with the ESR1 gene copy number state to address the association between ESR1 amplification and protein expression. There was a strong relationship between ESR1 amplifications and ER protein expression (p<0.0001). In 504 breast cancers with ESR1 amplification, 485 (96%) of samples were positive for ER expression. The vast majority of these tumors (78%) had the highest ER scores (7-8) according to Allred (Harvey, J. M., et al. (1999), J Clin Oncol, 17: 1474-1481); see FIG. 3. In contrast, tumors with normal ER copy numbers had only 59% ER IHC positive cases including 31% samples with a score 7-8 ER expression.

4. Example 4

Prognostic Relevance of ESR1 Alterations in Breast Cancer Treated With Tamoxifen 4.1 To address the impact of ESR1 gene amplification on response to anti-estrogen treatment, immunohistochemistry (IHC) data and FISH data were jointly analyzed for the samples of the subset of patients which have been treated with Tamoxifen. For this analysis, IHC data were grouped into ER negative (Allred scores 0-2) and ER positive (Allred scores 3-8, no amplification by FISH), and these groups were compared to a subset of patients with ESR1 amplification (FIG. 4).

4.2 Results

Figure 4:
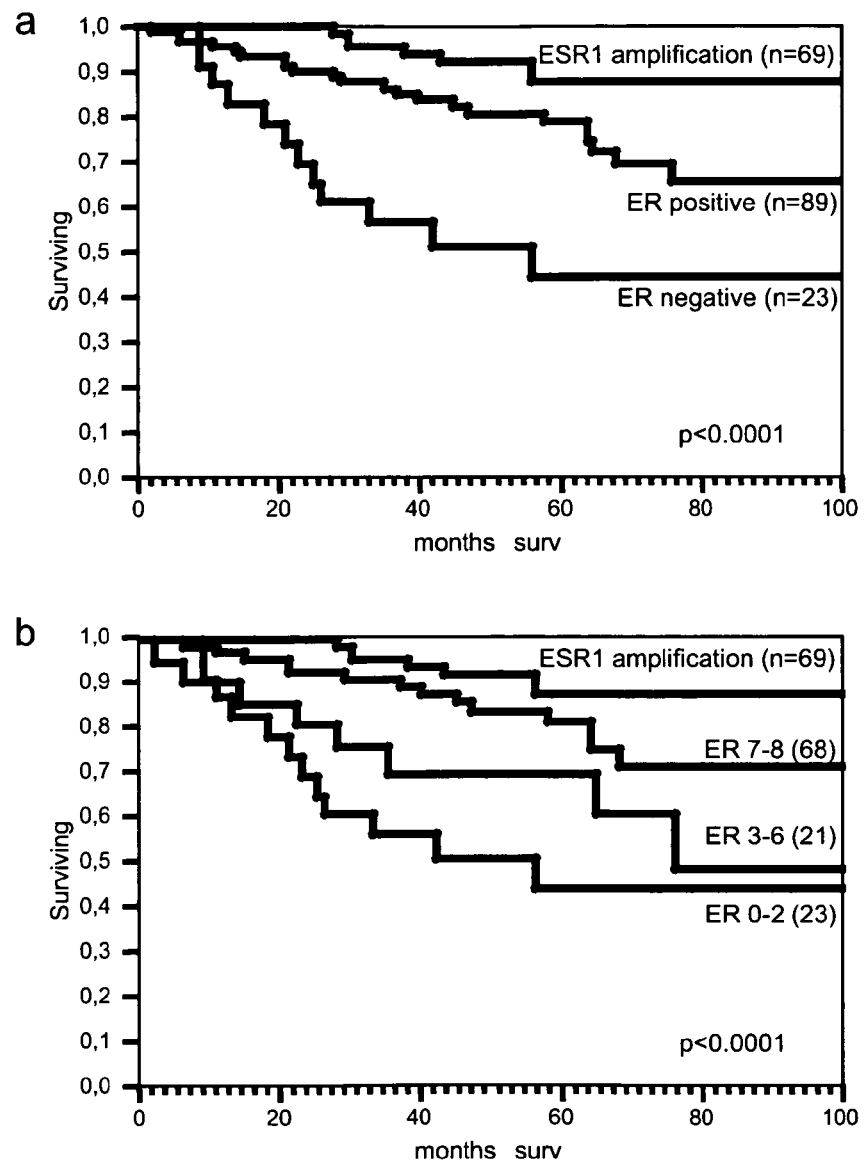
FIG. 4 illustrates the impact of ESR1 amplification and expression on prognosis in patients that received Tamoxifen monotherapy; a) Immunohistochemistry results grouped into negative (scores 0-2) and positive (scores 3-8) according to Allred; b) Immunohistochemistry results by scores.

Surprisingly, the prognosis of Tamoxifen treated patients with ESR1 amplification was significantly better than prognosis of patients that were ER positive by IHC but had no ESR1 gene amplification (FIG. 4, ESR1 amplification versus ER positive: p<0.0001). This difference was also seen between tumor with strong (score 7-8) ER positively and tumors with amplification (p<0.0001). A multivariate analysis including classical predictors of outcome in breast cancer (tumor stage, grade, nodal stage, ER IHC) in the subset of patients that had received Tamoxifen as monotherapy revealed that ESR1 amplification, but not ER expression, was an independent prognosticator of patient prognosis (see table in FIG. 2B). These data strongly suggest that ESR1 amplification may identify a subgroup of ER positive breast cancers with maximal likelihood of a good clinical response to anti-estrogen therapy.

5. Example 5

Association Between ESR1 Amplification and Other Molecular Markers 5.1 For co-amplification/co-expression analysis, data on gene amplification of HER2, EGFR, CMYC, MDM2, and CCND1 (Al-Kuraya, K., et al. (2004); Cancer Res, 64: 8534-8540), as well as p53 expression as detected by immunohistochemistry (Torhorst, J., et al. (2001); Am J Pathol, 159: 2249-2256), were compared to the ESR1 amplification status.

5.2 Results

ESR1 amplification was inversely related to p53 positivity (p=0.0003), and HER2 amplification (p=0.0099). In contrast, there was a positive correlation between amplifications of CCND1 and ESR1 (p=0.05). The amplification status of EGFR, CMCY, and MDM2 was unrelated to ESR1. The significant association with CCND1 amplifications is in concordance with previous studies reporting a strong link between immunohistochemical ER positivity and CCND1 amplification (Naidu, R., et al. (2002); Oncol Rep, 9: 409-416; Seshadri, R., et al. (1996); Clin Cancer Res, 2: 1177-1184). The high frequency of ESR1 amplification in low grade and early stage breast cancer together with the critical role of ER for proliferation control in breast epithelium would be well consistent with a very early—if not initializing—role of ER amplification in a subset of breast cancers.

In summary, these data suggest that ESR1 amplification is a frequent initial event enabling breast epithelial cells to escape growth control. ESR1 amplification defines a significant subtype of untreated primary breast cancers that maximally benefits from anti ER treatment.

6. Example 6

Mapping of the ESR1 Amplicon

In order to estimate the size of the ESR1 amplicon, a small tissue microarray containing 32 samples of breast cancer samples that showed ESR1 amplification using probe RP11-450E24 (which hybridizes within the ESR1 coding sequence; for sequence information, see above) was constructed. The TMA was analyzed in a FISH assay using additional probes which hybridize to sequences in the flanking region of the ESR1 gene. Specifically, the samples were analyzed with FISH probes that either map approximately 1 Mb upstream or 1.2 Mb downstream of the ESR1 gene. Labeling of the probes and evaluation of probe binding were performed as described in example 2 above. The upstream probe (RP1-44A20) corresponds to a sequence starting at base position 1 and ending at base position 165.000 of SEQ ID NO:1. The downstream probe (RP11_306013) corresponds to a sequence starting at base position 2.581.065 and ending at base position 2.725.892 of SEQ ID NO:1.

As a result, amplification of the upstream probe (RP1-44A20) was found in 4 ESR1 amplified tumors. Amplification of the downstream probe (RP11_306013) was confirmed in 1 ESR1 amplified tumor. This results clearly indicated that amplification of the ESR1 gene can be assayed by assessing the amplification status of a nucleotide sequence contained in the SEQ ID NO:1 but not forming part of the ESR1 coding sequence.

SEQUENCE LISTING (3 sequences)

SEQ ID NO: 1 - DNA, 2725892 bp, Homo sapiens (residues 1-1,362,946 of 2,725,892)
caaaattaatcatcagcaaacccctcctcctgtttaaatatactgtgttaaggtataaaacctttgaagtgaccctgtagggtttcagtgcccaggctattgtcagcagatcctggtttgagcatggcttgaggcatttactctctgtgtgacctcaggggagtgatggagcctttctcagcttccgggaaaatgggatgagtgggacccgtctcctagggttgcggtgaagatgaaatgagagaatgcatataaagcagacagctcagtgcttagcaataaactttaaaataacaacaatgatgattgccgggtgtggtagcttatgcctataagcccagcactttgggaggctgaggtgggaggatcacttgaggtcaggagtctcctgggcaacatagtgagaccctatctttacaaaaaaatagaaaagttagcccagtgtggtggtgtgagcctataaccccagctactgggaaggctgaggcgggagattgcttaaggcaggatttccaggttgcagtgagctgtgatcaagccactgcattctcacctggatgacagagccagtctctaaacaaaaataaagaaaaaagagaaaccaataatgatgataaatagcagtgaggagttaaaattcagattatgtaataatgtacatttattttactgatttttttccccatattaaaaaccctttgggctttacttaattttccttaatcaccatgtttcaaattacaccagtagtcctctgattataatgaagatgaatcagtttcttattttcagatgcgtcaagtgttgccaagacattgcattcctccaccacctcaccagccattcccattttccactttaaggattatagccacatttaattgtgtctgtctgcttccttacctggcctgggacctggagagtaaaaaggtagtttaaaaaagaaataaaaagcgtgtaaagttaacctgatgacaaggaagacaaagttgtaggaaaggaagtcaactggagggatcattctcaaaggagtggttaataaacttgcttcaaatttctatctagtgaatgcccacagcagcctcatactgagctttactccaggggattctggtaaacacggtggtggcccgttttgaagactttaaaatacatagtcttcgaagactttgtatttacatgcattcaacagcacatagattatttcagaaatgctttgcttttttttttttttttttggtagctagaaataatgataggatttacactatagaaaaaacagtaatgggaggttgcaaataggtctggaaagatatttcagtatgcaacaggacttcatcatggccaactgtctacctctgtcagttttagaagcactttggcatatgagaacgttgtcaatgtaatttggaaactgcaatttcgaaaataaatatttaacaaggcaacaaaattaagtttttctgctacgttattattgtaaaaaggcctcttataaggacttttctaattgttataccgaaaggtaatataaggaactgattttagtgttatgtttataccaaactgcttttccattattataacttttttaggtttcagtacatttatacacatccacatgaagtcaataaatgacatcactgtgaagtaaatgaaaacaattgatttctttctttttttcttttttttttttttttttttttttgagacaaagtctcactctattgcccaggctggagtgcagtggcacaatcatggctcactgcaacctccacctcctgggttcaagcgattctcctgcctcggcctcccaagtagctgggactacagggatgcgccaccatgcccagcaaatttttgtatgtttagtagagacgaggtttcaccgtgtcagccaggatggtctcgattacttgaccttgtgatccacccaggctggagtgcagtggtgcgatctcggctcactacaacctccacctcccaggttcaagcgattgtcctgcctcagcctctcgagtagctgatattacaggcctgtgccaccacacccagctaatttttgtatttttgtagagacggggtttcaggctggtctcgaactcctgacctcaggtgatccacctgtctcggcctcccaaagtgctgggatgcaggggtgagccaccacacctggcctaagacaattgatttcggtaatgattgtcagaagtgtaggaaaagatgggcgtcctgttgctttaagaactttaacatattaatactaattctatttcttaatttcttgttcatagatgtgtttttgcttaaagtctttaagggaaaaccaaacaaatattcctaattgtcttcaagcaaagatgtatttctctttctactcatcatttctatttttaacagaattcctgttccaagtttctttttctgggaagagctgccacctcctgccccttcctaggcccagctggcccatctcctcactatgagaaagctcacagctctccccctttcaggaggaggtagcaaaacaatagaggggactgaacaggcgcatgtatcatctgtcacagcttaacaagaaggccattcctgacattttttaccaatggtttatgtactgcaagtattatagttggtaaatgaggctgaaaccacccgatattttattcttttactcaggcatctcagagccgttaacagagttccacacatcacattaccagtaagatcagcctctgtcatatctttcttccccctttgtcttcccctttctttctctctttttcttttttttttttgagtctcactctgttgcccaggctggagtgcagtggcgcaatctcagctcacttcaacctctgcctcccgggttcaagcgattctcctgcctcagcttcccaagtagctgggattacaggtgcccgccaccaagcccggctaattttttttttttttgtatttttagtagagacggggtttcgccatgttggccaggctggtttcgagctgctgacctctgataacctgcctgcctcggcctcagaaagtactgggattacaggcatgagccactgtgcccggcccaaccctctctttttctttcttccctttcttctccttccttccccctgcccaaagctattgccagaaagattgtgtcccattccttctacattggattttcagtacatttctctgtggtgtggggtctagactgtatggacccagggaaaactctatctccatagtaagagcttttgtatccagcctaatgcagtggccggagaccaccattccccagatcctgtttctttggctgtaacttcctcctccctaggtgttcacagagaaagaagagaaaagagattcacttaagattggacttctgatacttttatctataggctacagcaggacattttattataccctgttcagtggcttatttggaagaaagataaagggcttctttcatttgcagtgtgttcttctgtactctcacagtactttgtaaataattcttgtagcacttaaatggtcaaactctgaacttcttttacatgttctccctcattctcctttgagcaccaacaggagggataaagcttcttttttttttttttttttttgagacggagttttgttcttgttgcccaggctggagtgcaatggcacaatctcaactcactgcaacctccgcatcccaggttcaagcaattcccctgcctcagcctcccaagtagctgggattacagctgcccaccaccacacttggctaatatttttgtatttttagtagagatggagtttcaccatgctgggccaggctgttctggaactcctgacttcaggtgatccacctgcctcagcctcccaaagtgtggggattacaggtgtgagccaccgtgcccgggccttaaccaatatcttatcagtcacaatgttctgtaagggcactctttgtgcaaaggacaatggctggaaaatcaaacccatgttttttcttagagcttgggccctagcaagaacaaaatgagccagcctgagcacatggaaatctacgatctggattaactaggccaaaagtaggcctgtctcctgtcaccacaaacccccagagatgcctttcaacctttcatcttggcttgaagaagtccagtccagggggtaccaaacctcagaacagccctgcccaggcctctgcagatggggcctgctagagctggccctggcttggttttacctcaccagccacctaggaaggaaaatcagaggagagaagccaatgggtccttctctgcagagggagcagcccagctgtctccatgctacagccaaaaggaagaggagacagatgggtccccatgtactcattgactttaactcactcatgccacagtggatgagaaagcatccttcctgggagctggtgaaacagcagcttcctccttaaggtgggaagtgacgaagagagaggagccccagacttccttccactgaaagcccacatggctgatcagtcacttcaaccatgctgtcaccctggactccatgctttctattattctccacatcccattaaatacctctcctctccacctgactcagggttaggagttggtctgcacatacctgtctgctgcatgcatcacctaaccagcctccccagcagctttatagcttctctcctattttctttttctttttctttttttttttaagacagagtttagctcttgttgcccaggctggagtgcagtggtgcaatctcagctcattgcaacctttgcctcccgggttcaagcgattctcctgcctcagcctcccgagtagctgagattaacaggtgcctgccaccatgccccgctaaattttgtatttttagtagagatggggtttcaccacgttgcccaggctggtcttgaactcctgaccctagatgatccacctgtgtttgcctcccaaagtattgggattacaggcatgagccactgcacccggccctgttttctttattgatgatggaaccatctttaatctcaccacacgcttcagtggttaccaccagctatgtagcgtggaagattctgcatgacctgtcccggcccccatttagcctcatctagcagtgcagccccaccctcaagggtctgtgtgtttaggcgcacgccctgctctgtccagctggtctcaaccctgacatctggctggcctgaaatctagcccttttcaactccttttagtgtcctttttgttaccctgtgcctttgtttacccatttctggcctcctagatgttgtcttcttcctcctttcgctgtgttgaaactccatccttcaagattcagctccaccctcaccttccctgtgaagcctctcccctccctggaacggaccacttccgcctttcctgccctctcttgtgaactgaatctctatcagtcttgctgccaaaacactattctatttatttgtttacacttggctcttcaactataccgggagcttgctgggggaagggatcatgttttatgcatttttttttaattcttatcctgtaaaacagcacttggcacacattattacatcctcaaaataaaaagatgggaggaaggcttgtataaatgaatgttaatgtgcttttaaactgtaaattactatacacatgtaagttattctagtttcagaggcatcccaacgtaatacatgaaatttgaaaggcaaatttttgggtaaacagactactttctagaaagggtagagggattggagaaatgaaaaaagattatttctcagggccaggtgcagtggcttacatctgtaatcccagcattttgggaggccaaggcaagtggatcacctgaggtcaggagtttgagaccagcctagccaacatggtgaaaccccgtctctgctaaaaatacaaaaattacccaggcatgatggcacgtgcctgcaatctcagctactcgagggggctgagtcaggagaatcgcttgaacttgggaggtggaggtcgtagtgagccgagattgtgccactgcactccagcttgggtgacagagtgagactctgtctcaaagaaaaaaaaaaatttaatgtgatatcagaagaagaagggaagtgcaggagctattaactaacctatttccgggcatctcatagaaataaggtaagctctgaagggcgctgaatttgccttcagtctcagttcttctttctatagcatgtccctgctggatggttatgtagatcagagcttctcaaactatccatggtgaggggcaagtgtgtgtgttttctttccatctatcacacaccgattcttttgtaaaatacaatttaaaaaagaatactagaaaagttagaagaagaataagatgtacaaagtacaagcacaaatttattattagattgatattaaatcattctgtaaactagtttctgcatgcttacttgatgtctgtacttatctccttgtagatcagcagcaaacagtttgcaaattggctcctgcccacttcccatactttgaataggaccaagtcagatctacttggatatctacttggatattttcaataacacatattacaaggaatgaaaaagttaattagaggaggctgctcgtgtgcaaatcttataatggtagagatcttaaggacataaactgattagaaagtaaataggagaaattttaaatcacagaacatcattcaaatggtgaaaagcccttttttgtgtgtactctctgctccttccctcaccaaactagggtaaattctttgatcctcttggagaataattgttttcagtgcaaaagttttaaattgatccttcatagttgttaacagcagggtaaccataggtgctgacatcaagccaataaaattaataagcagcatgacaggctctaataaatttcgttggtgtccttacactgtcatttcgggcgcagaatgaactgttattatcactgagcttcaaaccactcatttggctacagatgattacagctgtgaatgcagggcatgctgccttagttttcaggagctagtctagggttaaagtattagatttaaaagatgtacttatgatcagtgggggggaacaagttatgaccatacaactttgatctgttttctagagtggtctacaaaaatgtggactcctcacgatctgttttctcaataatttctgaaaacaagcaacttttaaaatttagtttctctgccatggactctgaggtttttgaaactctttgagctggcgatgggccatcagttgttggatgctggccatggttctttgtctgtaaccccagatgaaattctttaagccccttaactcaacctttctctcacatgaagaatttagtatcaggtttctgcaaatgagcaagcttcgctcttgaagtgagagaaaggattgttcattctctctttaagccccactgcagagcctctgaattcagccaggtgaatgtggcttgcaccctccacccctgccccgcccctcatcctgccatgctgtgtgtggctcatgcccatccacatccttctgttttaccttcttaattttgtgtacaatatgccctccaaaatgtccagcaaagtcttaagctgctattaaatacagacattcactgcacattgagtattagtccatccttttggaccatgtgtaatttaacagaaatatcaatgaatatatttctttattttgagggagtgtaggttttatgtgttgttcaaaatgtaccattctttcaattctggcctccatttgtttttcttttttgggccttttttgggcctgtctgtcctatgcaggtactcaagctcttatgattgttccatttataacagtaaggagaataggccaagctatttggggattttaatgccaactacttttaaatcttttgaatctagtttcttaccgaggtgactactttcttaagaagaaaagttgttaccacaaagcttgttttgaaaaaaggtttatgtacattggtttatgcatgacaatgattttagtatgaaagcactagaacgaaacctaatttgatgcaaactgtgaaatgtgccacttgagaaagttaatgatgaaagccttgcctattttgcattggaggaacctaaagaacatgagagaatgaaggtggattaataaaaggcgtaagaaacaattatctaatggatcttacatttcagcttctcctttctctagctgcatctaaacacgacagtgtttgctgttggacattggaatgcggctgcggtgctgggattttcatggtctgcttggcttttcacagggttacttcctctaaatgctgcagatcgccatgttacgtttgggagggagccacacttcattgttcagcctagggcaaggactgtatttactttttattttacgttatttcagctgttttcacttttttctgtattgttttcctgcctcctacagaatcctttttcaagtcttgctagggaaaggggaacactcagttatgaactctttagcacacaaggggcagaaagcagctttcctctttctcaacagttcaaataacttctaagctatgtcagtttaacccactatgggtctcaatccacagcagatctgtttgggagctgtttctatgttaaaacatacaaaatcaattgagagttttctgtggctaattaacacagcatagtaagttatatgcttatttttttcacttaaaaaaataagttggtatttgaaaaagaatttggttctatagttttaacaacagatagttttgtgacttaaggttatgtttaaaacaaattctgtcagttcagaatttttatttctggtttttcactatatgaattttagagtatgttttaatcatacaaatcagtcaaagaaaaagcagacgatgtggttataccaaaactgacgttattggcactatggtcattgtagccccatctggggaagctctaatatatttagggagtagacagaatgtataccacactctttctctttcctaaaactcttcgttctataaataggtgagtattagggccagtaataagagagcaactgtgtactctcagagttaatgagcacactagtaaaataattacttgaaacagatatgaaagatgcactgggcataattaaagatgacttggaaaggacaggagtgtttaaggcatccttctcattgatctcacaggattaccttgactgcatcagggaccaaacaaaacttcccctggggaccgaagaaagatcagccctttttggaaacatacaggatatctaccacttcaataggtaagttaatattcaaaagattgttctcacatacgagcattatgaaaatttctcaaatgaatgcagcctaagaaactttacctgtaacccctgactcagcttcatatatttttgtgggctgttgtgccaagaagctttctgcttggaagtatccttatttccttatgagtctcacatgtattccatattctctctctctccatcctcctggctcagagaagaaacctatttgccctggtggggcaatgacatcttttcttccacaatatgacatgaacatgacatccaagaatatgtacttgcttagtctccaggatccccagctacactgaattttctataacttttcttctacctggggagtgggctggacacagtaaacacacaatacatacttcaagtcataacatattaattcaattgaattgataattttaaataatcagtttaattaaaaatgtaagtatgtagcagacactgggctagaaaattaaaatagtaaacaagacagagagtgaatgaataagttattatattaatacttcttgaaagtaaagttagggccagacatggtggctcacacctgtaatcccagcactttggtaggccgaggtggacagatcacttgaggttaggagttcgagaccagcctggccaatatggtgaaaccccatctctactaaaaatacaaaaattagccaggtatggtggtgcacacctgtaaccccagctacccaggaggctgagacaggagaattgctcgaacccaggaggtggaagttgagtgagccaagactgcaccactgcaatctgtccagccagggtgacagagcaagactccatctcaaaaaaaaaaaaaaaaaaagaaagaaaaaagaaaaagaaaaacataagttcgtagactggttaacagcacagaagctgctgttcaacatacatgagtttgcatcccagcaaagccccctgtatgtgttgagtgaatctttaaatggaatgaaactaactaacccctgtatgtcaagtctttactcaaatccttcttctcgctgaggctccctgagtatccacacataccttacctcctccacttttcctttttctcatggcactcgtcaatttttaacatactatatgatcgacttttatattatgcctgttgttcctttcctctccaccctgactcacaaaacatttgctccacaaggacaggagtctgttttgttattgtctatatgtctaaaatggtgtcaggcccataggaggcatccaaacttgtattgaaggaaagaatggaaataataggaaaatctccctcatatggttacagtgaagctcccgtgaactgataaacctaaagtgccggcacagaggaagtaccaaaatataagcctacgatgctcttgattttgcgatagtgaaatcccattataaaattctgcaatgccctgtcattttgtgactcagctataaatgcaaactcagtcctacccatcttggcttactaaaattggtaaatgtgagctccttgagggcaggattcacatatcctttgccatccttgaatcccaacacctagcacaagcctgacctctgggagaaatgttccttgacttgaaatagcttatcctttaattctgaaagcctaggatgtaggaagtgtcagtgttacaacagaacttttttcatttgactcagactttgaaaaacagtttgtgtattttgcatcagtatttctcaacctgggctacccactggaatcacctgggaagctggatcctaccttcagaaattctgactcgttggtcgaggtggggccagaacatcagaatttttcaaaggtcttcaggtgtttggaatgtgcagccatggttgagatacacagtctagataaaatgaaagaaaaagaaaatagagaaagggcatagaaactgaattagagaatccagagtctacatgttcattagtaatgtgctggtgtgaaagccagccctcattgtgcaatcgctgatgataaaatcctgtgagcccctgcacagtttctccttccagagtccactaatggtcctgtaacccagaaagaggcaagagggctagatcctgggaggcccctggcctaggtcttctgtggtttggctgtgagttgatggtagggcatatttatagagtgcttgctccatgccagaggccgtagagctttagatacattttcatttcatatgcattatctcagcctctctgactccaaaccccaggcattcagccacgtgccctcctgccagagtggagccctgcttctctggttcatgaagttgtggcttactccaggaggggctcttaatcgctagagtttaaatctttacgtgtctcctaatttaaagaaaaataagaatgagggtgggcatggtagcttacacctgtaatcccagcactttgggaggccgaagtgggtggatcacttgaggtcaggagttcaagaccagcctggccagcatggcaagaccctatctctactaaaaaatacaaataaaattagctgggtgttgtggcacatgcctgtaatcccagctacttgggaggctgaggcaggagaatcacttgaacccgggaggtggaggttgcagtgagccgagatcgcgccactgcactccagcctgggcaacagagtgagactccatcttgaatgaatgaatgaatgaatgaatgaacgaacgaacgagttggcaagaagagatctttgcagtggacccccgtctgcagaagttagatgactgagatttacattcctgaatcacatctctgttcttttcttttttcttttttcttttgaggcagagtttcactgtgtcgcccaggctggagtgcagtggcgcagtctcggctcattgcaacctccgcctcccgggttcaacaaatcaataggtgtatcgatttcaaagatacacctatctggcaaatctgtggttggggcttgaaataataactttcagctcctattagttcaggtccaagtttttcaaaataatgtattgtggccaactaggcaagacttaaatctaaaattaaagagggcataaagaaatggtattatgctggcctgaaaaattcaactgactaggtttcttttttcagtaaagatttccaaaatacagaaaaccacagaaagacattctgtcaaagagtcaggcgtggctcatgggagtttgtcatattactcctttctttgtgtcttatttgctttaacatttgtttgaagcataaagatattataaacaatattgaatccagttatatacccttccccagtcacattctgctctgtggagaatggcaccctgatgtgttggtaaaccagttctccagcatggggaaaggggagggaggatctggaatttataatgttttttgatttctgtggtataaacactcccatcacagcagatttcaagttactaacacaacatcactgaacatggaattaagaagagatgtgcagaattggctcagggaagccagtgtaacctggcttagtacacaactgtgctggaactgccatccaaaacttgttgtttctttcccaagcatggttttgttgccattactatatatacaagtatttatttaaaatgtgtaacatgctgtgggaggcccaggtgggaggactgcttgagccaaggagtttgagaccagcctgggcaacgtggcgaaatcccatctctacaaaaaatcaaaaaattagcaggacatgatggcacatgcctgtggtcctactgcacaagagactgagacaggaggatcgcttgagcccaggagtttgagactgcagtgagctatgatggcaccactgctctccagcctgggcaacagagtgagaccctgtctcaaaaaataagtcatatgctttcacctatttcaaacatggcatacatggtgtcagcttacaggttattttcactcaacattgtttttgggatttatagctctagttcatttaactgctgtgtatattatccattggtgatgatctatctctgtattttgccaattgcgttaagattgagcatcttttcttattggccattttgatttcctctgcagttttctggctcatatccattgcccattctattaggatatttctttttcttattgttgtataggagttcttgatgaattctggccagtgatctttgcagattatgtgagatgtaaatatctcctaccgtgagacatgccttttaactttaattatggtttatttgaaaataaattgtataacgtgtaagtttgactaagtatactttttatagtgcgtaggttttgtgttgtgtttttttaaaaagtcctttcaatctcaggtcataaatatactctatttttttctaaaagtcttaaaattttgtctttcacatttgtccttaatgtgcctaacattgatggaggcatggtgtatagtaaggagatctaaactcttattttcatatggctagccactgatttgaaaagtacttctctcggctgggtgcagtggctcacgtctgtaatccccgcacattgggaggccaaggcaggtggatcacctgaggttaggagcttgagacccgcctggctaatacagtgaaaccctgtctctatcaaaagtacaaaaattagccaggcgtggtggcgagtgcctgtaatcccagctactcaggaggctgaggcaggagaattgcttgagcccgggaggcagaggctgcagtgagccaaaatgttgccactgcacttcagcctcggcgacaaagcgagactccgtctcaaaaaataaaaataaaaataacaagacttacacggatgtgtgggtctgtgttctctttcactggcccacccattcttgtcccataccacactcctctgatgatcaagcccacatacattgctcttcttcaacactggcttagattttcttgactctgccctgtcaaggaattttttttttaatttgtcatttctttgaactactctattgggatttttattgaaattgcattaaattttatagattaatttcaacagaattgacatctttacattactgtcatcccatccataaacatgtcttcaagcaagcttttaaaatttcctttaatattttctaatttctccatcagattcatacatgtaacttttatgtttttttaaatacatgtaacttttaaaactttattcctagatacttacagcttttgatgttatttggactagaacattttctctattgtttaaattggatattatcctcatctagcaatgcttttgatttttatatgtcaatactgtaacaaactttctcaactttcctgttctaagagtggttcatagatctcttggatttctgtgtagacaatgatgtctgaaaatgaggaagcttttttgtcatcttttacagttcttctaccctttattatctttttcatgtcttattgctttgggtaagtcttcctatacaatattgtttagacattggcgtccttatcttctttttggcattagcaggaatgttttacccttaagtgtgatgtttgctatggatttagacaaacacttttttcctcttttgctaaaattttattgtgaatattgagttttattcattgcttagtatgcctttaataaagttagcatatgattttactctttctattcataatgtggtaaatattaataggggacctgatttgaatcatatgtaacattactagaataaaccctacccagtcacaatgttttgtctatttaggcactgattagtttgaattttttttttttttttttttttttttttgagacacagtctcactctgtcattcaggctggagggcaatggcacgatcttgggtcactgcagcctccatctcccgggttaagcgattctcctgcctcagcctcccaagtagctgggactacaggcacaggccaccacgcccagctgatttttgtgtttttgtagagacggggtttcactgtgttggccaggctggtcacgaactccttaatccacccacctcagcctcccaaagtgctgggattacaggggggagccactgtgccatcccaatttatttatatttttaaaagaatttttaaaaattcttttttaaaattaaaaaaaattttttttcagacatgttcataaatgacaatagtatataatttctttccttgtcctgtctttgttcagtattggtatatgactagatttaaattgctgtttcacaaaatcttccatcatgaaatgttttggaatacaattgaaattttatttttgtgttctttttgatacccaaatatctctttctcttacaatccctatgataacctagaaatttaagtctctgatttggtgtctggaataaacaaccacaaggtcaggaaactgggttagtcaaaagaaaccactttcctcatttgaaccagccccctaaaatccaacagcgtgttttactgcaaaccaaaaaagaaatgccaagttttaaaaagaaagtacccctctcttggaatacagaaacgttacctaaacagtaatttgagcctttctttaagaatgaagagtgaggaaataaagatcattcctccatattgaatgtctgattttagacattcaattgtttcttaggagattaaaatcatctaagctctctccttccctcagaagatcagagtaaaactttcctttttccttcaactcttttctttattcagtatacctatgttgagtcattactctgtatgaaaccctggactagtctaatagtgtaaggatgaatgacaccattgtacaacagaggcaataagccacataatcaaggaaggaacagaatgctttgtgaatgctgaggaatgtgcaattaattttgtctgagggggactttacagagcaactaacacatgtctgaagacaaaagaaattctttgggccacgctttttcttctccttgcaatgtaatttaagtagtgaaatcatgggattcgtacaacagcaaggcaaaggaaggtggaatcgttttcttttttagtgcattttcataccaccaaaatgtctgacttctgcacaatggtagagatatttttacccacgcttttttcaactggacttttccaggccagtgcctggaaagtatgagtgaaattattggagtaatttctcttccatgcatatgtgtctctgtggatgcagtgggttaaaatgccagctgattaggcaacgggaaagggaagtgctgctcagaccggaaggggaggggccgcatcctcgaatctctctcagtgtaaagcaatagaaggttcaaggtcataatacaattcctgcctcaaagttcgcatcaggggtcagaaaagcttcacatgggatatgttctgtaaaagagaacagtgtttcctctcatttcccacccaactaagggacctgagctcaagtaggaaattttataattgttttaaccgtcctactcaaaaagaagaaaatatttaaaatactcaaggaaacgagaaaagatccaaatcctgaaggcaagatgactctaatttagcttagaatacaaaacacaatctgtgagttatttcttactcctagtgtacatgtgcggttgcacatcagccacactgatgcaatcctggtgcacatgtgcagttgcacattactcacactgatgcaatcctggtgcacatgtgcagttgcacattactcacactgatgcaatcctggcgtacatgtgcagttgcacatcagccacactgatgcaatcctggtgcacatgtgtggttgcacattactcacactgatgcaatcctggtgcacatgtgcagttgcacattactcacactgatgcagtcctggtgcacatgtgcggttgcacattacactgatgcaatcctggtgcacgtgtggttgcacattactcacactgatgcaatcctggcgtacatgtgcggttgcacatcagccacactgatgcaatcctggtgcacatgtgcagttgcacattactcacactgatgcaatcctggtgcacatgtgcggttgcacattactcacactgttgcaatcctggcgtacatgtgcggttgcacatcagccacactgatgcaatcctggtgcacatgtgtggttgcacattactcacactgatgcaatcctggtgcacatgtgcggtttcacatcagccacactgatgcaatcctggtgcacatgtgcggctgcacatcagccacactgaggcaatcctggtgcacatgtgcagttgcacattactcacactgatgcagtcctggtgcacatgtgcagttgcacattacactgatgcaatcctggtgcacatgtgcggttgcacatcagtcacactgatgcaatcctggtgcacatgtgcagttgcacattactcacactgatgcaatcctggcgtacatgtgcggttgcacatcagccacactgatgcaatcctggtgcacatgtgtggttgcacattactcaacactaatgcaatcctggtgcacatgtgcggttgcacatcagccacactgatgcaatcctggtgcacatgtgcagttgcacattactcacactgatgcagtcctggtgcacatgtgcggttgcacattacactgatgcaatcctggtgcacatgtgtggttgcacattactcacactgatgcaatcctggtgcacatgtgcggttgcacatcagccacactgatgcaatcctggtgcacatgtgcagttgcacattactcacactgatgcaatcctggtgcacatgtgcggttgcacattactcacactgatgcaatcctggtgtacatgtgcggttgcacatcagccacactgatgcaatcctggtgcacatgtgtggttgcacattactcacactgatgcaatcctggtgcacatgtgcagttgcacattactcacactgatgcagtcctggtgcacatgtgcggttgcacattacactgatgcaatcctggtgcacgtgtggttgcacactactcacactgatgcaatcctggtgcacatgtgcggttgcacatcagccacactgatgcaatcctggtgcacatgtgctgttgcacgttagttacactgattcaatgagaaatccgtagtctccacccccgaggctgtaactgtagaatcatcccgtgtctggtatttaggagtgtcttcagtggctgatgcactgcattccaggccccgactgtgctcccattgtactttgcgtgtttgcatatcttttatagcgagatgtcttcctctatcccaccacactctctgttgcccaccaaattccagccactgtggcttcctttgtatacctcacaggagaacccaccaagctcattctatcctggtttgcaattccattcttttttttgagacggagtctcactctgttgtccaggctggagtacagtaatgcaatctaggctcagtgtatcctccgcctcccaggtttaagcaatcctccctcctcaacctcccaagtagctggaattacaggcgctcaccatcacgcctggctaatttttgtatttttagtagagagggggcttcaccatgttggccaggttggtctcaaactcctggcctcaggtgatccgcccgcctcagcctcccaaagtgttggtattataggcatgagccactgtacccagcctgcaatcacattcttaaatgactttctcttccaagacttcctgcactcaaatatcacctcctcagagaaccttccctgactgtcccaaccttctttcaccctcgcccagcctcagttgctctctatcgtactaccctctatttccttcatatcacataatacaatgtgatattatgttgtttattcacacttattagtacttttcacccctggtcagatcataaacacatgggacagggcctttgtccaccttctttacccctgtaaccttcttgcctgacatccagtcttttagcaattgcttattgaatagcaagcagacaaagtggataggaacagcttcatggggatgatagccccagtgacaagaggatgagagaaatgccattactttctctttactagtaccatttttattgtgtttatcctgttctagaaaaaggttgtaaaggaaagctgaccaggtaactcaaacaagacttgtctagtaggcagtaccatgttgaagatatgacagtgtggagtctggccctcagctttgagtggaacagcaaacaaatctttcaatagatgtgtttctaagagagtgcaggactgggattcagaaggcctgaatctaaccatgactgtggccatgcattattggcagtgtgacctaaggtaagctacatcctttaataagccatggtttcctcaccttaaaattagggatcggaactgaaggtatctgagtgccctcccagctctgtggttcttgagtgccaggcattcattcacagatgaggtacacctggagcctggctgggtccccgagacacttcctcctaccaggaagtccactcgtgagatgaaactaaagcttggaggcaatccgaacatacaatttaaaacacagggggttaaatattgtcaagaagtttttttttttttttttttgagacagagtctcgttctgtcgcctaggctggagtgcaatggcgcgatctcagctctctgcaacttctgcctcttgggttcacgtgattctcctgcctcagtctcccgagtagctgggcttacaggcacctgccaccacactcagctaatttatgtatttttagtggagacagggtttcaccatgttagtcaggttggtctcaaactcctgacctcaggtgatccgcccgcctcggcctcctaaagtgctaagattacaggcatgagccaccatgcctggcctgccaagaagtgtttctgttgtgctatgagaaataacaaggccgggcgtggtggctcacgcccgtattcccagcactttgggaggccgaggctggcagatcatgagatcaggagatcaagaccatcctggctaacacagtgaaaccctgtctctactaaaaatacaaaaaattagtcaggcatggtgacacgtgcctgtagtcccagctactcaggaggctgagggagaattgcttgaacccagaaggtggaggttgcagtgagccgagatcacactactgcacaccagcctgggtgacagagcgagactccgtctcaaaaaaaaaagaaagaaataacatgatggagtccgctcacagttcttctctgctcagagagagggcctatactgaaagaccaggacacaatacatccagagcaccccatcctctactaatggaaaacactggcccagaaatgtttctctctggctattattttccttttctttaattttttttttttttttgagacagagtcttgctctgttgcccaggctggagtgcagtggcatgatctcagctcactgcaacctccacctcatgggttcaagtgattcttccgcctcgacctcccgagtagcaccacacctggctaatttttgtatttttagtagagacagggtttcaccatattggccaggctggtcttgaactcctgacctcatgatctgcccacgtcggcctcccaaagtgttgggattacaggcgtgagccactgcacctggccctctggctttcatttcctcagaccttttctcttacctcatctggtattcaggtcagaatgatgtgatttcgactctccttaaactcttccttttttccgtgagaatactggacagtggctctcacaggtgtagcatttaccccgagataactttaccatgacatatctcacttttattattattttcacatcactctagtatatcgactttaaaaacaaaagacatcattctctttatagcattctgtttttagtagtggtatttccatttacaaaatatagtaattctcaattgctgaaaatgtcaaatcttagaaaacatagcattcctacgcatgatgttaacgtcgttcttgaatgcttgttggccgaagattcatttgatgaatccaatttttctgaaatagatgattctgatgttctgtttagagattactccaaaagcagggggttttttgtttgtttgtttgttttttctgagacagagtctcactctgtcacccaggctggagtgcagtggcactatctcagctcactgcaacctcttcctcccgggttcaagcaattctcctgcctcagcctcctgagtagctaggattacaagcatgcgccaccacgcccagctaatttttgtattttttaatagagaaggggtgtcaccctgttggtcaggctggtctcgaactcctgacctcaggtgatccacctgcctcggcctcccaaagtgctgggattacaggtgtaagccaccgcgcccggccaagaacagtttttatattttattttcacattgaaaatcagtcagattaggctgggcacggtggctcacacctgtaatcccagcactttgggaggccaaggcaggtggatcacctgaggtcaagagttcaagaccagcctgaccaacagggtgaaaccccgtctctactaaaaatacaaaaattagccagacgtggtggcacatgcctgtaatcccagctactggggaggctgaggcaggagaattgcttgaacctaggaagcggaggttgcagtgagccgagatcatgccattgcactccagcctgggagaagatgcgagattccatctccaaaaaaaaaagaaaagaaaagaaaatcagtaagattagtttcagcctcaaagagcatgtttatgtaaaattaaaagagcgctggcagagagctgaactttttttttaaacgggaaaagagttaatttaatcactcccatctttctataaaagaaaatgatataaatatcagaactatattttctgatctttcaaagggagtcttttataggaatatggagaagaatgtttggaattgggactgttttaaaagatcctttctttttctttttcttttttttttttgagatggagtctcactgtgtcacccaggctggagtgcagtggcccgatctcggctcactgcaagctccacctcccgggttcacgccattctcctgcctcagcctcccaaatagctgggactacaggtgcctgccaccacgcccggctaatttttttttttttgtattttcagtagagacagggtttcgctgtgttagccaggatggtctcgatctcctgacctcgtgatccacccgccttggcctcccaaagtgctgggattacaggtgtgaaccaccatgcccggccttaaaagatcctttctaagtgcaagataggccagtggattttaaagtaatggtacagtagccaggcgtgggggctcacatctgtaatcccagcactttgggaggctgaggcaggcccatcacttgaggccaggagttcaagaccagcccagccaacatggtgaaaccctgtctctactaaaaatagaaaagttagctgggcatggtggtgggaggctgaggtaggagaatcgcttgaacccaggaggcagaggttacagtgagccgaaatcacgtcattgcactccagcttgggcagcagagcgagactctgtctcaaaaaaataataaaataaaataaagtaccagtatagtacattgatatggtttcagactcaaacaggccttcaacccattaccacttgctgagtttcagtgtaatatgaaggatgttagtgggctatgaaagatatccatacttattggaaatgccattaaaatactccctccttttccagtgacatatctgtgtgcgactggatttttttcctatatacttcaaccaaaacaacagattgcaacagatagaatgcagaagcagataggacaatccagctatgttctattaagttagagattacaaatttgcaaaaaggggaaataatgctactcttctcactaaattttttaagagtataaacaggtcctgatgccaaaagtttcagaaccactgccttggaatgaggaacaccacacaataaactccatccctgcgaagagttcatgattgacgttgtggctcattttcaaatatgaaaggacaaatgaagatactcagaatttgagaagagcatctaacatgaatgacagaagctaaaatcatcaaaaagggagctcagcagaaaacaaagaacaggaaagaaaagtacaaaatcattatgatcatcatcatggcgagtttggaaataagggaagattttgcacgcatgaaataagaacaaaagcataagcaagaaacatccaaaacacatgtttaaaaaaaaactttgaaattgaaaatctgatggttgaaacaaaacaaaaaaatcaataaaagaaatggggaaaaaaaactaaaaaaaaaaaaaaaaagggaaataaaggggaggtctccccccacaaaaaatggaggaatgaaaacaggaagatagagagtagaagaggaagagtaaggaaaattagcgtattagaccaggagatccaatatgtgagtaataggaactttaaaactgcaagggaggaaatatcaaagacataattcacgagcagagattcttcttttttttttttttttaacggagtctcacttttgtcacccaggctggagtgcaatggtgcaatctcggctcactgcaatctctgcctcccaggctcaagtgattctcctgcctcagcctcctgagtagctgggactgcaggtgtgtgccaccacacccagctaatttttgaatttttggtagagatggggtttcactgtgttggccgtgctggtcccgaactcctgacctcaggtcatctgcccaccttggcctcccagagtgctgggattataggcatgagccaccacatccagccaggagcagagattctcaagtgttttggtccaggatctcttacatgcttaaaaattactaaggactgaaaaagcttttttgtttatgttttattatgttttgtttgccacattagaaatgaaaaccgagaacctgttaagatgtctatttatttaatactaaaaaagaacaagcccacatatttctagaaaaataattttactactttttctactaaatttttttgtttgttttggagctgttttacatttttacagatcttgttactgcctgacttactagaagacagctgaattctcatatctgcttcaactttccatctgttgtgatatcacacgtcatgtagcctctggaaaagttcactgtactctcatgagagaatgaaagtttaagaatttcataatgtctcagtatttttatgaggtccaaccttgtggacctcctgaaggggtcttgtctcaggaaccccagaggtcgttagaccacacttggagaactgctatccagatcatttcccaaatttgtacatttgctcagtgcatgaaaaagacccacccaaagcctactatcacaaaattttgtaattatgtcaactaagagaaaactttaaaagctttcagaatgggctgggggtcatcagaatgatactggaatctcaatagcagcattggaatctataaatcacaggtagacaaatagctccctgagtactcagagaaaattacttccaaccaagacttttatatctactgacatcattagccaagtgcgaagggagaacatttttgaaacaggaagagtctcagaaagcataccttctgttactcttactcagaaactattgctcgattttgtaatctcccaaaggaaggaatacattggaaatagcaatacagaagaccagcaaaggctatcattaggatggtgttgaagaaacaaccagcaggcctggacagcagcctgtccaggttggagcagaggtcaccaagaaagaaatgcaaagcatagaatatctgatatttgaacacagtgagacaagattgatacttctggcatacaatttgctaataaattaatggtctttatcttgaaaaaagaaaaaaaaagagaaacaattttaactccagggaaaacatgattctctaagaaaggaaatgaaatcatagtatactctgaggctaacagggcataatacttacatagtcttaaagatgtaaattctgacatttaatcgaatcaaattacataacagaactagttaagaaggctggccacggttgctcacactacccagcgcttcagaaagatcacttgagcccaggaagacctgcctggttgacagagtgagaccctgtctctaaaattaaaaaaaaaaaaaagagagagagagacatcttagaactagttgagaagacagaagggtaagtttgaggaaactgagagtaaataatacctaaagttgaaaaataatgaaaacacattatcagcatggttagaagcatggaccttcttagagcagaaatagcctaaagaatcaaaaatgcttctgggcagtgcccatcgagaatgagaatctgaaaaccagaaactgcttgtttttatcataattcctgtagaactacttcactttttattaaatatatagcatatgactcattaaaataaatacttagcatagtaaggtgtatattagtataactcatgtggagtgcaatttagaaatgtgttaacatttacactgagaatgttctttgacccatcaattccatatgtagaattttatccaacagtgtgagattcattgaatcaattatggtacagtcacacaatgaagtattatgctgttacttaaaataatgatactcctagtaaaaaaataacatgaatttacatttgaggaaagatatttcccttcccagcatatctctcctttaaagcactatctctattataattttgtattcattagtgtgatttttcattgaatgcttgactcttccaatggattggaagctccataagaccagagccatggagtccccaacccccaggtcacagacaataccagtttgtgacctgttaggaactggtctgcagagcaggaggtgagagcaagtgaagctgagctccacctcctgtcagatcagtggcagcattagattctcataggagcacacaccctattgtgaactgtgcatgcgtgggatctaggttatgagaatctaatggtaagtgtaatgcacttgagtcatcccaaaaccatccccacaatccagtctgtggaaaagttgtcttccacgaaactgatccctggtgccaaaaaggttggggacctccgagagcccatgtcttactttgctcactgatgtgttcctagtacaggtacactgtacctggtacctaggcagctatttgatgtctgaatgagcatgggtgagcattcaagtagatgatgacaaacgtctgcaaaacttaaagataggcagggcttagctctggtgggagagttatgggttcaacctgggtttaatcccctgctccaccatgaccttgggcaagtcccttacctaagccttggatacaatgacagcagatcctcagttatccaattatatgattccttgtaaatgccatggaaatgtttaaacttttaaattatacaaaatgtactcacccagaagactacaatctaatacttcctggctgttatttttttattagtgaacttctgcaagatttggaaaactgtgaaaatgatcctgtggccatagcagagtgttttgtgtccaaggtaagcagggttcatccttctgggccaactgagacagatacagagtacagaatttttcattttaaagttaaaatgactggtttgtttcatatcagatagagttagccactaatctttctctggtttctttgtttgagtagcaaaaatgtattgttcctggagccagggagatgctaatctagtagttgttctagaacttgtacagtaactgaataatgttactctttgctgggaaaaacttaaagcttgggaggggagagtccggagtagaagaatgttagaaaaatgggccgggcatggtggctcacacctataatcccagcactttgggaagccgaggtgagtggatcatctgaggtcaggagtttgagaccagcctggccaacatggtgaaaccccgtctctactaaaaacacaaaaattagccaggcgtggtggtgtgcctgtaatcccagctactagggtggctgaggcaggagaatcacttgagcccaggaggcggaggttgcagtgggagccaagataacgccattgcactccagcctgggtgacaagagtgagactctgtctcaaaaaaaaaaaaaaaaaaaaagaagatgaatgttagaaaaatataaaataccactgaactggtttagtttagtgaaagtttagttttagtgaaagtccaagagaatctaaatattttacgtataatatatgtggcactagcctagtctctataattatctttcttttgagggatagagagaagcagaattaatctcctacattttaaaaatgtactcttccactgttttcttaagctgcatcagtggtttcgaaaaatacaaggaaaggatttgactttcaaagcttaaatgacagtgagctcgtgctccgaagtggaataggtgatggaattctgaaacctaccctttcctacaatgtggcctttcctacattgctttctcagcatgctgcctagtatatagagatttctgtcttgtttaaattctcttaaacattcaaccgcttttgtttggaaagcctttagcagaaattgttttgcagcaaactttcatgtggtttctgcatttgtagtttgaaatgcacgaaggtttaataaaagttcatgatggcgctttgagacccactgggaattagcacacgcggagtccggtgtgaactgggagatgtcgctccagtctgacctggctctggactgttccacagggtcatttctgatggtggcagatgcatcctgatggcttccaaacacaacaccctgggttttattggagcaaagttccttaaaggcacaatccatgggcttatatgtaaaggcacaatccatgggctctcctgactttgtgtgtgtgtgttcacatgtaaagtgtgcacacacgtttacctgtgtgtaagcttacacatacaatccttttcacaagttgcctgtgtcaaaattgagcagggatttgaaaaaaagaagaaaaatgaaagaaggcaaaatggctaaaaagatatgctgggtatatcaaaggagatatgttagaataaccacagcacataaacaacgtagaagctttcggaaacgtttgggcttttactggtaactgtaatcacaagttgattaaagatgttccagcgtatgcttagctctcgcttaattattcacataaaagtttgtttatgtgccacgttgccaactcccaaatcttccttttcattgtaatattgccaagtttaattagaagactgacttgagctctctgcactttcgcatggaaacagggaatcctgagggagtgctgggctcaggcactgcctgcctttcactcagcagcctgacatttagaagatgttacgtcttctgaaacacaaccagctgttcaactctagggaggaatggaaaattgctttaattgggaggccgttaatgaaagaggtgaagctgacagttgacttctgcttttatctgaaccactggggcctgcacagagattcatctttgaccttgcttactgtcgtggtatgtgtaggttacagaagtccttatcgacagatggagaacatggttgctttttacctgatgctcatggaagaatgaacccacagttctcctgaaggacagaaattaaagtttcgtgctgggcaggccaaaccttctcccagtaaacatttgtctgttttaggtctctggaaacacctagaatggctcactttgctgcctttacctccaccttcacatccacctctcatcttgactggcagcaaggctgacccagggcaacgtttaggagggagacaaagtctgtctttagagcctcaacctccccttagctgcctactctccctcgttgtgtggctctctctctgttggtgccttcttccttttagagcccagggagtgagtgtgtgtgcacacacacacgcatacacacacacacatgcacacacacaagcatgcacatgtaccacccacttactgaaattatcctcaaggaagtgtggatattggatagtcatatgattagagtgaatttaagtcaaagttacccgtatgctgtttacatattaagtctttcttgtagtgtccagtgaaaacttctcaggaatcagagagggagaggaggaccctggggcagaagaaaccctaaaatcatacatattgctttactgtggctacctattcaataaatatttgagagacttaggtgcttgattggtcagcactgattatatcatattttggctctttcataattaaatgtctcatttctatgtcatctctgattacaatttgaaagatttgaagaactagaaggaaatatcttttcttatgatttatatatatttgtataacacattcccttaaatccttctaagccgatttggggtggcatatttaataactaatggtatctaactaggagctgttgacttttatgtgaaaccatcatttgtaaggtccacagagcttcacaaacctaagggcaaacttgcatttaattccagttaaagatatataactgatttaaatcacagccctccaatttaaaataggaatagagccatgatatcacaaaatgcacagaaattcaatcgtgcagaagtcatgaggtcttatgatagctggctaggagtaagtcactatattatgcaatgtcaacctaatttcattgaaaccattgttttctaatttgtatttcaaatgatcctacaggtccaaaattgtaaggaaagtcaacttgatattgttctattccaggttgagtatagcaagaggcaggaaagaaaaagcaagaaactcaaaaagtatgagccaatcagagaaaagtccccatttggtacattaacttgctcacagaccttgggcaagtcactctggcattttcatccatggagccagggctggcttcaagaaccaataagtgaactcaagtgcacaaaggggcccaggtggagtctatagcagtcgaggtgtttgcctggtctcctggggatggtcattgccatgtgaaactgcaggcccagggctggtgggtcttatacttcttcaggagaagctagaaattgaaatatttttttttcttcttgatacagagtttcgctcttgtcacccaggctggggtgcagtggtgcaatcttggctcaccacaacttccgcctcccaggttcaagcaattctcctgcctccgcccccacgagtagctgggattacaggcatgtgccaccacacccggctaattttgtatttatttttttagtagagatggggtttctccatgttggtcaggctggtcttgaactcctgacctcaggtgatccacctgccttggcctcccaaagtgctgggattacaggcgtgagccaccgtgcctggccaaaatcaaaatatttatatctttcaacttttaaaagttgacaactaatttagacttttttaaataccatgcttgaaaatttggtacaatgcttgaaatgttggcaaggccatggggaaacagacactcataactgtaggaaaagaaaatggcacagcccctatggagaggaattgggctgtgtgtctagcatctgaattcaccctttcacccaccagtcctacatcgagagatctattccaaggatacacttaacagaaattcatgtaagcataatactgttctttgcagtaatgtttgttactgcaaaagactagaaacagccaaatgtccctaaacaagaagctgtttgaatcaactgtagtatatccacgtaatgaagtactgtgaagcagtaacagtaaagaatatctcggccgggcatggtggctcatgcgtgtaatcccagcactttgggaggccgaagggggcagattacctgagatcaggagttcaagatcagcttgaccaacgtgatgaaaccccatctctactaaaaatacaaaaaaattgccaggcatggtggcaggcgcctgtattcccagctacttgggaggctgaggcgggagaatcacttgaacccaggaggtggaggttgcagtgagccgagatcgtgccactgcactccaagcctgggcgacagagtgagactccgtctcaaaaacaaaagaaaaaagaatatatactcctctggggagggagtggataaaagtgtgtgtacagcactgtggttcccaaagtgtggtcttggacctgcagcatcagcgtcacttgggaactcgttagaaatgcagattcctaggccctactctaagacctactacatcagtaacccagcaatctatgttttaacagtccctccaggtaattctgatactcaagtttgaggatcactggtataacatgatttgtttatctaggagaggaaaacctgtaagattaaaaattgattaccaatggaggaatggagggaacagactagaagggaaaagaatagaggttcggcttctttggaggctgggagcggtggctcacacctgtaatctcagcactttgggaggccaaggtgggtggatcatttgaggcctggagcttgagaccagcctggcaaatatggcaaaaccccatctctactaaaaaataaaaataaaaaaattagctgggctgtagtggaacatgcctgtaatcccagctactcaggaagctgaggcaggagaattgtttgaacccgggaagcagaggttgcagtgagccaagatggtgccactgtattccagcctgggtggcagagcaagactctgtctcaaaaaagaaaaaaaaaaaaaaaagaggcttctttgaatatgaatttctttgtagaattgactttgaagccatgtaaatattttacataattatagaacaaaactaaggttccaaaaagcagtctccacaaactgaaagcaaaattaaactgtatccggttggtggcataaccatgcagtaggaatttcagttgatttgaaaatatgctttagatgaaacacagcaaatacatctctaactgtttaataatgatactatttatggtggtgttgctattgttattctgaaattattgagtgtgttgcaagataaagcaaagaagtatttatgttagcatcattgagaaatggaattggtaggagaaagaaaacacagacaaaagaatgagtgtagctaatcaaaagtgctgtagtcctgtatctgaattattaatgtaagtgttagtataaactaaagttgtattttatcctttaaaaaaaacaccacttcctatcctggccaacatggagaaacctcatctctactaaaaatacaaaaattagccgggcgtggtgatgcatgcctgtagtcccagctacttgggaggctgaggcaggagaatcacttgaatccaggaggtagaggtttcattgagctgagattgcaccactgcacttcagcctgggtgacagagcaagactcagtctccaaaaaaaaaaaaaaccaaaaaaacaccacttcctggctgggcgcggtggctcacacctgtaatcccaacactctgggaggccaaggcaggcgatcacctgaagtcgggagttcgagaccagcctggccaacatggctaaaccccatctctactaaagatagaaatatttagctgggtgtggtggtgagtgcctgtagtcccagctactcaggaggctgaggcaggagagtcacttgaacccaagaggcaaaggctgcagtgaaccgagattgcaccactgcactccagcctaggtgacagagcaagactccatctcaaaacaacaacaacaacaaaaaaaaaccacaccacttcctaactctgtccactgaaaagtcccagaaatgatgattgccctacagcaagagtatccctgatacccagattgtggtctccaaacactgtttcctgccagaaggaataggggctccatgaagaatgagtgtggggcacaaaatatacaagatagtctgggacatcttgtcacaccaggaaacaagctacaaaagaccataggccaggtcatgaatgctcaagaaggggctcctactagccaaaaatgggataatttgaacatcagtgaagataattaactgaaaacaatggaaactcattaaataggctcatattaatgaatttgcagtgatattaaaacaccaaattgatcacctttgcatgacgctggagaaccaatacattattttgaaaattaaaggcaagaattggctgggtgtggtagcttatccatgtaatctcctacactttgggaggctgaggcagggggatcacttgagcccagaagtttgagaccagactgggcaatatagcaagaccctgtctccataaaaagttttaaacttagccagaggtggtggcacgcctgtggtcccagctactctggaggttgaggtgagaggatcacttgagcctgggaggttgaggctgaaatgaactgtgaccaccactgtactccagaatgggtgacagagcaagaccctgtcttgaaataaaaaggaaagaattaaacatttattctgcctttcccatacaaatcataaactgcagagtaaccaagagttcatagaaggaggttctttttttggaaagattctagctaataaataaagaaggaataaagtattagaaataccaccattttccaactcctaataaattaatagatctagccaataagtaccaatggttgttagcatcacagaagagagacaaccagactttatgtccattggacttcccaattccattagacttccattgtacttccattagaggaagcacaaaacagctgctagtgtattgtgccaaattacggaacctaaatctgagcaagtctctactaaaccagtacgagtataatggacagggcatattaaatgaaaccaggccaggcgtggtggctcatgcctgcaatcccagcactttgggatgccaaggtgggtggatcacttgaggtcaggaattcaagaccagcctggccaacatggtgaaaccccatctccactaaaaatgcaaaaattagccaggcatggtgacgcatgcctgtaatccctgctacttgagaggctaaggcaggagaatcacttgaacctgggaggcagagactgcagtgaaccaagatcgtgccactgcactccagcctgggcaacagagcgagaatccatctcaaaaaaataaaacagaaactctagagatgtcattggtaatagtggaactggggctgtgccgcacagtgtggtttcttcaactcacttgcaaaaggaagaaaaataggggagaacttaaagatgaaaagagactactaaagagatatcaaccatttgctctgtgtgattgttatttgcaaatcaaacaggcaaaagattttaaaaagaaaaaaaggaaatatgaatagtgactggtgaaacttcatgatgttattgaattatttaagtgtaacaatggtattatgtttaatgtccttattttagtctgggcatggtggctcatgcctataatcccaacactttgagaggccaaggccggtggatcacttgaggccaggagttcgagaccagcctgaccaacatggcgaaaccctatctctactaaaaatacaaaaaattagctgggtgtgatagcgtacacctgtagtcccagctactcaggaggctgaggcaggagaattgcttgaacccaggaggcagaggttgcagtgagccgaggttgcgccactgcactgcagcctgggcaacagagtgaggctccgtctcaaaaaaataaagtccttattttagagatacatgttaaaatatttacaaggaaaatgatgtctagaatttaattcagaatgatggggaagcaggggaatggggggtggggcagagacgaggagttaatgattattgaggttggacgatggaaacttggggatttattataccatcctctctacttttatatatgcttgaaactttccattttaaaaaaaagtttaacctaattccagttgaggttaacaggaaggattctaagtagagattttagaatttaaaaaaattaaagctacctgaaaaataggcacttagagtcacatgtgaatcttagaccacattaagtggtctaaaaagtaaaagtaaaagttaaaaaaaaattggagaatgtgaaaccccaccaaaataatctgtggctctttttcaaaatataatttcaaggccaggcatagtggctcatgcctgtaatcccagcactttgagaggctgaggcaggcggataacttgagaccaggaattggagacaagcctggccaacatagcaaaaccccatctttactaaaaatacaaaaaactagctgggcgcggtgacgcatgcctgtaatcccagctactcagcaggctgaagcacaagaattgcttgaaccggggaggcagaggcagaggctacagtgagcagagattgtgccactgcactccagcctaggcgacagagcgagattccatctcaaaaaaaaaaaaagtaattttattttagattttgcaaaagctagtaatttattggccttgaattaattattctgactgaaagccttatcaaaagttctggccacttcccctccctgtctacatacctcgtttctttggcagtctaggaaaacattgtgaaagacattgaaatccaccaaagccgggcatggtggcgcattcctgtaatcccagctactcgggaggctgaggcaggataatcgcttgaaccggggaggcggaggttgcagtgagccgagatcatgccattgtactccagcctggccaacaagagcaaaactccgcctaaaaaaaaaaacaaaaaacatatatatatatatataaatgtcaaggcccgaatgctatttctttttattgttttcaaatgaatgtttatgtttgtgctttgttgcctataaaaatttcttttgtttccttgcagagtgaagagttccacatttatacccagtattgcactaactatccaaggtatggatcgagaatgggccaagagtacttttgttcactttcacattgtttcaagtcagctggtgcagtacacatggttgttaggcattctgtgcctggccttgtgctgaatactatgggaagaatgcaaaacgtgctgagaacagattacaggggcacccagatatggatccgtctgggctttggggctccctgcagagccagtgtggggaaaaattgtaaaagtctatggagaaaccaaaaagatgactaggtatctccaaaaggaaactaagcaagctattgcatcaggccgcaagtcttgcctgctcacccttttctgtgtgtgtcatgtttttaagaatttaggaaacactgctaatgagtttctataatctagatggggagagaacagattctatttttttccaaataagttttatgaactatataagtttaatggagttcagaggaaggacagatcatcataagcctagatgagaagaggggcatcgtcatctcgcctgggttgttggttcagttttccttgcattggaaatcaatggcacaagggcagtgtaggaagcatccttggacaatgtattaaccatttcagtaagggagttgggcctaagatgatgggctacaacggtaggaatttctttttttctccagaagacatttattgggcacttactaattcctaagccctgtgctaaatgctgtaaatacaaaatactgaatttaacttttcaaagcaatccagagacattgagggattttttttaagcagagcacctatcccagtgcctggcccctcctaagttcttcataagtgctagttcaccatcacccctgccccttccccatttcatagatgaagtaactgaggctctgataggtaaggtgattctctgaggggtgcatagctgatgaatggcccagcttggatttgaaccaaggtttcttctctgacttttaagacctcgtgctgctatgagtatgtcctttgaaaagtttctgaaactttgtgattctccccctgcctttttattttcctttttttccacatgattagcagactttgagttatggggtttttttgttttgttttgttttgtttttttgagacagagtctcactccgccacccaggctggagtgcagtggcgcgatctcagctcactgcaacctctaccttctggttcaagtgattctcctacctcaacctcctgagtagctgtaattacaccgcaccccaccagactttgagttatcttaaggaccagccaggaagaagagagctagggagactttacacactctgtagccagtcttggtagacaggtccctgacgataaagtggatggtgggatccacctagaagagaaggcagcacgctgagccctgagtgttacttctggaaggaaaaacaaataggtcccctgttccccactgtcaggagtaaccccagaaagccagtgtggattaaaagacccgggatgttgctgcatgtggtggtgtgcacctgtagtcctagagctactcaagaggctgaggcaggaggatagcttgagcccaggagtttgaggctacagtgagctactgttgcaccactgcactccagcccaggcaacagagcaagatcctgtctcttaaagacccaagaagcggctggatacagagacttatgcctgtaatcctagcactttgggaggccaaggcaggcacatcacctgaggtcaggagtttgagaccaacccgggcaatatggcaaaaccccgtctctactaaaaatacaaaaattagtcagacgtggtggcacatccctgtaatcccagctacttgggatgctgaggcaggagaattccttgaacccaggaggcggaggttgcagtgaactgagatagcaccactgcactccagccttggcaacagagcaagactctgtctcaaaaaaaaaaaaaaaaaaaaaaaaaaaaaaaaaaaagacccaagaagctagaagtttagaggctcaacttactctggcaaatacttttccttggaggacccctgctttccccagtttcccctaaaaaaaacaaaacaaaataaataaatagaaccacatgcatattagaacatttattacacatccttatctgtagacccacccatagttaatttacatggtttcacttaagcaattttctctcttaaagtatttgtttccatcttaatgctgaaaacatcaggcgattgcaggatgccccagctaaatcccatggttctaaaccaaaagccagcttgcctcacaccctaattcagagaaatcacagaatcagccctcatcttctccacaaaacttcttccttagggaaggaaaaaaaacattcagattctgaagaatcatcaaagttccagatccaattatgagaatctaaaatgatacaggagcttgtttggggaattatgtttctataaatctcattataaacatatcatttaaagaaataattcttaaacttccaaaattgcaaattcagaagattttgtgatttattaagaagagtacaaaataaaaacagcttctttatatggcaggctgcttcagagccaggggagaggcaaatcatttgtgcaaggacatttttaagagctggtcattcatggagcaccgtcccaagcctggtgtatattggcaggaaatagcaaacaatacccttgccttcaagcagtttctgttcttttgaaggtcagatgcaactaaatgcaatggtggaagagcatgttctggaagatcaaataaatataaattaacacaggacaaactcagtaatgtgtagtaaaagctgaaggttaaggataattttctggagaaagttgtctttttttagagttagagtctcgctctgttgcccaggttgaagtgcagtggcatgttctcacctcactgcaacctctgcctcctgggttcaagcaattctcttgtctcagcctcccaagtagctgggattaccggcacatgccaccacacccatctaatttttgtatttttaggagagagggggtttcaccatgttggccaggctggtctcgaactcctgacctcaagtgatccacccgcctcggccttccaaagtgctgggattgcagccatgagccactgtgcctggtgagaaagttgtctttaaaaaaaaaaaaaattgagtctgactttgaagaaaagtgttagcagagaggtactcaaaagttgttctcagtgaagaagacatgtccatttcttgcccaattgtgtggttttcatattcatagataaatattttatcttgtccacttgtatcccatcactttactctctgagacccaaagttcccttctcccacttaacaagccaaaaatgccaggtatttcagcccatctgacaaattttccttccccctttggatcctgtctggtgatattaaatgtcacaggcacatcttgacagtgtccactatcttcataccagtcacacctcagtgattttgctgtgaagagccacaagctcccacactctgttccccagggagggacgcaaacccagccaggtccttgtcctcagatgcctgcctgtacccaagacttccgggaacctggagctcagcatgctcctaatttgttgcaggttcttacccttgagcaagaacccaagcctttaggtggccaaagggctacagagcagccgattctgactctaaagaaccttagaaatgttcctaggttacatgatggagagttttgaaatcttgactcaaggggaaaataaatcagtgtgaatagatatttctcaaagtagattggcacaaaagggattctaatggtttaattacgaaacttccatttaacttccttcctcacagccttattttgttgtttggctctgtctgattttctcaattaatcctgaaaatgtcactgacttagggagaaaagggctgaaattatttccacctgcttccttctacattttgcgaacgaaagatttttaatttacacgcgtgtgactgcacaagccgttagctggctttgtgatacgagcattgtttcaaccattgccttaagatgttttcgtctgtgctcatcacctcggggggatctgggttgcggaaagaattctaacccacttttggaacaccctcatctgaggcgcactccgtaggagcaagactatctggctttcccagaagctgtatcacttataaggttaacaatttggaggtagaaagggagacctcttcaaagattctcacagggaagttacccaggggaagaggtctctaagcaagcctaccacatagggtcacagtttgtgcatcatataaaaggggccagcagagggggtgattaaatgctctgacggggggctggatcttccagcaggaaggaactcctttttcttagtacaaaaagtgcctagtctttataatctaacgcgtggaaatggaataccgacgtgctgtgtgagcactgcacagagatacccagattgggcgcagctaggggctaaaatccctctccaataacttttgccaagccatgggccctggcacaaggccgcgtctcctagaaggaaggaacttgttacttagaagccatgagcccagggtgccactgccagtgggtccggtgcctttttctaattcaccctcccagagggaaccctttctccaatttgcctaaaggcatgctgatctgaccacagctctggagctaccctactcattttagggcatttacacttgcaatagcatttaaaatttgaatacccacataaagcattacaatttagataaaaacatggactcttcctgcaggtccgtggctgtgctaacagagtgtatgaggaacaagatactggccaaattcttcagggagcgtcaggaaactctgaaacactcgctgcctctggggtcctatctcttgaaaccagttcagcggattctcaagtatcatctccttctgcatgtaagtttctgcctggcatgagcactttccaggggatgggagttttgtgtgtatatattaagtttggtggaaaataccagaaaatgctatggacatatggaaacatttcccacactcatatttcacaactgactaatctgctttgaggatttggagatatttatattctaggcccgtagccccattgacaacagccaagagaagagattaatcttagctctgattctgatggggcttaggagtgcctcgccctgtgcactgacagtttcaggcagggagctatcatgcgaatgaaaaacagattttgtaatgtttccatcagccccgattcagtaggcaattggaagggaaagctatttgtcatagattggcttttgtatggagagcaaagagaaggggctgaaaagggagaagacagatgagcagagtgataagtgatctccaagctgggcttagcgtcacttcagttatctcctcttatattattttccactacttttgcaaaatgcaagaaggctttagaaacaacgataatcatagctcttaaattcttttttcttttcttttcttttttttttttttttttgagacagggtctggctctgttgcccaggctggcgtacagtggtgtaatcacagatcactgcaacctccgcctcctgggctcaagcaatcctcctacctcagcatcctgagtacctggggctctaggtgtgcaccaccatgcctggctaatttttttgtatttttggtagagatagagtttcaccatgttgcccagcctggtctcgaactcctgagctcaagcaatcctcctgcctgagcctcccaaagtgctgggattacagatgtgagccaccacgcccgtcctcaaattcttatttcttaccctccaaaaaactgatgcgaatggaaaaaaaaagtattaccgcaagtaattttcattctgtaagtagggcttgcttacttttgtagcaggagaaagacagtacagcagagtggttagaaacagggctctgggaaagactgcctgggtctaaatcttatacgttgcccacattcactgtggctcacaagcacttgataaaagtaagctattgttttttattatttttatgatacattaaaatcccctttttaaaggaattttaattcagagttcctctccacgtcaacaggcctgcagtttataggtatctctttttaagtgattccaggtttctaatttggataattattccagatttgtttggttcatatacatttaaaattttgaaaactttgtccatctttactagcaatttcttagctttgtctgtttgcctgggtagctcatctttggagaatcttatgttctatgaagtcacatcagggatattattttaatttttaaattgatccgtatgacctcttagatttagtgggatttatttgctaaatcagtgtccaaataactcttaaataatatttgtctcaggacacatctctgctgaattctgttaatataatgtctaagactggtgtgtcccaaaaatctctaatatggtcttctagacagtaagatggccttcagtcaaaaggaaagtttaagatctcggttaagcatatgaaacaagtcaagatccttacaaaaagttaattaacaggaaaaacagcctttatcctacattttaagggctggcaatgaagaaaaaaaacagtggttggattaatccaaaactaacttctggttgcttttgaagtgttttctgcttttataattgattagagggctccctctatgtcattcacatcatttttttttttttttgagatggagtttcactctgttgccaggctggagtgaagtggcacaatctcagctcactgcaacctccgcctcccgggttcaagcgattctcctgcctcagcttcccgagtagctgggactacaggcgcgcaccaccatgcctggctaattttttgtatttttagtagagacggggtttcaccatgttggccaggatggtctcgatctcttgaccccatgatccacccacctcggcccctcaaagtgctgggattacaggagtgagccaccgtgcctggcccattcacatcatttcaaagttatgtagctatccatgaaaatccccacagaaatatcctctgtacctcccagtctgtttactgatgagcacagttgtctctcaggctaaaagaagaaatcattatgtttttaaatttgccatctaggatcttgttaacagctagtccaagcacggaaagaaaatgtaaattcttttacagtttctagctagatgaaaaacttgagtactcagtaaaagtaaacaaagatttacattgttactacaaaataatggaactaatcttcaagttgcaccataacatttaacctccacccgttagctgattatgtatgataaatgtcacaagaaccatctaattgattacaatgttttcttactgttttaggcactaatataggattactgttattgttgtctttaaaaaggcaatagtttcaatttaataagcacttattcaccacccagctctctgctgggcactgagaagataaagaatcaaaggaactatatacaatattctctatccttagactcttgaggatctaggaacaagtgtcttatgtgctcaaaagaactagaacaaagatcctgtccctctctcacgttcctgggagtgtgggcctccagtggtaagatgattgctaatctaacatacttctgaccatcagagaattgagtactgaaaccatgagatccttctcaacactctcaaggattgtctttagtcaacttcatttggcctttaaaaccttgactacaggaaaatgtgctaaaatgtctacttgctatggagataattttgtaaagatagttttcgctatatttttgagtctgttaaatattaaggtcctgtatgaaacattttgcttcctaaataaataagggaaaaaaataagtatgcattttatcttgtgagagtgagaactatatttctgagaactgtataacattggccaccaggaagctcagaactccagagctataagagcaatttccacgtctgttataataactataatatcgctatgaaactcaatgggctacatgtatgttgtattttatcctgtttatcctggaatcctattccacttttatctttcctatccttgtttttttttttccccttgtcttaccattttgttgcaggtatctctggcctcaaaatcttaaagaatgatgctggtgtgtaaatattttatatatatatatatatatattttttttttttttttttttttttttttcgaggcagagtctcactctgtcagccaggctggagtgcagtggcctgatctcagctcattgcaacctctgtcccccaggttcaagtgattccctgcctcagcctcctaagtaactgggactataggcatgtgccaccacgcccagctaatttttgtatttttaggagagacagggtttcaccatgttggccagactggtctcgaactctggacctcaggtgatccacccacctggcctcccaaagtgctgggattacaggcatgagccaccgcacccagctgatagtgtgtaaataaataagcaaaaataaaatataaggaactaatcatagcggtgccatttgtttcactgtctatatgaaaataaaatgaaaaaaaaaaaaaccctcgttcttttttgtttaaggaaatagaaaaccaccttgataaggacacagaaggctatgatgtggtgcttgatgctatagacacaatgcagcgagtcgcctggcatatcaatgacatgaagcggaaacacgagcacgcggtccggttacaggtgagcccgcgaggtgtcggtgcccggcagggttgcaggtgtagtgacttactgttttcccaataaaatattaaggctgctcaagtactgcactacactcatcatcttcagtgtagttctccctgaaaaaagttcaggacatcagtaatacccatcattgtctagtatggctatttaagagaaagggatattataacttttttttttttttgagatggagtttcgctcttgttgcccaggctggagtgcaatggcacgatctccactcaccacaacctctgcctctggggttcaagcagttattccccctcagcctcccgagtagctgggattacaggcatgtgccaccacggcctgccaattttgtatttttagtagagacagggtttctccatgttggtcaggctggtctcgaactcccgacctcaggtgatccgcctgccttggcctcccaaagtgctgggattacaggcatgagccaccacacccggccgacattataacttttaagctaattgtttgcttatagcccctttgatggtctaagttacaattttgagcctcccacttctattaattgcaaatttagtaattcttattgaaagcaactttccctaaactatgtaaagactttttaagcctttattcctctgccaccagttcctgcaaaatcatgaggtggtgcgtgggtggtcttaggcaggggacgcagagtaaggggagccaaggctgaaccagctcctttacagtcacttgggacctgaccctccagcatgtcatttcggtttccttttttttttttggagacgaagtttcactcttgtcgcccaggctggaatgcagtggcacagtctcagctcacggcaaccttcggctcccgggttcaagcgatcctcctgcctcagcctccttggtagttgggattacaggggcataccaccacgcccggctcattttgtatttttagtagagacggggtttcaccaggttggccaggcttgtcttgaactcctaacctctggtgatccacctgcctcagcctcccaaagtgctgggattacagatgtgagccaccgcacctgacagtttcctcatttttaaaataagacagagaagtttgctaaaggcctatccagcacaaacattttgagccctgaatcttaaggaacttttgacagctgttgggccagtgatcatgccctgggcacctcaatagatgcactattaaaaacaaaacaagaggctgcatgggcccagaggccagttccaggctcctggctgtccctagagtgagatggaaaagcccaaagtgactccacactatacagagtggccttgcctaactcgggaaaaaagataccttatttggctcataagtcagaataaactctgtaggtttcaggtataggcagccagagtgtggtgtgatgccactgactatcaaaaatcagaggaagatgacattctaatcttccaggctgcttttttttttttttttttttttttgcaacagcaacaaaagtttaatactttatcatacaagtgttttgcagacataatgtcggaatctattgaatacagtcatcccccctatccgcagtttcactttctgcagtttcatttgcccatggtcaatcaaggttagaaaatttttaaatgagggccaggagtgatggttcatgcctgtaatccctacactttgggaggccgaggcaggcggatcacttgatgtcaggagttcgagatcagcctggccaacatggtgaaaccctgtctctactgaaaatataaaaaattagctgggcgtggtggcacacgcctgtaatcccagctgtttgggaggctgaggcaggagaattgcttgaacccgggaggtggatgccattgcactccagcctgggtgacagagcgagactgtctcaaaaaaaaaaaaaaaattagccgggcgtggtggtgcacacctgtaaccccagctacttgggaggctgaggtgggagaatcactggaacacaggaggcagagaggttgcagtgagctgagatcacatcactgcactctagcctgggagacagagcaagactccatctcaaaaaaaaaaaaaaaaaaaaaatgaaatgaaaaattctggaaataaacaatctgtaaattttaaattgtgcaccattctgagtagcatgatgaaatctcacactgcctttctccctcccacctgggacatgaatcacccctttgtccagtgtatccacactgcctacggccactcacctgttactcagtagctggcttggttatcagatcgactgtcatgtttctcaatgcttgtgttcaagtcaaccttattctacttcattatggccccaaagcacagagtagtgatgctgacatattgttataattcttctaatttattatcagttattgttgttaatatctttatgcctaatttataaattaaactttatcataggtatgtatttgtagggaaaacatagtatatttagaggtcaatactatccccagttccggtaatccactgggggtcttggaacatatcccctgcagataagagggactgctgtattcagaaatgtctgaatggctggtttttcatactgtgtgaagctgcttgatattctgaagtcattactaaatcagactctggctcaaactaatactccatttctgttcatttctgttttcaaccagtaaagttttttgttgtcttgtgggttccttaattaaacggtgcttgtgaatattttcatttttcaaataataaaatcagcttccttcaaaacactgatattcatatacaataaatcccacataaatgtcaaagtcatgttagtttatttatcaatttccattaaaagcactaaaacggggagtggggcaagtgggggtggttaatgaatacaaaactttacttagagagaatgaataagatctaggccaggcgccggggctcacacctataatcccagcactttgggaggccaagtggatcacccgagattgggagtttgagaccagcctggccaacatagtgaaaccccatctcttctaaaaatacaaaaattaaccaggcatggtggtgggtgcctataatcccagctacttgagaggctgaggcaggagaatcgcttgaacccaggagggagaggttgcagtgagccgagattgtgccactgcactccagcctggacaacagagcgagactctgtctcaaaaaagaaaaaagaaaaagaatgaataagatctagcatttgatagcacaacaggaggattacagtcaacagtaatttataaaataactgaaagtataattggaatgttcgtaacacaaagaaatgataaatgctggaggtgacggaggcccatttaccctgatgtgtttattatgcattgtatgcctgtcaaaatatatcacgtaccccataaatatatacacctactgtgtacccataaaattttaaaattttaacaaaaaaagcactaaaacataagttaggggcaaagaaaggttcatttcctttccctgagtaagtaaatttaaactcaagaaatttctgagaaaatgatgtgggtgattttatataggctttagttttgaattacttatgtgtggtatgaacttcagtatccggaagaaagtcttcaagtcaacagctctgaaggagtttttttttttcccagagaggaggggtgagaaaaatcaagggaaggggccgggtgcggtggctcacttctataatcccagcactttcagaggtataggtgggcagatcacttgaggtcaggagttgaagactagcctggccaacatggcaaaaccccatctcgactaaaaatgcaaaaaaatttagccaggcatggtgatgggcacctgtaatcccacctactcaggaggctgaggcaggaggatcgcttgaaccgggaggtggaggttgcagtgagccctgatcgcgccacttccctccagcctgggtgacagagcgagactctgtctcaagaaaacaaaacaaaacaaagaaaatcaagggaaagaggccatactggtggcccctggacctggctttggaacgatgtaagggctgctgtgagccacagcatggcatgattaaggaatggaaataagtaattagcagcttgtcagctaacagcctgattcattgctgttaacccttaagtggcaccacttgtaaatgcagatttatgtcatagaccatcagataccacgtagatagttagaccccctcagggacgatttggcaccattcttgaggctcaacagatgggccaccaagcccttggtgcctggcttctgcctcctgtaaatgccatggcccattccctttctcaggagatacagagtttgctcactaactggaaggggccagacctgaccagctacggggaactggtgcttgagggaaccttccgcatccagcgagccaagaatgagcggacgctcttcctcttcgacaagctgctgctcatcacgaagaagagagatgacacgtttacatacaaagctcacatcctggtaggtctgcacgctggccatgggcagggactcagatccccagttctgttccctcctgagtgtgcctcaccctctctgctctctctgctctagtgtggcaacctcatgcttgtggaggtgattccaaaagagccgctcagcttcagcgtcttccactacaagaatcccaagctgcagcacacagtccaggtagcagccgggccctggcctctccgcaaggcccctttgtgtaatgatgagtgctgtgtaccatgtggctttttgagagcgttctggccacatggtcatttcccatctcatcagagggtcctgtgggtggtggaatcaagttgtctgactgtctacatctcgtcttggcaggccaaatcccagcaagacaaacgcctctgggttctgcacctaaagagactgattctggagaaccatgcagccaagattccagctaaggtaggacactgaataatgcacagtgaaatgggagagagatacaagaatcatttgaacctgggaggtggaggttactgtgagccgagatcacatcattgaactccagactgggcgacagagtgagactgtctcaaaataaaaacaaagagactgggtcaaaaaaaaaaaaaagagtttagaattagaatctgggagtgacaacggttaatctgatcatttaattactaatgaagcccagcaaggcatcctgataggataaatgttcaacttcataataaagaggctggcatgtggctcatgcctgtaatcccagcacgttgggaggccaaggcaggtggaacacttgagcctaggagttcgagaccagcctgggcaacaaagtgatacccccatctctacaaaaaatataaaagttagcacccggcatgatggcacgcacctgtagtcccagttactctgggagactgaggtgggaggatcacctgggtccgggaggcggaggttgcagtgagctgagattgcatcactgcactccagcctgggtgacagggtccagacagggtctcactctgtcacccaggctggagtgcagtggcgcaatctccacacaagaaaaagcaaactgcaacctcttgtgcctcagccacccgagtagctgggactacaggtgcgcaccaccacacctggctaaattttgtatttttagtagagacagcaagaccctgtctcaaaaaaaagaaagaaagaaagaaggaaggaaggagggaaagaaagaaagaaaaagaaagaaagaaagaaagaaaggaagaaaggaaggaaagaaagaaagaaaattgagagatagaatatataggaactacatctcagctaaaccagccattaacatcaaaaagactcacatggggccaggcacagtggctcactttgggaggcactagcaccttgggaggctgaggtgggcagatcacctcaagtcaggagttaaagaccagcctggccaacatggtgaatccccatctctactacaaatacaaaaattagctgggtgtggtagcacgtgcctgtagtcccagctactcaggaggctgaggcaggagaatcgcttgaacccaggaggcggaggttgcagtaagccgagatcgtgccattgcactccagcctgggtgacagagcaagatcctgtctcaagaaaaaaaaaaaaagattcacatgaattgcaggctctgtggaggtggtggtgtttttccttttggggcttaaaagaagatcaagttatgagaattattcaaaggtgcatgaagcacctatgggtgtaaagctgtgctgggtcccatgagggtgctcgggagacaagatacagattcggccaagaaggaatctgtagatggggagccagctgccaagccatgaaccgtttgccaaccatgaagacataacagagtataacccaggtgttgtggaagaataaagtgttcaattgcgttgagtggagagaggaaggaaaacatcttttacctcagtcttaaaggatagggaatgtttttttttttttaaagacaggatcttactctgtcgcccaggctggagcacagtggtgcaaacatggctcactgcagccttgacctcctgggctcaagacatcccaccacctcagcctcccagaatagctgggaccacaggcttgtgccaccacaccaagctaatttttgtatttttggtaaaggtgtagtctcatcatcttgcccaggctggtttcaaactcctgggttcaagtgatctgcctgcctcagcctttccaaagtgttgggatgacaggcatgagccactgtgcccagtcttaggaatatttttattaagtgggaaaaaaggaattaaggaaaccagacctagagacctgcattaaaaaaaaaaaaaaagagagaatgtatgcgctgtgttcagggcgcacagacggtgccaggatgggagggctgagttctcagggactgaggcaggggctggggcagggacgggaagggcaggagcccctggagggctgtgagcatgtgctctgaggaatctggacgcgttcacactgggaaattactgcaggctttggaggaaggggagatggcgcagtcagtcctgtgttctgagagtgtaactttggggacaaggtgacaaataagtggcaggagtgaggttggaggctggagaagatagtaacccaccaccatggcctagaaaggagctgagcagtgctgccgtggagccacagcgacagagggaacaaatgcagaaagtgccactgaggcaggaggcaggattttgcccactaaaagtcaaggctgagtcaggggttgaaggagagcatggtactgtgagttctgagacaggcagggagaggaacctgtgagatgggagtgagagagaggagccctctgctctcactggcacccgtgctgctgggcagggtcagccacaggtggaaattcaggtcttggaagctaaggatcaggagactcttgctagaggcagtaattgaagccctaaggtttaataagatggcccacaaaaatgtgcaaaggaaagatgaacccttgggaatcccaacatctaagtgatcagcaagcgggtggggggatttggagaacagccaaagaaagattgaaagagtagcagaggaggcagggaggatgtctgaggagaaggcactgcgctaacaaggaaaaagcacatctcagagatgggggagacacagtctcaaaggctgccgaggtcaaggagatttaaacagaaaagcagattttatatttggcaactaagagaaaagggagagatcacagtgggttgcagaaaaagggggattaagaaggaacggaatgggtatagacttttttatatgtaaagttcacaaaaggaagaaaaaatgatagtttggagagaaaggcaagagcaaagcaagacttctcgtctggctcgaatgccgagtccatgagcagatggcagggaaggaggaggaaggtgggagaggagacagtggctcacttcttgttggaacggggcctggggaggtgggaaggaagaggatgggacacacaggaataggggctcatcttggaaagggctggaagcatctctctgaaccaagggagaaaaagatgaaagacagaggaactttgaggtggacttgggggaagacaaagggttcgatttcactcgtgcagataataaagtcatctgctgagtgagtgaagcagagagcaggggtgtctgagggaaagtggaaaggatcagaagaacacttgctggccgggcgcggtggctcacacctgtaatcccagcactttgggaggcggaggcgggcagatcacgaggtcaggagatcaagaccatcctggctaacacggtgaaaccccatctctactaaaaatacaaaaaattagctaggcgtggtggcgggtgcctgtagtcccagctacgcgggaggctgaggcaggagaatggcgtgaacccgggaggcggagcttgcattgagccgagatcacgccactgcactacggcctgggcgacagagtgagactctgtctcaaaaaaaaaaaaaaacaaaatggaccagtcactagagatgactagaatagcctgtgaaagacatcaaagacccaactgaggctggcccccatgaatcagtgtgatgacgtcatttcaaaatctgctcagcagcttggaaactactggtgaaaaccgtggtgtgtgtgggttcctccaggttgggaaccggcagagctggtaggggaaggttcccagggcgggggtggggagggtgccagtgagcacgcagttgcagtaattgggcatgacattaggctgagtgaagaggaaaaccagctggcgacagaggcgtggggtgagggactgcagtattgtcataaagcccggttcagcaggacttaatgtgagagagaaggaaataccctaatctgtaattgaagaagggacttttggagtcctgccttagaggtgggacggttttgagtgtgatcaggttctggaggtggctctgattctgtgctgctgctctggagtggaggaaaaggtcattagaaagtggtcaaggaactagggtggtgggtggattattcacatggatggtgaaacagtccaagttggggctgggaggagtgaggtggagcagacaatgggatgatgatcatgaaaattgaactgggtggaaaataagggctgagatttctgagaaaggggacagtctgttttgttctctgtatattttgacaagcatttgaagcttgttctcaggactgccagcaatgatttggtcctcaggaaatgaatgtgcataggtgtggacttggacctaagcatgagttttcatttcgtcagggtgttatgagatgaaagggagctcatgcagagaggggactgcattttctttatgattagtcattttgttgctggcctggtgccttagaatgcccttctgagcaatggcagagtatctttgatgggccccacccattgtttacctgtctgctgggaaaatcaaaattgctaacaagattctgaaaggcagttacaaaatgagacccccttacatacctgtctttctcccacgctaggcgtgtgtgcctcaggaagttccctttaagtattcaaatggttaatatagtcaatataacatcgtactttctccccaagttgtcgatcctttctatctaaaaacatcttttcagttacaacttattgagcatacacactgtgctgagtactttatattcttatttcaccctcaccaaaatatgttatgaggtagttcttattcttcccattctagaaaaaataaaaacagaggctgagagacattaaataaactgcccaagtttatataactagtacatgaccaagcctggattggtctatctggctccaaagagcatcctaaccacattattcccactggcaataaaaacacctttttttgttttgttttgttttgaaacagcgtctcactctgtcacccaggctggagtgcagtggtgcaatctccatacaagaaaaagcacactgccacctccaccttctgggttcaagtattcttgtgcctcagccacccgagtagctgggactacaggcgcacaccaccacacctggctaatttttgtatttttagtagagatgaggtttcaccatgttggccaggctggtctcgaactcccggcctcaagtgatccacctgcctcagcctctcccaaagtgctaggattacaggcacaagccaccacacccagcctcaaacacgcttgtctaatatactttattcactataatgtaatcataattttctatttaagcaggattatcattaaagtgaactttccacatctttcctcgagattatttcttattttcctaaagttttcaaaatgtatttctattatttctgtgaaatgaatgcatagtgggaaattttaaacatcaagaaatgtatcaccagtctaataatgtcaacacagctgtgggaaactcattagttacagcctcccagctgccttccgttcttttaattcaatgatggtccttggctgacacctagtggaaatcctggaaacagtactttaaaaattaaatgtccagacaaaaaaaaattcttgaagtcagctttacagataccagggaacttcttggaaatagccatattgcccattagtatatgtggtaaataaatttaactcttctccaaattaattgaaaataaaggtgaaggtattttgcattttatatattagtatgtttctgtaattgcacttcccagagagagactgagctaacatttgtgtttgcaagtaatttcaactcataatctcaaactctgaatgtatgagagagatagctatcaggttacaaaaattgaagcatttgttttctctaaggtgactgtgttgaggctcccccaagccccacactttttcactaaacgtgatcgccacttagccgaaatatttgtactgggatatcacagatggtagcaaaatagagtaaaattattttaaaagttatttttagcatagtgttttgtaggttaaattatactacccttaaaaaatgaaaataactttaaagaggcaagaaaggctacaatcccctaggacagtggtcttcaaccttttgggcaccagggattggttttgtggaagataatttttccacggatggaggcagggggaggcttttgggatgatgaaagcacattacgtttattgtgcactttatttctattactacatggtaatatataatgaaatcgttctacagctcaccataatgtggaatcagtgggagccctgagcttgttctagccctgagcaactagacagtcccatctgggggtgatgggagacagcgacaccccaagtgtgttgcttatgtccagtctgctctcatcttattttggtcactgtcactgcagaaaaccctgcttcacaaagataggatgttggaaatggaagcaggcttttgtgcttttgtggcaatctcaggatattcgcctggactttaatccagaatgtaaggaggtttgaagttgtctcaaacatactttttttttttttttttttttttttttttttgagatggagtctcattctgttgcctaggctggagtgcagtggtgctgcaacctctgccttcccaggttcaagcaattctcctgcctcagcctcctgagtagctgggatgtcaggcacacaccaccacgcacagctaatttttgtatttttagtagagacggtttcaccgtgttggtcaggctggtcttgaactcctgacctcgtgatctgcccgcctcagcctctcaaagtgctgagatcataggcgtgagataccacgcccggcctcaaacatacttttaaggccaccagatgcagctgtacaattgaagtacatcaactcacttgccacgataaagcctgccaccagatgcagcttaattgctccttgacactcactgacagggttttgatatgaatctgcaagcaattgatttattatggtctctgtgcagtcaaacctctctgctaacgttaatctgctcctcagtgctagcatcactgcctcagctccacttcagatcatcaggcattagattctcacaaggagtgctgcaacctagatccctcgcatgcataattcacagtagggttcacactcctatgagtatctaatgctgccactgatctgataggaggcagagctcaggctgtaatgcgagccatgaggagccactgtaaatccagacgaagcttctctcgcttgcccaccactcacctcctgctgtgcggcccagttcctaacaggctacgaactagtactagtctgtggctcgggggttggggacccctgccctaggagagtgggtggaactcaccagttgagctgatcattgaatcctaatgaccattctgaaagagaggctccctgatcccactgtccagttgagctcggagagcacccacctagtgaagtgcctgagctgggatcacagacattgtccttcagggccgtctcactctgggagattctggggcacacagaagagatgggaggtgcagggagttggggaaacagagagacttagctcatgataatcacagcattctgcaggaggaaagacaacaatgagaggaaacttccagcagccattttgcaattaactcaaaatagttacaaggccatagtgtcatggtgagggctggtgataaagataccaggctccgtgccttgagcttttgagtcagtagatcagggttgggtggcaagaatctgcatttttttttttttttttttttgagacggagtcttgctctgtcgcccaggctagagtgcagtggctcaatctcggctcactgcaacctccgcttcctgggttcaagcgattctcctgcctcagcctccctgttagctgggattacaggcacccgccaccatgcctggctaatctttgtatttttagtagagacggggtttcaccatattggccaggctggtcttgaactcctgaccttgtgattgtgatctgcccgcctcagcctcccaaagtgctgggattacaggcgtgagctaccgcgcccagccgagaatctgcatttttaataagctggccaatgagtgctgatgatcagccaggcttcggaaccagcctccctccctcctctttcacaggattgggggtgcagtcttagctccggtgccttgatggtgtagcagctattacccacttgagggcgctcatctgcttgaattccctgcactgtgtgtaaatgcttaacataaatagcgagtttttaaacgtttttaaaaatctatttattcaggtgggataagatctgtgttgagatttggagtttaaagaaaaaaaaagcaattggaattacagctctactttctctctttcaggccaagcaagcaatccttgaaatggatgccattcgtaagttttatttccttaaaacaatttgaaatttcattgtctgtttgtatctatcacattttctatcttaaagttcatgaaaatgtcgattgttagaaaatagtatctctctattcactgttttcacaaattgggtagacagtataatcccttctaagcacattgacttgtttctacattggttctcccaggtttatctgagtcccttgatggctggccactgttggggtttctgcatcaactaacaatgtcagttatgtctccagggtcaactctacccctacccctgccccaacctctaccaccaccaaaaaccagagcttaacaatgcatttctcacttcatccctaacaaaatgttgattatctgcaagaatcgcaatcacttcgtagtattggttttcctgatgcagcagaaacttctaaaatcacaaccaccccacatatgtgcatatatttctaggcttacaaaagcaggagagaataaatgttacaggtccttcctattaaataagaccttattcaacagcagttatcacatctttgttatttttcagattaaatagaataaaaagagaaaacagtggctttaaatgcagtcaggtctgctggaaacttgtactgaaaacacttctactttacttaaccctttcataagaccttacttcgaggaatcaagtgcaaacgttgattcccttccctccagcctggcacttgttaactccccagggggaaaagcagcatcagcaaagtggaaacaggtgcattcccaccatcgctgcagctgaggctcccatctcgcatccaacagacccgagaaatgatgcccagagctccccagcggagtgctaggctgtattctctagacatcaacattttacctgcagaaattgccttcggattttttttttttttttttggccgggtgtggtggctcacgcctgtcatcccagctaatagactcctagaagtcccaatgtaaacaaaaagccctgagatacatatacagcagcaattatgggaggaggatcatatccatgtcagatgaaaaagaataaatccatataggccgggcatggtggctcacacctgtaatcccagcactttgggaggccgaggtgggtggataacctgaggtcaggagttcaagaccagcctggccaacatgttgaaaccccatctctactaaaaatacaaaaattagtcaggcatggtggcacgcgcctgtagtctcagcttctcgggaggctgaggcaggagaatcacttgaacttgggaggtggaggtcagcagtgagccgagatcatgccaccgcacttcagcgtgggtgacagagcaagactctgtctcaaaaataataataataataataataaatccatataaatctacactagccataaccattttctgagaagcccctgacaccacagtcccactgatgcacgtggttatctttacagatcatccaggcttctgttacagtcctgagggagggacgaaagcactgttcggctctaaagaaggttctgctccatatcggctgagaagaaaatctggtaagtaagatgttgtcataaaaatttaattctaatgggggactggcaatgaaagtccctttgagtctgacaaaagggaatgttctgtctggtttctcagctcactgccggtctgaatacatttgcggctgccttaagatgggactcatgagcttttgatctaaaactcttttctctgtaatcctagcactttgggaggccgaggcaggtgggtcacctgaggtcaggagttcgaaaccagcctggccaactggagaaaccacatctctagtaaaaatataaaagttagccaggcgtggtggtgtgcgcctataatcctagctacttgggaggctgaggcaggagaatcgcttgaacccaggagacggaggttgcagtgagccaagatcgtgccactgcactccagcatgggcgacagagtgagactctgtctaaaaaaaaaaaaacctcttttctacttaatgtttcccagtgactatcaagcatgccagtcaactaattttgctttgtacatcttaccattgacatgcagatacttaagctgtatttgctgttgctaatgaaaaatcacgtcctatgagtgacacacacaaaagattatccaaagctaaaattttaattcatatttgctgcaccagactccatgaactattgtcttagttcagacaggtttggggttttatttgaagcagtctttattcattacccactttatgctttgctaaggactaggaatgcaaggataaataatccacgtgactcctgcttgcaaggagctcatggtgcgagagacaaaaaatgcaaataaggccgggcgcggtggctcacacctgtaatcccagcatttcgggaggctgaggtgggaggatcacctgaggtcaggagtttgagacctgtctggccaacatggtgaaaccctatctctactaaaaatacaaaaattagcctggcatgttggcagatacctgtaatcccagctactcgggaggctgaggcaggagaattacttgaacctgggaagcagaggttgcaaggagccgagatcgtaccattgcactccaacctgggagacaagagtgaatctcagtctccaaaaaagaatgtacaattgaacatcatcagcttataggtgttagtgaagctgaggaagctgctctgctactgacaggactgaaaaagtcagattttgcttttctgttgggtgactcctgataacacagcataacatttattctaccattttagcagagtgaatgtcttgctcctgtgtatctctgagcaatggggattttgttaaatttgatacaaaagttatagagctctgttaatctgtcaataggctcataatcctcttataaagaataaagaaaaaggtttgatttggttttgccaatgatgctggctttgttttgtctcccagaaccttcctcacggtcacataaagttttgaagaccagtggtaagtcgtaaaatatattttcctgtttcattcttgttgatattcactaaatcaaaccacacaaaaataaataaataccagataaattacatattgacagatttgatttgattacaaaaagattaacttctgtaaataaaagtgtcccattataaaatatatagtcaaagccaggcacagtagctcacgcctgtaatcccagcactttgggaggccgaggcgggcggctctgttgaggccaggacttcgagactagcctggccaacatggtgaaaccccgtctctactaaacatacaaaaattagccagtcccagtggctcgtgcctgtaatcccagctacttgggaggctgaagcaggagaatcgcctgaacctgggaagcagaggttgcagtgagccgagatcacgccattgcactccagcctgggcaacagagtgagaccgtgtcacaaaaaataataataataaaatttaaaataaaatatacagtcaaatgacataaaatacttgtaatatatttgacaggcataaaaagattattattcctattatataaagaaactccatacatcaaaaagaaaagacagaggactcttttatttttttttttatttttttattttttgagacagagtcttgctcttgttgcccaggctagagtgcaatagcgcgatctcggctcacctcaacctctgcctcccaggttcaagtgattctcctgcctcagcctcccgagtagctgggattacaagcatgtgccaccgcgcctggctaattttgtatttttagtagagatggggtttctccatgttggtcaggctggtctcgaactcccaacctcaggtgatccacccgccttggcctcccaaagtgctgggattacaggcgtgagccaccacgcccagcccaaaggactcaaaaaaaaaaaaaaaaaaaaaaaaaaaagaatagggcagtttcacaaaaacacacaaactggcaataaaaattttaaatggccatccatattcataatcagaaaatccatacatttaaatgaaataaatagaagggaaaaaactatgaacgtggccaaaacatatagaaaaatagtcactccaaaactgttggtgggagtaagtttttgcaacgcttcaggggcaaaatttggtaatagtcgtttgaatttaaaaatgtacatatcctcttaacccaacagtttcacctgcagagatgtacttacccacatgcagacggatttatgtgggagtttgttctttgcagtatttgtagcaggacactctataaaaatgcccatgcagttggaaatatacttaaagaaattgtaatacatccatacacacaatggaatattctacagctgtcaaaaataaagaagatctctacctgttcacaagagtgtccacgtatatttagcagaatatacaaagttgcatattgaatccttattttaaaagtgaaacaggctgggcgtggtggctcacgcctgtaataccaacactttgggaggccgaggagggtggatcacctgaggtcaggagttcgtgaccaacctggccaacatggcaagatcccatctctactaaaaatacaaaaattcaccaggcatggtggtttatgcctgtaatcccagctactggggaggctgagacacaagaatcgcttgaacccgggaggcagaggctgcagtgagccgagattgtgccactgcgctccagcctggatgacagagcgagactccatctcaaaaaaaataaaaaataaataaaagcaaaacagttatggtgggatgggagtagtgcaggagctggaacgataaacattcagctgttaactgttgtttcctcggaggatgggatctgtggagagggaaggacttcatatgcttccgtaatcatctttaaaggggagacacccataattaggctagctctaagggtgtcttctctaaggatgtggctatgtaaatctctccccacaattccactggcaacaccccttctttgcaagaaggctgcatctttcagttaaaaccaataaaatgtcaaaaaatcagcagaaacaatatcatctttacataattgtcatggcatggggcatgtgcaatttctttttcaggaaacaacacatttttgttcggaagcttttgaaatatcttgaacatgaattagttaatggctgtcagggattaaggaagacaactagtgctcagatgcatgtaaggttgtttgatgtagtgtgggggtatgcagctgggagagctgacagggattttctgaaaattagatctatagggcccagaagtcacttgggcttcaattactagtaataagtttctaagttctataaaatattagtgcttacttatataggaggtacattttcattctcaaacttgaaaaaaaacttttatttttcagaaacagcacaagacatccaaaaggtaagctctatctcatttcttacttggaaatgttcacttcaggcacctttcataggtgtcccttccccatctctgtcatctccagcccgtattccaagtgtcaacagttattttacattttggaaatatggtattttacattttgaattatttacatttgatttaagcaaagactcatccttatcaacttcttccctttccccagcccacatctgagaaccatggtgattatttattcatcctctgccccatatcacacctcagaggctgtaaccttaccttagggtgtaatacctgcccggtgctcacgtgagccacctcacattgtcctttgccaccaccagtgtaagaccaatgcccctgcctcctggatataactccctcctccaagcgcgagccttcattcacaagggcgaggggcccccttctaagaatatggttctgctgctgacgtaagaggtgatggcgtatgatcgaatgagactttgtcatatcaagttttgatttttcttcccctgagaaaagcttaggagagggagaataagaatggtatactgtattggaagatattatatccaactgtattgcctatgaagaataggtattttctcctgacctgagtggtttgtccagtgtggctactgatcagttggcttaattaacaattcttagagaactgatcatggctccttgtttaatgttctgtatctagaagaatatggctgtgaaacctctccctataatctcatttccaccatggcttagcacagaaccaaagcgaccttgttgataaacgttgtatctttccattaaaaccaagaaaatgtctaaaaatcaacgtagtctttttttttttttcttttgagactggatctcgctctgttgcccaggctggagtgcagtggtgcaatctcagttcactgcaacctctgactcccgggttcaagcaattctcctgcctcagcctcccaagtagcctagtagcttggactacaggcacccgccactaggcccagctgatttttgtatttttagtagagacgggggttcaccaagttggcaacgccagtctggaactccagaccacaggtgacccacccgtctcagcctcccaaagtgctgggattacaggcatgaaccaccacacccggctgaacataatcttacctttaagtgattgtcatggctgaggtgtgcgcatttttttttcaggtagtacatgcttttgtttggaaacgtgtgaaacttattaattggttcattgtcctgaaatatggcataaggttttggtttcataagtggggtcactgcagagggctccctgctcttcaaagcagccacagtagcattgtggagccatgccctctcagtgctaaaagaaggaatctccccatcaaagagttctagagattcagtctcaggagctgcttgaaaactttctacagcagtgctcaagccaggtccatatgggcataaccaaaccttatgaaataaaaaggcaagaaagaaaacatccatgctttttttgtgataaaattccatctcctaatagtaatgtgctgaaggtatattaaattcaaggagagcagatttactgatgattaaagagtttgtaacagccaggtgtggtggcacacacctgtaatcctagcactttgggaggccaaggttggcagatcactttgagctcaggaattcaagatcagccttggcaacatggcaaaaccccctctctacaaaaaaaaagtacaaaaatgagctgggtgtggtggcttgtgcctgtggtcccagctacttgggaagctgaggctggagaatcacttcggccgaagttgtaatgagctgagatagtgccactgcactccagcctgggcaacagagtgagattctgtctcataaataaattaacaagtagtttataacaggaactattccttaataatagcttaatatttctcccagaatatatattctgaggctgcgtatatgtgtgtatgaggtggttaagctcatgtataagccgtggattaagacatggattcaaatctgtttctgccatttataaactgtgtgactacaggcaaattgcttaaccttaccaggacttagtttcctaatttacagaactgttaaaaagattaaatgcaacatgttcttaaaagtgcttattaatggaatatttggcacaaagcaagtgttctataaatgatagctaatatcggcctggcatggtggctcacgcctgtaatcccagaactttgggaggctgaggtggttggatcacctgaggtcaggagtttgagaccagcctggccaacatggtgaaaccctgtctctactaaaaatacaaaaaaatcagcagggcgtggtcgtgggcggctgtaatccccagccactcaggaggctgaggcaggagaattgcttgaacccaggaggtggaagttacagtgagctgaaatcgtgccattgcactccagcctgggcaacaagagcaaaaaaggctgggcgcggtggctcacacctgtaatcccggcactttgggaggtcacagcgggcggattgcctaagcttgggagttcacgatcagcctggccaacacagtgaaaccccgtctctactaaaatacaaaaaattagccgggcatagcggcatgcacctgtagtcccagctacttgggaggctgaggcaggagaatcacttgaacccgggaggttgaggttgcagtaagccgagattgtgccactgtactttagcctgggcaacagggtgagactctgtctcaaaaaataaaaacatgatagctaatatcattgttaaatagctcaaatgctgagaatgtggaaggacaggagaaaagttcattcaggctgtggcaaaactgccgtatcgaaattattaggttggtgcaaaagtaattgcactttttaccatgactttcagtattgtgaccaacatatgctgattctttcctatttttttaaacatttatttatttattttgagacagggtcttgctctgtcacccaggctggaatgcagtggcacgatctcagctcactttaggctcaggaatcctcccacctcagcctcccaagtaactggactacagtcatgcgccaccacgcccggctaactcattttttgtagagacaaggtctgactatgttgctcaggctggtcttaaactccttaactcaagtgatcctcccaccttcacctcccaaagtgctgggattacaggtgtgtatcaccgtgtccagcctgattctctctctatctttctttctgtttctttcttccttcctttcctttccctttctttccttcctttccttcctttatttcctttctttcctttctctttcttttcttccttctttctttattaaatttttttgtagagatggggtgtctcaccatgttgcccaggctggtctctagtttctgggctcaagtgatctgcctgccttggcctcccaaagtgctgggattacagacataagccaccgtgcccagatgattacttcttaatttaagagtgtcttcagttttcttaatgattaatttgatgtaaatttacagcttccaaaaaactgctttctttttttttttttttttgagatagagtttcgctcttgttgcccaggctggagtgcagtggcacaatctcggctcactgcaacctccgcctcccgggttcaagcggttctcctgcctcagcctcccaagtagctgggattacaggcatgcatcaccatgcccggctaattttgtatttatagtagagacgggtttcttcatgttggtcaggctggtctcgaactcccgacctcaggtgattcgcccgcctctgccttccaaagtgctgggattacaggcgtgagccactgtgcctggccaaaactgctattttcatttcaagtgtaattaccttaaaaagatacttcagcggcacagctggcttgagcaactgaactggaaacaagatgcaggaccccaacgcagacactgagtggaatgacatcttacgcaaaaagggtttcttacccgccaaggaaagaattggaagaattggaagaggaggcagaagaggagcagcgcatcctccagcagtcagtggtgaaaacatatgaagatatgactttggaagagctggaggatcacgaaggcgagtttaatgaggaggatgaatgtgctattgaaatgtacagacagcagagactggctgagtggaaagcaactaaactgaagaataaatctggaaaagttttggagatctcagggaaggattatgttcaagaagttaccaaagctggcgagggcttgtgggtcatcttgcacctttacaaacaaggaattcccctctgtgccctgataaatcagcacctcagtggacttgccaggaagtttcctgatgtcaaatttatcaaagccatttcaacaacctgcatacccaattatactgataggaatctgcccacgatatttgtttacctggaaggagatatcaaggctcagtttattggtcctctgagtgtttggcggcatgaacctgacaagagatgagttggaatggaaactgtctgaatctggagcaattacgacagacctggaggaaaaccctaagaagccgattgaagacgtgttgctctcctcagtgcggcgctctgtcctcatgaagagggacagcgattccaagggtgactgaggctacagctgctatcccatgccgaactttcttgtgacaaattgtctggattttttaaaaaaggaaaaagcaagaatgaatccttgtggtttttagttttgtataaattatgtttcaaatctttacattttggaaataatcattgctggagattctgttaaatattttggaactcttttttttaaattatagtatttcctctaaaaaaaattaaaaccagccatttgtatggcaaaaaaaaaaaagatacttcaatattaacaattcaggtttcctaattttctaaaacctatgggaattttctgggatggacgatcttaggaaggatcacttttggctgttgtgagaaacacaaaataattttattacactttaaaaatgttttgtcataatttagttaatattaaccttgttttactttataaaaagtagttactgggtgcctatatttttataacattaaaccagtgcagtctgagtaaggtgaagagaaagatatattaaagaatgtgaaaaacatatatatgaacaaatattaggtataaatattgtgtgtgtatgtatgtgtgaaaagaaataaatggctaattgaattgcttaagttttaatagaaaaataacatttaggatgaaattccattattgtctctctactcctctcttccctctctaatagatattccaattaacatctatcccattttcattgacatgtgatgaaaagttcttgcttatttgacatttccaataggttactatagtgttttattagaatatatgtctctggtactaattaggtcttaaccctttcaagcctttgaagttaatcctgtctgcagaatagaatcagagggtaatctgctcctgtctgcaccactgagctccatccagaagggttccaagttataaaagacctcattgttttctttgattagaaatcactaatttggctgggtgcagtggctcaggcctataatcctagcactttgggaggccaaggtgggcggatctcttgaggccaggagtttgtctaagaccagcctggccaacacagcaaaaccctgtctctactaaaaatacaaaaattagccaggcgtggtggcgggcacctataatcccagctactccagaggctgaagcacgagaattgcttgaacccaggaggcagaggttgcagtgagccaagatcatgccaagggacccaggctgcattccagcctgggcgacagagcgagattctgtgtcaaaaaaataaaaattaaaaaattattaatattgttcctattttacttccttataggcaactaaatgttaattaaatgtattttgaaataagtaaaaatgtcattaaatgaacagaggattaaattacactcctacaataaaaactctttgcctagagtctataaaccaaggtaatgctggccatgttcgtggtgggtctgcagatttaagagaaatccttggagtgtgtggtcgggtcagcagaaggggcttttcgtataccagaaaccacgataaaactgctaggagacaagcactggccctaaagctccttagaaagtctcaaatagaacagatagcatggcccttaacttctatacatattaatttatgcaatgaatatttgccaaatgtacaccagacttacttgaagaatctaagaattttctgtatttagcttatatcatgctttggggcaaggggtttggggttagacctgggttctagcagtagtcttactactgactagatagagcaagttactgaacctttaggaacctagatttccttactgtgaaattggtacgatcatacctaatttcataaaatgattgtgaatattaagtttggagaatgtctgcacattgcccagcctagtttctaagtatatattagttcctgtccttccctttttgaaaatatctgaagtgcttttcaagtcagttaaacactcagccaggtgtagtggttcacacctgtagtgccagctacttgggaggctgaggtgggaggattgcttgagcccaggagtttgagattagcctgggtaacacagcaagaccctatctcagaaaaaaataaaagaatattaaagcctagtgggggaggcagtgtgtaaacacaggagaaattcctgagttatgtgtcttctccatggtgctgtgattcagttgatatgtttccatcttcctcaggtttctagagaggaaggatctccccagctgtcttcagcaaggccgtctcctgcccagagaaatagtcagcctagcagttctaccatgatcagcgtgcttcgagcgggtggagctctcagaaacatctggaccgatcaccagatcaggcaagccttgtttcccagccgacggtccccgcaggagaatgaggatgatgaagatgattatcagatgttcgtgccgtcattttcctcctcagatctgaactctaccagactatgtgaagatagcacttctagtcgcccttgcagctggcatatgggacagatggagtccacagagacctccagctctggtcacaggattgtcaggcgggccagcagtgctggggagagcaacacatgccctcctgaaataggaactagtgacagaactagggaactgcagaacagccccaaaacagaagggcaggaggagatgactccctttgggtcatccatagagttgactattgatgacatagaccatgtctatgataacatcagttatgaggacttaaaactaatggttgctaagcgggaagaagctgaatccactccctctaaatcagccagggactccgttcgccccaagagcaccccagagttagccttcacaaagaggcaagctggccacagtaagggctctctttacgcacaaacagatggcaccctctcaggtggagaggcatccagccaaagcacgcatgaactccaagcggttgaggagaacatctatgacaccatagggctcccagatcctccgtcgctgggttttaagtgcagcagcctaaagcgtgcaaagcggagcacctttttgggtctggaggccgacttcgtgtgctgtgacagcctgaggccatttgtttcccaagacagcctccagctcagtgaggacgaagccccttaccatcaggccactcccgatcatggttatctgagtttgctgtatgactctcccagtggtaacttgtctatgcctcataagcctgtatctgataaactgtccgaagaagtagatgaaatctggaatgacctggaaaattacatcaagaaaaatgaagacaaggccagagaccgtctcctggcagcgtttcctgtgagcaaggatgatgtgccagacaggctgcacgcagagagcacccctgagctgagccgggacgtggggcgctctgtgtccacgctgtccctgcctgagagccaggctctcctcacgcccgtgaagagcagggctggcagagccagccgcgccaactgcccctttgaggaagacctgatttctaaagaaggctcctttatgagccttaaccggctttctctggctagtgaaatgcccctcatggacaatccctacgacctggccaacagtggcctgtctcaaacagacccagaaaaccctgacctggggatggaggccacagataagacaaaaagcagggtgtttatgatggctcggcagtacagtcagaagattaagaaggcgaatcaacttttaaaagtgaaaagtctggagctggagcagccgccggccagtcagcatcagaaatccatgcacaaagacctggctgccatcttggaagagaagaagcaaggagggcccgccattggtatgtgcaccctgcccttcttccttctccaaagtaagaggggagagcggttttcagatttcagatgtccttaaaacggacacacctgtgagaacactgacactcaagctttgtcatctcaaagtaagaccacagacaaagccatactggcctttctcacatcgcctcctgtgaattatccacattgtagcatgatttggcctcagagggtggtggtgtgcatgtaacatcgtaactgcagagataatattttaagaaagagttttctctaaggtgatctgaagtatgaaaaacgcaatcagttttaacctgtgctatctccaacttttccagtatatcagtaattttttaggaggaggaggagtgtgtatgatcttctgaggtttggaagcatatagaataacattgtttctggcttcaggatctcaacaaaaatgccaactcgtgctaacaaaaagaggggtttttttgcatacttttttttttttttttttgagacaggatctcactgtcacccaggctggagtacagtgacacaatcacagctcactgcagcctcagcctccccaggctcaagcagtcctcccacctcagcctcctgaggtgggaccagaggcactaaccaccatgcccagctactttttacattttttgtagagaaggggtttcaccatgttgcccaggctggtctcgactcctgggctcaagcaatcctcttgcctcagcctcccaaagggctgggattacaggtgtgagccaccacgccagccattgtactttccttagttgctcgcactataaatcaatggttttctcacatatctccattactactcaatttttttttttttttttgagatagggtctggctctgtcacccaggcaggagtgcagtagcatgaacatggcttactgcagcctctgcctcctgggctcaggtgatcctcccacctcagcctctctagtagctgggactacaggtgtgtaccaccacgccccgctaatttttttgtgtgtgtggtttttttgtagagatgggattttaccgtgttgcccaggctgctctcaaactcctgggctcaagtgactctcccaccttggcctcccaaagtgctaggattacaggcgtgagccgccacacctggcctactgctcaattttttaaaatagctgctgtaatgcattcaacactatctcatttagtattttcatatatgcttctgagtttaatgctttagttagactcctttgtggagcacaaccaaaccagaatcttaggtgtgatattgtaggatcaggactatgggaatgagatgctcatggttagactttttttgaaggccaaaatttaacactgatctctggggaagagcctagctgtgaataaagcccctgattgtcatagaaagaaaagtccaaaggtagtggctcttgcctgaggagcttttacctccaggcacagagagatttctggctataggctcaggaatatgcctttcaaatagtatgcccttttcatcatattttaagaaatcctgccccagattttctaaccaaggaccaccttagtatcaaatgagaggagtctattctacaattaaaagtgaaagctgggtgatggcttagtatcaggacaggctctgatcattagcttcattatcagcacattgggacaggttgatgccactaactattaaatgctgtctttgggattgacattgacatccatggaaactgaagaataggaagggcatatccaaatcttaaatgaatgcacaagttacataacaagaatctgtagggaacttttttttttaagtttgagagtatttaagaattgtctaaagttttaatcttcagtacaatttcttaacagatagggaaacaaagtgctggaattgatgcctgaaggatttcacagactctgagttcttctttttaatcaaatgaaggttttgtatgcatgtgagactagaatgcatgtatttttctccttgccatgatgcactatgagtaattcaagtccctattctgatgctagcgttgctaagctggtttgctgttacagggaaagtgactgagttcccgctgcaggaggacaattttggtggggtaggggaatatatatggccttagaaacagttgtatattggcaattgcaagcactgactaagtctgggttggggctcctcagcataagaggaaatgtaatgctgaagtttttgatgatgatgggttatgcccacagactaccactgaaaaagtagtaattccctgggccaggttgttttgaatatggaccatctgttaaaatacaaagctccaatcttgacagaagcatgtcctttgatactgaatcattagggcctacgactacctcgagtagtcttcttttttacccacctttttaagtattaaatgatttcacattggggttttcttttcacttttggttggctctcctttttgttttgcctgctggtgttgtcttgggatgccccaggatcttttctcagctttgcgtctgggtcctttcttgacatggtgggctcctgtcgacgttctccccagcaaggaggaggaaatctctcccgagtcatcttctgagagtgctgtcttccctgccatctggcagaggcacgtccctaggacctgatgagttatatccacacctcgtccagctgggtgatcgagaccacttcctgtgcccactaggctttccgtcagttgacatgatgactccttttctctttcttgtttatctgggcacaggacgtcgtaatcgaatggaccgattctccagacttctccgtgtgggccttgccgctttgccaggagcttgctctcggtgctgtgcggaaggaggagcaccttattcacctgccgaaactctcgagcatctttattgaactctctagccggggtctccaggccctgggtcagatttctgcctataaatcacccaaccaggtccagttgctcccatatcttagagcctgtcatagcatgctggccatcttgttccatcagaccttcctcctgatagtctttgagagcaaggaggcctttgggtttctgggttttttggtgatgtttcacatgggagaaaactccatacaggcttgagaaattttcctccttgtgtagagtagggaaggcacaattttatgcttttgtctgcatctcgagcaacatcagaaacatttattttaatcctctgtctggaggattaaaatgttgtttgatatttcccttggcaaacattattctaaatttttgtctgagatcataagaactccaattttcaaatctcaaaaaaggcaataaaccagagacattcttgcgattgtcatgtagtcataatgtatatattctatacaactgttaatactagaactaaggatatgggggagcctcaactcagctgactaatactaagctttttaggccagaggtgtcatctcaggctggctgttccctgtacatctggctaatagaatctgtttaattacagctggagctctggaagcttgtctcttgttcacatagatgtcacacaagctatagactctcttagaaggtcaagctgaaacaaaaagccccttagatcagcaggtgcagtgactcacacctgtatggccaggcacagtgactcacacctctattgcctactagtgagataccttttattcaaaattgataaatggtcaactctatcatccaaagataaactgttcccattatgagttatctataggaagcattttagctgtcttcttgcttctgctttttctgcttatgacctgatttccaggccacctttccactcccagtggtatggtctcaggaaagtgcatccctttttaaaagtaggcttaaaatgaaaggagtctgggtgcagtggctcacatctataatcccagcactttgggaggctgaggcgggcagatcacttgaggtcaggagttcaagaccagcctggtcaacatggtgaaatctcgtctctactaaaaatacaaagaattagccaagcgtggtggcgggcacctgtaatcccagctactctggaggctgaggcagcagaatcgcttgaacctgggaagtggaagttgcagagagccgagattgcgccactgcattccagcctgggcaacagagtgagactccatctcaaaaagattaaaaaataagtaaaataaagaagggagtgaaaaaaattctgagtaatgaattagttattgagaccactttctgtctaaaccatgctaggtcctctatagggagttgaacaaaatgtacagcattgttctcccagaccaaaagctcagaggccaggcgaggtggctcacacgtgtaatcctagcactttgagaggccaaagcaggaagattgcttgagctcaggagtttgtgaccagcctgggcaacatagcaagactttctctctacaaaaaatttaaaagttaaaaatttccaggcacagtggctcatgcctatagtcccaggtactcaggaggctgaggcaagaggattatttgagcccaggagtctgaggctgcagtgagttatgattgtaccattccactctagcctggccaacagaataagaccctgtctcaaaaaaaaaaaaaagaaaagaaaagctcagggactaataaagtaacttacataaaatggccaggtgcagtgactcacacctgtaatcccagcacttagggaggctaaggctggtggatcacttgagatcaggagttcgagaccagcttggctaacatggcaaaaccctgtctctactataaatacaaaaattagccaggcgtggtggtgggtgcctgtagtcccagctactaggaaggctgaggcaggagaatcacttgaacccaggaggtagatgttgcagtgagccaagatcctgccactgcactccagcctgggcaacagagtgagactttgtctcaaaaaaacataaaatgaaaataaagtaacctacataaaataattagcaacacagcaatacaaattgtgtgtgtctgcatgtgtgtgtgtgtgcacacacaggcaacagctaggtacacactatgtaagacttcagagaagagaaatcagaaaaggattcaagtaaggagaagatagggcttatggagaatcttgagagatgagtaggatttgattaagcaaaggacaaggagtgtataataagacaaaggcatgggaaatactgtggatattttggatgatatgtgatttcagattatctgggctaaagtcaagatctgattgttcttacaagacttaatggttaaattttgatactggaatagtttgtttgaatttttaaagttctactacattttccaaaattgtcatcttcttggaaccttgtagaagttcagagccttcctgatacagctgtgggatcaggctcagggctatactgtatgtgagaatggcttgagcagaccatctgcctttcaggcaggtctgctaactaatgactatattaaaggtccagctgattttgattgggtttcatagttaatgaaatattatagtttcaggatggctaccatgggcacactggtgtctgtggagacttttacactctttctcttaagatgttgctaaaccctaattagtattaagagtctttactgcgccttttatggaatcatttctcaagtttttgtaactagaaatttcaacactaataatctctgttcttccaaggaatttggagttgaaaactcaaaggatctgagtataggtctgtaatgagaagttagactatttaccttgatcacagggaatagggggtgagggattggggttgcaattaaaggtcacacaataacaggttgtttctctctcctcatagaagatagactcaaaagaaatgacaaaactcacctaaatgagtatttattagtagtttaagttcaagaaataatttactgataacacatcattaaaaatgtaaatagcttaaagaagaagaagaaaacagtgttacctgctggttgtcatatataggatacatttccttcataaagattgtgtcaatatggtctgagcaagttataggatgcgttagaggaaccttgtccaacctatggcccacagctgcatgcagcccataacagctttgaatgtggcccaacacaaatctgtaaactttcttaaaacattaagggttttttttattttgagatttttaaaaagctcatcagctatcactactgttagtgtattttatgtgtgtcccaagacaattattcttcctccaatgtcttctggggaagccaaaagattggacacccctgcattagagttttttgattctagggtggttgtgcagatacctggattggggagggtggcagatcttgaaattgtcatctctgggctcccatcttaaatttttgctagccgaagagaatcccctacccatagcatggttaatgtattaatatttagaaatatctgtactcagaatcagggcaaaggggagaatggacttgtggcttaattttaagcggcaaaagcttttgtggaagtaactgttaggtcctattcttgaaccagtagtagagagcattagattattgagtacatgcacagacggttccttcttaatgtcttggcggcctaggctttagtgctctgcttcttggggatgtgaaatgagatgtgagttagtcaatacatgtggttttgaagcacttgaggggagaactttacttagtagacattggttccccagacaatggcagtggagggctgcctggaagcaagaagcgcagcaacagccaggagctgactcctctaggagcagctgtctgagacaaaaaaagaatgatgggaagccaggggtagccattgcattgtggattgtggccatgctgctttttttgtttgtttgtttttgttttagatggagtctcactctgtcacccaggctagagtgcagtggcatgatcttggctcactgcagcctccgcctcccaggttcaagcaattctcctgcctcagcctcccaagtagctgggactacaggtgcacgccaccatgcctggctaaatttttgtaattttagtagagatggggtttcaccatgttggccaggctggtcttgaactcctgacctcaagtgatccacctggtttggcctccgaaagtgctagaattacaggcgtgagctattacgcccagccctgcgatgctgcttttaaagactgcttgaatgatttttcattgaccaggctgaagtgctgactttcttacttttatgatgcatgttttcagcactgacactgttttatgcttataaagaacactagaaactttcattatatatagtggacacttgcagacctgctgttgaaacaaaataatggacaattagatgaaattaaatgaacttttaggtggcatttttatttatattaaaccatggatttgtgtgtgtgtgttgctcagagttcaaagattactcatccttagacatcagttagtcttgtctactgtcaaaattttaaaatacgttggttagaatgttattctcttatttttaatcttcacgtataggaattatcctgtgtgtatttactgtttcaatatttgccttccaggtgccaggattgctgagtattcccagttgtatgaccagattgtattcagagagtctcccttgaaaattcagaaggatggctgggccagccctcaagaatcctccctcctgaggtctgtgtcaccttcccaggtccaccatggtagtggagactggcttctgcattcaacctatagtaatggagagttagcagatttctgtctcccaccagagcaagacttgaggtcaagatatcccacgtttgagatcaatacaaaaagtactcccaggcaattgtccgcagcttgctctgtgccttctcttcaaacctctgaccctctgccaggctctgtgcagagatgcagcgtggtagtaagtcagcccaacaaagagaactggtgtcaggaccatctttacaactccttgggtcggaaagggatcagcgctaaatctcagccttatcacaggtcccagtcatcttcctccgtcttgatcaacaaatcaatggattccatcaactaccctagtgatgtgggaaagcagcagctgctgtctttacacagaagttcaaggtgtgagagtcaccaggacttgctgccagatattgctgactcgcatcaacagggcactgaaaaactctcagatctcacactccaagactcacagaaagttgtggtggtcaatagaaatttacccttaaatgcccaaattgcaacacagaattatttttccaatttcaaagagactgatggagatgaagatgactatgtggaaatcaagtcagaagaagatgagtcggagttggagctatctcacaatcgtagaaggaaatctgactcaaagtttgtggatgctgacttttctgataatgtctgcagcggcaacacattgcattctttgaatagtccgcgcactccaaaaaagccggttaacagcaaacttggcctttcaccatatctgacaccatataatgattctgacaaactgaatgactatctttggagggggccatctcccaatcaacaaaatattgtccagtctctaagggaaaaatttcagtgtctcagttcaagcagctttgcttaaggttcttcataataactgcttgaatcaacttcttattttgctcataaaacgttacagatactgatgaggtgttttatgtataccagattaaaacaattttgtaagaaccagaggtgtaaaatatactttcttttacagcacaacttttggaaatggctgacgatgcagcccggattgtactgtagcacatgttggcatcaacagtatattttctcatgctgagtgtcttcatgtttcatgtaagtcaatcttacttgaaagtttttagacttttaacacgatggccataacctgacaatagtgcccacaccttaagaaatgcaataatcctttcctgttatccagaaggcccaggtagttttatcctgtgactcaaaggcagcaaggagactttttcacattttaaaaggcaacgaaagctgttgaaagaattatgcttatatctcacattttggttatatttgtggtaacaccttaggataacgtaagccagagatctgtaaattggactgcagtctgaggtgcccattttagggtttttgtgctagtattcttttatgtcattttgatgcagaaattgtgtgactgttgaaaattaaaatgtagcgggacccattttctgtacgcagaaccctttacctgtattcctggacaaggcctagagaacgagctgctcatcatgtttctaatataatttctggggtgaaatgaatgatttccttactggcttagagaaaaccaaggtcaataaaatgcagattgacttaactattagaaaagatgggatgacttctgggaaccacttaactcttcaaatgactgttgaaagagaaaaagcaaaactgaaatcccaccagaccattttgtgtgcctgtttctaatcgatacaaagttaagcatgagctaaaatcagacaaagcactttaaatttatcctttccagagcgctttgcacatgcaccctcctgagtttgggattctgccaaatgaccaacttgatcctggccctgaggagtcattggctgcaggaatagggcaagaatctatttcctaaactacacataacatgggagcctttttttcgttgttttcaggtatattaaagaatgaaatctttggttactaggtgctgactaataaataacaccttttatattctgaccatttgtcacatttcattgtgatactgtatactgatctaactccttatgaaaggcaacaaacaaaaataagacattgaataaaaagcaaaatcaaagaagctaaagagaaaaatgaaggcagatatattgcaactttataacatattctattttattgaagactgcaattaatgcagcaagaatgctttctcaagcggtggcctttgtattctcattttaatcaggtgtacattctatggcctctcccccatgctgttagtttctattttaaaagatacaataatatatgtagggaaaggggcctgggctcttcatttaaaggtaagcagtaatattgagtaagtgacataattctttttctctttgttaagtcctatgcctctttttcttaactgtaaaacatagaatatgagcgtttttatcttacaaataggtacctaaggcatgtgattttatttttaaataacaaaaaataacccaagtttcttgcttctccaaagtattcttctcatagcttataaaagaaagtccacattgaatagcatggtctgggaacattccttctttattgtgtttatttgaacatgatatgagtttccaagatgaaatgatcaaaaaagataagtaccacaagaaagtttttttgtttggttggtttttttgtttgtttgtttttttcttgagactgagtctctccctgttgcccaagttggagtgcaatcttggctcactgcagcctccacctccccggttccagcgattctcctgcctcagcctcttgaatagctgggattacaggcgcccgccaccacacctggctaatttttgtgttgttagtagaggcggggtttcatcatgttggccaggctggtctcgaactcctgatctcatgatccgtctgcctcggcctcccagagtgctgggattacaggcatgagccactgcgcccggccaagaaagtatgtttttagaggtgtgtgtaagtgcatttgtattacctatgaacaaaattacctgactcttgtcccaggaaagctgtttcgcattttcgctttttgattggtattatccagttctatgtagttcatattattgttctgtctgactctcagaaattacttcttcacgccagtgtcttgttgcatgactttgatgtcacctataggaatacacctcactgcacgtaagtgggtatcttactgtataaaaggtctacatggctttaggttttaggacaaatgtgtagatttatagaccatttctgttggccaggacacagattttgagagctgtgtgtatatatatataatcatgtttgtatttttttcctgaaagttatcaattgcttttgtttaaaacagtttgttttagaggtggggtggggatgtatataacgaggaaaagttatatgtactttaaagtatgtcaagttcttactagtttcctgtactgaaggttcaattttttttatataagtttacttttcacctgctctattctttgtggggaaaaaatgcatctagaaaaacatagtttaaatactgtatataagataatgaaagttagtaacgtccattatttaataaagtttgtaaagtacaaggtaatttatagtgtgaattaatgtgtttattttagaacatcaagatgtttccaaactacatttagctataatactttttcttgccttgtgaaccatggagaaaatggtgcagggtcacaatgatataactatgtctcagcggcccatgatagaccattttctacatctttggattacctttgaaacagtgaatttggtgtctaggatttttgttgtcttgagcgaaagctaaattagatcagttgctaaattaccttttgaaaaaatttgcagtaagtaacagaagacattcttttaacttttattattgaatcaaaaaattaatatagccgggcatggtggttcacacctgtaatcctagcactttgggaggccaaggtgagtggatcacttgaggccaggagtttgagaccagcctggccaacatggtgaaaccctgtctccactaaaaatggatggtggtgcatgcctgtaatcccagctactcaggtggctgaggcacgagaatcacttgaactagggaggcagaggttgcagtgagctgagatcacgtcattgcgctctggcctgggcaacacagactctgtctcaaaaaaaaaagaaaattactatagaagtttttggtacaaattgagggttttttcatgtaacttcatgttcttaattttctttaatagaaagtttacagggaacaaaaatatgctgctattagttgataattacagacactttccaaagcaactctttccaaatgtaagcaaaaagccctaccccattataatgaaaatgtggattacctgactttcctcagactgaagaaacagccttcggcttttagtgtattttagagagaagagttttccaacttcacactgaggagccctcagatctgccttatcttcctgttccaccttgaggtggaaaatggatgggttcgctccaagttcagtttagagaaacaaataacaggagaataaccatgccccgtgtaaatggtaaacataaattcagtccttaaagaaaaattttaatgagcaggcttataatgagctataaatacagctgttgaacatgaatacttaataagatttgtctattaaggttttttttagtaaaaacaataaaaaatctctatttgaaagagcaaatgttaatacttcaagaactctgagatcctctaatgctgtataactttctctatctggattgtgataactacactcaattctttttttttttttttttttgagacagggtctcactctatcggcccagactggagtgcagtggcatgatctcagctcactgcaacctctgtctcctggggttcaagcgattctcctacctcagcctcccaagtagctgggattacaggtgcatgccaccatgcccagctaatttttgtactattagtagagacagggtttcaccatgttggccaggctggtctcgaactcctgaccccaggtgatcctcccgcctcggcctcccaaagtgctgggattagaggcataagccacgtgcctggccttgttggtgttttttttaaagagacatggactcaccaaggctggtcttgagttcctggcctcaagtgatcctcctgccttggcttcccaaactgcagggattacaggcatgagctatcatacctaccctttttttcaatgttttctgtttaacaaaatcatatatatatgcgcttatatatatttatatagagagatactgtggaaattttgctgtattaaaaaggttaatgcaaaatatgattgcacaacctatataactgtaaattaataaaatttggaatgtctggtgtatagcatatttgaaagctctttaacagaagatcaaaaattcctttttgaaagaatattctaggccaggcatggtggctcacgcctgtaatcccaacactttgggaggcgaggcgggtggataacctgaggtcaggagttcgagaccagcctggccaacatggtgaaaccctgtttctactaacaatacaaaaattagctgggcatggtggtgggcgcctgtaatcccagctacttgggaggctgaggcaggagaatcgcttgaacccaggagggggaggttgcagtgagccgaaatcttgccattgcactccagcctgggtgacaagagcaagactccatcttaaaaaaaaagaaaaatatattctaaaatttagcatgtgcaaccattgtctgaccagttgaggtagaaatggctttaccagcccctcacagtgctgggcaacttgtagtgttccatacattttaatcattgaatagagttaaaaattcgtctgagctcaaagcatgtgaaaaatattcaaaccagatacacaaaggagggaagtcacaacaacagcaaataagttgctttaaaaagattcacagcacactcagaaatctggtggtatcaactttctctagagctcttattaggtaagtcatgggaggtggcattttggaaagactctctgcgcctttcccatctcatggctgatagaattccagagacatttactctgcagacttccagtaaccttttaggctaagcatctacatgggcacaggaaggtgtgattatcagaccctcctcaaaattccatgtagaccactgcctgtcctgataactgcttttgatcatattggatttctgagggcgctgtgaatttttttaaagcaacttacttgctgctgttgttacttcccgccttttgatgtgatgagatcatagagcaccctagcatgtagatgtggggttgaagtcaaataaggtggaaggaaaaggcccagaatgcctcgatttggggtgccaaaaaacacacttgcccactttacaattttggtacacatctgtggatcaaagtccaccttatgtatctgtgaaaaacaagagtcttattttcctgacaatggcttattcacatgcatcgtacaataggaaagaaagacaagcaggcagttccacctcattggttccaaaaccatgtttatcaagctcaatataaaacaacagggcttggatggtgatcaaatcatctgttctaacgggcaaatataagcccccaatttgccctcctgtttacatagcaatgtatgcctctccacatagttctcatggaaccatcaagaccacagggtaagcagattcctgctactaaaccacagttaagtcagaggctgcaaactgctggcccaggggctcaatctggcttgtgcaattttatttatttatttatctatttggagacagtctcgcactgttgcccaggctagagtgcagtggcgtgatatcagctcactgcaacctccacgttccgggcttgagcaattctcttgcctcagcctcccaagtagctgggactacaggcacgtgccatcacacctggctaatttttgtatttttagtagagacagggtttcaccatgttgcccaggctggtctcaaactcctgggctcaagtgatccacccacctcagcctcccaaagtgctgggattacaggcgtgagccaccacacccggccctcggcttttacaattttagaaaggcttaagcataaaatccaaatttccacctcttaaaaaaaaaaaaaaaaaaaaaaaaaaaagatgtggtctgtgtggacctggattctggtgaggccaatgctatgagatctaaggaggggatctaaaggtgaaagtcaccctaaaaggtggacacttgctttgacctttgggggaaatggttcctttatccttcattatggacttcgtcaacaaatttaaagcaaccgtggtacacttgaaatacagatgctttaggtagaaaataagaaatctctccttttaagataaaataaacatacgtcacaaagatctctagaacgtatagctgctttgggggaagttttatacctggtccacttccctagttaatactgtattatctacccatcctctagaagcctccagaggcttcaggtctgtgataccaaatcatctccactccattctcctttaatatgaattcacctgaattcactactatatatactctgtttcccaaaacaccatctctagggtcaaactcccctcttcagtgcaagatttttcctgcaggacatctctgagttgtccagagccaatgtcatttttccccatgtacgactcctttcttcctcagaagctcctcctctagtttgcagtctttttgttggactactataacagcgtcctaactagttgtcctgccactgtcttccccacttcctgtcttttattctgtgttttaaacacagaataaaatcctccagggccgagtgcggtggttcacacctgtaattccagcactttaggggacagaggcaggcagatcacttaaggtcaggagttcgagaccagcctggccaaagtggtgaaaacccatctctactaaaaatacaaaaattagccaggtttagtgggcaagccggtaatcccagctactcgggacgctgaggcagaagaatctcttgaacccaggaggcggaggttgcagtgagccaagatcatgccagtgcactccagcttgggcaacaaagcgagactccatctcaaagaaaaaaaaaatcctccacaaagccccccataatctgtctctgcctttatatgaggaagagctgctccctctgcctgcaatacccttcccctactatccaaagggaaacccgctaagtcctcaaaacccagctcagaaacgattgccaagaactgtgagattttacccagcttgcaagctaacaaggtaacctgcctcagtttcatcaatactggcagaagacacaagactcctgggtaagagaggaaggacatgattacagcacagccggtagcatgagctttacatttccattgcttcccctcaccccgctagtctcagagcagcccagggggttgttgtacacacagtggttcattccacagcagaggagccctgggctcagaaatccccaaacttaaaagaagctactagcaaatctgcccaacctttgcccctggagggagacattatctttattctgtggaggcaaacaaatctgccttctgccctaaggggagatactatttctatcttccaaggctgtatgctctaaaaatgtccttgaattgatagtctggggtaagagaataatacaagacatgaagaaatacaaaatcatgagacccctaaagaatggtctcaaaaccatgctaattttgtgacatacaagttttttttaatttttatccagtatgattaaggatggagaaagactgttaatcccaaatgaatcagaatacacattggtatagaatattataaatgaatttagcaatatgaatcagtaacattaaaaattcatcctctttgagccattaattagacttccggaaatttattctaagagaataaattcaacggcagttaaagatttatgtatcaaattgagaggtgaatctggctagtcttctgggtcgggtggggacttggagaacttttctgtctagctaaaggattgtaaatgcactaatcagtgctctgtgtctagctaaaggtttgtaaacgcaccaatcagcactctgtaaaatggaccaatcagcaggatgtggtggggccaaataagggaataaaatcaggccacctgagccagcagcggcaacccgcttgggtccccttccatgctgtggaagctttgttctttcactcttcacaataaatcttgctgctgctcactctttgggtccgcactgcctttatgagctgtaacactcaccacgaaggtctgcagcttcactcctgaagccagcgagaccacaaacccaccgggaggaacgaacaactccggatgcgccgcctttatgaactgtaacactcactgcgaaggtctgcagcttcactcctgaagccagcgagaccacgaacccaccgggaggaacgaacaactccggatgcgccgcctttatgaactgtaacactcactgcgaaggtctgcagcttcactcctgaagtcagcaagaccacgaacccaccgggaggaagaaactctggacacatctgaacatctgaaggaacaaactctggacacaccatctttaagaactttaacactcaccgcaagggtccacggcttcattcttgaagtcagcgagaccaagaacccaccggaaggaatcaattctggacacattttggtgaccacgaagggaccattgactattgccaagcagtgagtaccatcggaccccttttgcttgctattctgtcctatttttccttagcatttgagggctaaatatcaggcacctgtcggccagttaaaagcaactagcatggccaccagactaaagacatggatgtcaggatttctgggaaagggctctctaacaagcccccactctttggagttgggagcattggtttgccacttttcctgtacttccgggctgagctgagggttgacagagaggaaagccattcagctccgaggtcctgagaacaagttggttgaccctgcagccatgagcggaactctcaaagtcatgttgcccaagccagactctctcatctattctatctaccttgacccttgcctcctgggtcctaatgcctgccagacaaactccctctcacctctcttctccgaggctagtcccgcttctaaaaaccactccctgtctctggtgcttttctagtttctcctataagaatgatttctagttcaaactccaggactctgttaccttctttcggcacctgggctcaccaatcagaaaaacataatttttcccaaagccccatcgtaggggatactatctggaattttaggatacctcctcagacaagtgggcctaacaaaagctattcctgaagctaggatatggggagcctcagaaattgtatccttcctattcatataagtgaggacaaaaggcatcactcttccaactctagagatcacttccctccctcagagcaaaaaatgcctgcgcagtccaaatcaggctaaaagaccccatcacttttccttatcaaaggcaatatcccttaaggcctgaagctcataaaggattacaggatattgttaaacatttaaaagctcaaggcttaggaaatgcagcagtccctgcaacaccccaattctaggagtacaaaaaccaaacggtcagtggagactagtgcaagatcttagactcatcaatgaggcagtaattcatctatatccagttgtacccaaaccctataccctgctctctcaaataccagaggaagcagaatggttcactgttctggacctcaaggatgccttctgtattcccctgcactctgactcccagtttctctttgcctttgaggatcccacagaccacatgtcccaacttacgtggacggtcttgccccaaggttttagggatagccctcatctgtttggtcaggcactggcccaagatctaggccatgtctcaagtccaggcactctgttccttcagtatctggatgatttacttttggctaccagttcagaagcctcgtgccagcaggccactgtagatctcttgaactttctagctaatcaagggtacaaggtgtctaggtcaaaggcccagctttgcctacaacaggtcaaatatctaggcctaatcttagccagagggaccagggacctcagcaaggaacgaatacagcccatactggctcatcctcaccctaagacattaaaacagttgtgggggttccttagaattactggcttttgccaactatggatccccggatacagtgagatagtcaggcccctatatactctaatcaaggagacccagagggcaaatactcatctagtagaatgggaaccagggggagaaacagccttcaaaaccttaaaaggccctagtacaagctccagctttaagccttcccacaggacaaaacttctctttatatgtcacagagagagcagggatagctcttggagtccttattcagactcgtgggacaaccccacaaccagtggcatacctacgtaaggaaactgatgtagtagcaaaaggctggcctcactgtttaagggtagttgcagcggtggctgtcttagtgtcagaggctatcaaaataatacaaggaaaggatctcactgtctggactactcatgatgtaaatggcatactaggtgccaaaggaagtttatggttatcagacaaccgcctacttagataccaggcactactctttgagggaccggtgcttcaaatacgtacgtgcatggccctgaaccctgccacttttctcccagaggatggggaaccaatcatgcatgactgccgacaaattatagtccaacttatgctgcccaagatggtctcttagaggtccccttagctaatcctgaccttaacctatatacccatggaagttcatttgtggagaacgggatacgaagggcaggttatgccatagttagtgatgtagctgtacttgaaagtaagcctcttccctcagggaccagcgcccatttagcagaactagtggcacttacccgagccttagaactgggaaagggaaaaagaataaatgtgtatacagatagcaagtatgcttatctaatcctacatgcccatgctgcaatatgggaagaaagggagcttctaacctctgggggacccgcattaaataccacatggaaattatggagttattgcacacagtgcaaaaacccaaggaggtggcagtcttacactgccaaagccatcagaaaggtgaaggagaaaaggcagaaggaaaccactgggcagatactgaggccaaaattgctgccaggtggaatctcccattagaaatacctatggaaggacccttggtatggaacaaccccctccaggagattaagccccagtattccccgattgaaacagaatggggactttcacggggacatagttttctcccctcagggtggttaacgacagaagaaggaaaggtacttattcccaaagcaagccagtggaaaatacttaaaactctccaccaaactgttcatatgggtattgaaaacactcatcaaatggccaaatccctatttacagggccaaatctcctccagaccatgtgacaggtagtcaaagcctgtgaggtatgccaaaggaataatctcttggtccatcataaggcccctgtgggggcacaaagaataggtcactatcccggagaggactgacagttagacttcacccatatgcctaagtcaaagggatttcaatacttgttggtctgtgttgatatctttacaaattggatagaagctttcccccgcaagacagagaaggctcaggaagtgattaaagttctaattcatgaaataattcctagatttgggcttccccaaagcttacagagtgacaatggtctgacttttaaagacatgataactcagggagtttccagggcactagtgatacaacagcatcttcactgcacctggaggccacaatcctcagggaaggtcaagaaggcaaatgaaacactcaagaggcacttaaggaaactaatacaagaaactcatctcccatggcctactcttttgcccatggccttgttgagaatccaaaattctcctcacaaaatggggcttaatccacatgaaatgctgtagggacgaccttttctcacaaatgacctcctacttgatcaggaaatggccaacttggtcaaagatacaacttatttggcaaaatatcaacaaaaccttaaaaacctacctgaaggatgtcacagagaaaagggaacagagttgtttcaactaggagatctagtgttggtcaaatctcacccctctacctccccatctatgaactctttgtgggaaggaccatactcggtaatcctctctaaccccactgcagttaaggtggcaggagtggaatcttggattcaccacacccgagttacattttggacatcccctgaggaacctgcaggactgtcagctcaggagtctcaagccagaccagcctcgatacacctgcgaaccattggaggacttgcatctcctatttcggaaggaaacatcccagactaaaaaggctcctaccgctgatcctgaagaaaaatccctttctccttaaaaaagataagtgaaaacctacataatctttaacacctctccttgcccctttaatggaatccttttactatttcatcatattattaagcagcatactaaccatactctttgcgataggactgtatactgtagctcctgctgggagaaaaatcctaatcacatcaaccttctatcttccttccttctgacagcaatttactcctgcctttaactcagactggataaaatggtctcgtcttccagagcaccctctttaccttcctatttactctttgcctatctatccctcctgcttccttggatacctcatacaattgcccctccccttccactagctcctaattacctctacaagtctctcaacttaacctactctctgttaaaccagtccaatccttccctggcaaatgactgttggctttgtatctctctatcaacctctgcttacactgccactcccattcctgcaaaaaactgggtctttaccaaattaacctaccaccctcgttatgaaggaaaagaccctttctgacttttaaatatgcaatcattagccaacttccccatctctgataggaacaagaataccctaacaggatgtgcaatccaacttttacgttcttacatttccaacctcacctattacacaagcaatgaaaagcccatacacggccctgtaactacaaatactatcttaactttccaagcccctttatgcatccaacgcaacctgttatcaggcctgcccctggggcacttactaccccatcagtgtaattacacgctacaacttcaagccccaactgatcatagtaacttctgagtcacccaaacagctccatttagatggcttgtctgcttcttggggcccccaaaaatcatcacctcctccctgcttaacaaatagtccagggtttgtaatggcaaacatactccctgcatgaccattcacccctgcaccccctgcagcagcgcccccaccactagtgaatgccttctcatcccctctttcaatcactctctcgagtggttcctagtagatataaaatgtttttttctccaatgggaaaatagaacacagggagccactcagtttgctcccaacacccctttccagccgctcactggagctaccttggcaagtactctaggagtatgggaaaatgaaaacaacaaattcacacatctttttaacatacacaaccagttctgtctacccagctaaggtatactcttcttatgtggaatgtcgacctatatctgcctccccactaactggacaggcacctgcaccttagtctttctaagtcccaacattaatattgccccgggaagtcagaccttatcagtacccctcaaagctcaagtccgtcagcgcaaagccatacaactaatacccctacttatagggtcaggaatggctactgctacaggaactggaatagccagtttatctacttcattatcctactaccacacattctcaaaggatttctcagacagtttgcaagaaatcacgaaatctatccttactctacaatcccaaatagactctttggcagcagtgactctccaaaagcgctgaggcctagacctcctcacggctgagaaaggaggagtctgcaccttcttaggggaagagtgttgtttttaccctaaccagtcagggatagtactaaatgccgcccggcatttacaggaaaaggcttctgaaatcagacaacgcctttcaaactcttataccaacctccggagttgggcaacatggcttctcccctttctaggtcccgtggcagccatcttgctgttactcgcctttgggccctgtatttttaaccttcttgtcaaatttgtttcctctaaaatcaaggcaatcaagctacagatggtcttacaaatggaactccgaatgagttcaactaacaacttctactgaggacccctggaccgacccgctggcccttccactggcctaaagagtttccctctggaggacaccacaactgcagggcccctgcttcacccctatccagcaggaagtagctagagcagtcattggccaaattccaaacagcagttggggtgtcctgtttagaggggaaattgagaggtgaagccagctgggcttctgggttgggtggggacttggagaacttttctgtctagctaaaggattgtaaatgcaccagtcagtgctctgtgtctagctaaaggtttgtaaatgcaccaatcagcactctataaaaatggaccaatcagcactctgtaaaatggaccaatcagctctctgcaaaatggatcactcagtaggatgcaggtggggccaaataagggaataaaagcaggccacctgcaccaccagcagcaacccacttgggtcccctccacacagtggaagctttgttcttttgctcttcacaataaatcttgctgctgctcactctttgggtccgcactgcctttatcagctgtaacactcaccacgaaggtctgcagcttcactcgtgaagccaatgagaccacaaactcaccgggaggaatgaacaactctggatgcgctgcctttatgaggtgtaacactcaccacgaagatctgcagcttcactcctgaagccagcgagaccatgaacccaccgggaggaatgaacaactccggacgcgccgcctttatgaactgtaacactcactgcgaaggtctgtggcttcactcctgaaatcagcgagaccacgaacccaccagaaggaagaaattctggacacatctgaacatctgaaggaacaaactccggacacaccatctttaagaactttaacactcaccgcgagggtccacagcttcattcttgaagtcagtgagaccaagaacccactggaaggaaccaattccggatacaaaatgtctccatgcatgcctcacctgcagtgccatacgctggttgatattaataataagacagattttgcagagcattgttggtgcgtatgctacccatactcctatcgaccaggcttgcaccttccagggccatgctttccagcctaaacaatcacagatcaggcccagactgcactccctgggagctttggaaaaagctgcatcaaaccagagcttctccccaagcccagcaaaccactcatggctcaggtagtccttcctggaagaccaaagtgttggaagtaaatgcttattccccgatgttacagagaagaatccgcaattagacaaaatgtttcctcaacaggaaactctttttactctttgcagaaagggtggtgcctgtcagcaatcctgccaggagtacccacaaagtaaaaaagatactagaatagttttgccttacacatgaggtccctattgctgtgtcctgactccattggctggagccagacctcacaatctaaactaaaacccgattggctaacagttcaaaactttttaaaataggtaaaggcagtgaggaacaaaggaaaaaaaggaagttgcttatgaaaggacttagaaaagtaataatattcccaaataagggaggagggtaggctgcaagctgggacatgcctgggcatgtccagcacgaatattctgactaaggtacaaggacatagaatgtactacatgcctgtgagcatgtttaacagatactgaagtcagagtatgcttattctgttacctttgctacataaggcttaacagagagttattactataaaataagaaacttaaagttagttttgagaaaagatatcaataacatttatgatttaaagggatttgaagaggaacttttgctttctacacaaagcctcctcattcattgaagaggaaaactcttggtggggacaagagtgaatttactttaaataccaatccactgactaatcccaagtctgggaatgcctccaaaatgttgagttgatgtattattatttatgtagaaacacccatttactgtaagtttccttcaaaacaaccctcgttgctgttgcagaaatcataggctgtgacgctggtagccacctacacattccttctagaacacgtatatttttccccaagatataagccctgggtctagggggttgtggtgcagagatctacctatcttgtagccgcccaagaccacgtttctgtttgtaaatttccctaataaatcacccagaaccacacattggatttctctgcctcctttggtttccaggctccttctgcatttgggggttgctgtgtaaatacagccctttcatggaacaaactcccatagaagtgcaaactgtgttgacccttgttttatccaagtgtcctgtctacatttgtagccttccagtatttgctgggtctgtctctttggcattttgggagccacataaaccaccaggcttcaagctgttaccccgggttgctgctcctctgaccatccttcctggttagtctccctcctgacccaccttctcactgctgctgttcttcccacatcttctgtctgcgtgctctgggtcactttaagttccatgttgaactcctctacattccctatattttaatggaagcagttccctccattctttttttttttttttttgagatggagtttcgctgtcgccaggctggaattcagtggtgtgatcttggctgactgcaacctccaactccctggttcaagcaattctcctgcctcagcctcccgagtagctgggattacaggctcgtgccaccacgcccagctaatttttgtatttttagtagagacgaggtttcaccacgttggccaggatgatctcagtctgaccttgtgatccgcccacctcggcctcccaaagtactggggttacaggcgtgagccaccgcgcccggccaattcatttcttttttaaactaacacttagctcttccttaaggatgtttctcctggggatctcttaaaggaaggctattcattctcccacaatccaacacctcaagttcgagaggtggagtcagtgcttcatggatccatgctgtggctggagaccattccttctctgccctcatgaatgaatgaactattgcatggtggctatttggaatgcaattttttttttttttttttagatggagtttcgctcttgttgtccaggctggagtgcaatggcgcaatctcgactcactgcaacctctgtctcccaggttcaagtgaatctcctgcctcagtctccccagtagctgggattacaggcagatgccacgatgcccagctaatttttgaattgttagtagagacggtgttccaccatgttggtcaggctggtttctaacttctgacctcaggtgattcgccctcctcagcctcccaaagtgctgggattacaggcatgagccactgtgcccagcctggaatgcaaatctttgtgtcacctgactcctatcatccattgaccttcttaccaattggcctcattcagtgaaggtgagcccacacctcagaatcagtctccttatcatcctatactctccacccctatatactaccaccaccttgaaaatatctagaaaatccctatttgatggatatttcgatggatgaccttctcaacatccagccctttattttcttgacttgctcatggccagtgaccttcacctgcattcactttaaccactgtacacaacagagtgctttgttgtaaatgatagtaattgactctagcaaacttagatcaccaatttgagctgtttcttcacctccttcttgacttttaagatggtggtaaaatgcacataaaatttaccatcttaaccatttttaaatatacagttcagtggcattaagtacattcacaaaggtgacacaaactccagagaatatgctgcttgcagctttgatgattgtatcaacggtgataagtcttcccatgtctgcaggagcagctgcagctaattatgcttactgggcctatgtgcctttcctgcccttaattcgggcagttacatgggtggataattctattgaagtatatgttaataatagtgcatgggtacctggccccacggatgatcgttgccctgcccaacccaaggaagaaggaatgatgatgattatttccactgggtattgttatcctcctatttgcctggggagggcaccaggatgcttaatgcctacaacccaaaattggttggtagaagtacctactgtcagtgccaccagtggatttacttatcacagggtaagtggaatgtcactcaggccacaggtaaattatttgcaggacccttcttatcaaagatgattaaaatctaggcctaaggggaagccttgccccaaagaaattcccaaaggatcaaaaggcccagaagttttagtttgagaagaatgtgtggctgataggacggtgatattacaaaacaatgaattcggaaccattatagattgggcacctcgaggtcaattctactgcaattgcacaggacaaactcaatcgtgtcccagtgcacatgtgagtccaactgtggacagtgacttaacagaaggtttagataaaaataagtataaaaggttagagtctctatacccttgggaatggggtgaaaagggaatctcatcacctcgaccaaagttagttagtcctgttactggtcctaagcgtccggaactttggaagcttactgtggcctcgcaccacattagaatttggtctggaaattaagctataaaaacaagagatggtaagccatcttatactatcgacctaaattccagtctgacaattcctttgcaaatttgtgtaaagcccccttatatgctagttgtaggaaaaatagttattaacccagattcccaaactataacctgtgaaaattgtagattgtttacttgcattgattcaacttttaattggcagcactgtattctaccagtgagagcaagagaggccatgtggatccctgtgtccatggaccaactgtaggaggcttcgccatccatccatattttaactgaagtattaaaaggagttctaaatagatccaaaagattcatttttactttgattgcggtgactacgggattaagtgcagtcacagttatggccgctgtggcaggagttgcattgcactcttctgttcagacggtacactttgttaacaattggcaaaaaaaattctacaagattgtggaattcacaatctggtattgatcaaaaattggcaaattagattaatgatcttagacaaaatgtcatttggatgggagataagctcgtgagcttggaacatcattttcagttacagtgtgactggaatacgtcagatttttgtattacaccccaagcctgtaatgagtctgagcctcactgggacatggttagatgccatctacaaggaagagaagataatcttacttcagacatttcaaaattaaaagaacaaatttttgaggcatcaaaagcccatttaaatttggtgccaggaactgaagcaattacggaagctactgatggcctcgcaaatcttaacccagtcacttgggttaaaaccatcagaagttccattattataaatttcatattaatccttgtgtgcctgttctgtctgttgttagtctgcaggtgtacccagcagctccgaagagacagcgaccatcaagaacgggccatgatgacgatggcagttttgtcaaaaacaaaagggagaatgtggggaaaagaaagagagatcagattgttactgtgtctatgcagaaaaggaagacataagaaattccattttgatctgtactaagaaatattgttctgctttgagatgctgttaatctgtaactttagccccaaccatgtgctcgcagaaacgtgctgtatcaaatcaaggtttaatggatttagggctgtgcaggctgtgccttgttaacaatgtgtttgcaggcagtatgcctggtaaaagtcatcgccattctccattctctattaaccagggacacaatgcactgcggaaaggcgcagggacctctgcccaagaaagcttgggtattgtccaaggtttcccccactgagacagcctgagatatggcctcatgggaaaggaaagaccttacatcccccagcccgacacccatgaagggtctgtgctgaggagtagtgaaagagggaggcctctttgcggttgagataaggggaagttttctgtctcctgcacgtccctgggaatgaaatgtctcagggtaaagctgatcatgagataggagaaaaccaccctgtggctggaggcaagatatgctggcagcaatactgctctgttactctttgctacactgagatgtttgtgtaaagggaaacatacatctagcctacatgcacatccaggcacagtacttttccttggacttattcatgatacagattcctttgctcacatgtttcccctctgaccttctccacatcaccctgttgccctgccacactcccctcaccaagatagtaaaaatagtgatcaataaatactgagggaactcagagactagcaccggtgcaggtcctcacatgttgagcaccggtctcctgggcccactgtcctttctctgtactttgtctctgtgtcttatttcttttctcagtctctcgtctccacctgacgagaaatacccacaggtgtggaggggcaggcccccttcacatgttggtcaggctggtctcgaactcccgacctcaggtgatctccccaccttggcctcccaaagtgttgggattacaggtgtgagccatcgcacccggcccactttctaattttttctcctactgtttttccctccgtagtctcttttgtggcattgtcttcctctgcttctttcttgtttgtgttttttggtgctattgtaggtcctcctgtcttctatacactctctcggtgatcttacccataaccatggttatcaaatctgtatctccatttttgaactttctcctgagctatacatccatggatccaacatcctactccacatctccactctgatatcccataggcatgccaatcttgatagggctaagcctgttgcttctctcctctggtcttcctctaggaatagcaccacctatacttcaagccagaaagtggggcttcatccttgacaacttccttccatataccctctaaatcaatcaaatcctaaaggctaccaatggttcctcttacttatctcatgaatccatccacttttcaccaatccattggtcaaggatatactcaggaacttctcgtttcttctcctgttactgaaacagtcttcggatttgtctgctgccttcactttctattgtctacgctgtcgctgctgtgatccttctacaacacacatctgagattgccactctcctaattctaaatccttcagttgttttccactgctttcaaaatgcaatgcaatgggctgggcgcagaggctcactcctgtaatcccaacactttgggaggaggccgaggagggcaaatcacctgaggtcaggaatttgagagcagcttggccaagatggcgaaaccctgtctctgccaaaaacacaaaattagccaggcatggtggttggctgtaatccctgctacttgggaggctgaggcaggagaattgcttgaacctgggagtggaggctgcagtgagacaagattgcgccactgcactccagcctgggcaataaagctagattccatctcaaaaaaaaaaaaaaaatgcaatgcaatggtttcgtgacctgccacaacgtggccctgcccagctcttcttacttgccattgctactcattttcccctgccctccccactcgactgaacagctctcagtatctcaaattcatcatgctctcttctactccagacttttgctcatgttgttccttcatttccaacattcccacttttccaacactgaccttcccttagctcatttccttcccttagctgaccttcccttagctcaactgctaaggtcttgcctccagctgccacctctttcactttcttcaggaagcctttttttttttttttttttttttttgagacagggtctcactctgttgcccaggttggagtgcagtgacacgctcacagctcattgcagcctcaatctcccagctctgccagtaaacagatgggcctctctggaccccagtttccaaaggttgaaggtcaagacaatagctctcaattccctacttttgttaggattgtatgaagggtccttccagcactgtcccagtatggtgctcggctaatggaaaaccaatctctgtaacttggactagttttattcccaccttatctgggaattataagggtataaggttgtaaaaatataaagttaacaatctgaccctcacttgggaatcataaaattacaatctgatatccactttacttggaacttatggtcagccctctgtatcctcaatcaacctgggactgaaagtatttgaaaaaattacaataacaaaaaataataaaaaatcatagaaataaaaaagtacagtgtaatatctatttacatagcatttacattgtattaggtattataagtacagcaggtcctggaataacatcatttcatcattttgctcagtggttttcttataatgatgagaaaaaaatagatttctggctgggtccactgtcacgttttatccatgtctgtgtggattttctctgtcttctggtgtcctgtcacatcccaaagccgtgcagtgcactttaggtaaattggtgcatctacacgatccgagtgtgagtgtgggtgtgtgtgagcacaccctgtgaggtgccctgagttggaataagccggtaaaaatgatctcacttttattaatctttatttttctctaagcgagagggatagggggtgtttaaaaaaaactttttctttgagacagagctgtgctctgtcgcccaggctagagtacagtgacatgatctcggctcactgcaacctctggctcctgggttcaagcgattctcctgcctcagcctcccgagtagctgagaatacaggcacgcgccaccacacccagccaattttctgtatttttagtagagatggggtttcgccatgttggccaagctggtcttgaacttctggcctcacgtgatctgcccacctcagcctcccaaagtgttgggattataggcgtgagctaaaaatcttccttaaatatatgcatggctcacacttatttcaatgtttaatattagaagtgttttggtctttatttcgaagtttaggggcgattttgtgaccacagatatgttgtaggaacttcactcatatcaattagcctgtggtcaaactgttttccttacagtcatttggcttaaagtttcagtttccaagaacccctccacgatgttaggtgaggacttagggaatgtggagatgacctaaagtttatgatgggaagatgtgtgtaggtgatatgcaaacacttttttttttttttttttttaccaaggacttgagcatttgtggacgtgggtcccctggaggggccctggaaccaatcaggactataaaatccttttaaggttttaagaagagcattgttatctctgtggtactgacgaagaccccgcaagctcaccgagattaagtgcccctgcctaaggttacaaagcctcttatcctcaggccacctccagtacagcaaatccaagccctcccgtctaaacttggcgccctgagtaccaagggtcacctcggcctttcaggctgaagggagggaggctgagtctcagggcagagtctgagtcccactccgcaccccaccctctgtctggtacagcttaccaaaccaaagtgcccaaagccgtgacatcccggccggcggctcgcaggcccccgccctccgcacgtcacggccgccgggtgcagtgccccctaggggcccctgggacgaggaggaagcgccaggtccttcccgccgccgccgccgccgccgccgcctgctcccctggcacgcgccccgccgccctcggcagccgcagctccgtgtcccctgagaaccagccgtcccgcgccatgggcacgcgtctgccgctcgtcctgcgccagctccgccgcccgccccagcccccgggccctccgcgccgcctccgtgtgccctgtcgcgctagcagcggcggcggcggaggcggcggcggtggccgggagggcctgcttggacagcggcggccgcaggatggccaggcccggagcagctgcagccccggcggccgaacgcccgcggcgcgggactccatcgtcaggtgagtgtcgggtctggccctggcccaggtctccagcggctgtggccccgacccaggggcggagcgcccgggaccgccgtggggagcggggcgcggggctgcgagtgtttggtgccaactcattaggggggccgggcggtgtgtcgggaaacgcgggcttgggcactgcggccgggagcgctggcggagaacgggggatccagtacccgaccgggcccgcagcgcaggtgggcgtgggcatctccaatgggcgcctagcggcatggaccgcacgcccggctccacgtgcgcagccggccgccggctctgatgcaatcgcgccgggcgcgacccagacggtaaaggggcggtgcggctggggcggaaaccaggggagggggcgaggagcaggaggagggcggggctgcggctcggcgcgccggctggcccggggttcgggaagggcaagcggagctcgggagaggcgggctcgggcccagcgccgcccgcgcgaagctccctggtgttgtgcgcccttccccgcgcgcggcccctcctgctgggctggggtctgtggctgacgtccgcttttcccggaacggcaaaggtggagccgggcccccgggacagccgccggggggaatccgagaggtctcagcgctggtttccagcttcgccgcgcagcgcccacggagtccccgcgcagctgggtttgcagggttttctgcgggcccagagcgaactgggagccccgggcccggcctttcccgtcccggtccccgcccctgggctccagccttccccgccctcgcccagaggggcgcacgggtctcgggccttgcagggcgagcccttcgggacaacttgggggtggcaagaaagccccttccgcctccctcggaactgggattaggaacgagttccaggatgcggtttccccggccagcggaccacctcctccattcacatcctcttccctttccttctagccttctttcttagtcattgcctgcttgcctttctctctgcctttccttcctccctctgctctcccattttcctccccactccccttctcccatctcagtaaaatacgtttcctaggctctttattatgtggcggatgattttaaggggccatttatttagtttttcttgttctctgtcttctttttcttttagaaatggagtctcgctttgttgctcaggctggagttcagtggtgccatctcggctcaatgcagcctccgcctcctgggctcaagcgattctcccgccttagcctccagtgtaactgggaccacaggtgtgcgctaccatgcccggattattttattttattttcatagagacagagcaccactctgttaccaggctggtctggaactcctgggcgcaagccatcatccctgcccccaaaagcgctgggattaattacacgtcaggtcattaggttttaacctgcacgttgctgagactcatcttaccggttagagtctgaagccaggataggcggcaaaaaaacttctcccgtcatgctgttttattttctaggtaaactgattattacctgaaacttccttctttgctcatttcttgtctgtctcacccacctggaatatgagcttcatgagacagccgtctcttcggtgctatatcctaggtcctggagagagtgcccagcatgtaataagcacttgtgaaatggttacagaaggaatgcttcaagatttggggtcatctgtgggttttattcatacatattctttttttttttttttttttttgagacggagtcttgctctgtcactcaggctggagtgcaatggcacgatcttggctccctgcaacctctgcctcccaggttcaggcgattcccctgcctcagcctcccgagtagctgggattacaggagcacgccaccacgcccggctaatttttgtattttgagtaaagacaggatgtctcaccatgttggccaggctggtcttgaactcctgacctcaggtgatccgactgccttggcctcccaaagtgttgggattacaggcgtgacccaccgcgcctgggctattcatgcatacttttaggtttaaagccatgactgccttagagatgagtaaagaggttagtagggggctttagggcctgcactgggttctccaaactcaattccttcaggaaaatgggaggagtaacagtacttacctcaaggggttatggaaacaattatgtgagaggacacatgcaaaatacatagcccaggactgtcacatacaagacaagtccctcaacaaatggtggctattaattttttttttttttttttgagacggaatctcactctgtcgcacaggttggagtgcagtggcgggatctcggctcactgcaacctccgcctcccgggttcaagcgattcccctgcctcagcctcctgagtagctgggattacaggctcgcactaccacgcctggcttattttgtgtttttagtagagacggggtttcaccatgttggccaggctggtctcaaactcctgacctcgtgatctgcctgcctcagcctcccaaagtgctgggattacaggtgtgagctaccatgcccagcaatatttttacaattcactaagccaggggtccacagacgttttatatataatgggccagatagtaaatattttaggtttagtgatcctagaggcaaatcaaaattattagtaggtacatttataacaagagaaaagacaaatttaggccaggcaccatggttcatgcctgtaatcccagcactttgagaggccaaagtgggatgatcacattcccaggagttcaagaccagcctgggcaacatagtgagacacccatctctgtaaaaaattttaaaaaattaactgggcgtggcgcgtgcctgtagttccagctactcagaaggctgaggcaggaggatcacttgagcccaggaggtcaaggctacagtgagcggagattgcgctactgcactgcagcctgggcaatggagtgagaccttattttttatttttgcaattaagtatttttaattaaggtatgtacattttttagacaatgcttttgcacacttaatagatggcagtatagggtaaccataacttttatttttattttctattttactttaagttctgggaaacgtgccgaacgtgcaggtttgttacataggtatacatgcgccatggtggtttgctgcacccatcaacccgtcatctaggttttaagccccacatgcattaggtatttgtcctaatgctctccctcctcttgccctcccaccccctgacagaccctggtgtgtgatgttcccctccctgggtccacgtgttcttattgttcaactcccacttatgagtgagaacatggggtgtttggtttctgttcctgtgttggtttgctgaggatgatggtttccagcttcttccatgtccctgcagaggacatgaactcatgctttcttatggctgcaattttatttttgtagagatgaagtctcactatgttggccaggctggtctcaaactcctgggttcaagtgatcctgctgcctcagcctcccaaagtgctgagattgcaggcatgagccaccacgcctggctatattgtacctttcaattgagttatgtgcatggtttactgaaactctagccctgaattgattctccgaggattggagcaaagtgggtgggggtgtgtgtcagctagaagtcacctggaatagacatccaggagcggaagtgtattagtcagaaaaattaaagaatgagctccctcaaaagcatagtgacctgttgttcctggtgatgggactagatgaccataatccctcagcctcccaagtagctgggattacaggcaggcaccaccacacccagctaatttttgtatttttagtagagacggggtttcaccatgttggccaggctagtcttgaactcctgacctcaaatgatccacccgccttggcctcccaaagtgttgggattacaggcatgagccactgcccctggccagtaataatacattctgtataatagtcacagtaatggtgaaaataacaaagctgctgctgatggcttagttctgagttttagctacacatggcaacctagctagagagctcacattccttcccactgtcctcaaccaaagtggaagctcacaaggccatttttctgccccaaggacatgaaaatctctgattagaaacatttatgctactttttggatttattgagcctaatgactcctttttctttcttgctttgtcactgtaggaatgagtaaccccaaaaaatgaaacattacacatataacaagttgtagggagcatgaacctattttgttttattagcttgggtggtagtagcgttgaactcctttacatacctgtacaggcacccctaagatattgtgggttcagttgcagaccactgcaataaggggaatatcgcagtaaaacgagtcacacaaattttgtagtttcccagtgcatataaaagttatgtttagacaatactgtagcctattaagtatgcactagcgttttgtctaaaaaaaaacccatatataaggccgggcgtggtagctcatgactgtaatcccagcactttgggaggctgaagtgggtggatcacgaggtcaggagttcgagaccagcctggccaacatagtaaaaccctgtctctactaaaaatacaaaaattagccaggcatggtggtgtgcgcctgtagtcctggccacttgggaggctgaggcaggagaatcgctttaacccgggaggtggaggttgtggggaggcggaggttgtggtaagccactacactccagcctgggaaacagagcgagactccgtctcaaaacaaaacaaaacaaaaaaacccaaaaaacatatatatatatattatatatataaaatatatataatataatataccttaattataatataatataattatatataccttaatttatatatataccttataatatatataccttaatatatataccttaattatatatatacacaccttaatatatatataatatatattaatatatatcttaatatatatatataaggtaatatatatatacaccttaataataatatatataccttaattttaaaatactttattaccaagaaatgccagtgatctggtggaggatttgcctagatgttgatggttattgactgatcagggtgattgctaaagattagggtggctgtggcagttttttaaagtaagacaatgaggtttgctgtattgatggaactcttcctttcctggaagatttctctgtagcagtgctacagagaaaatggtaacattttacccacagtagtaggacttctttcaaaatgggcgtcaatcctctcaaaccctgcaactgctttaccaagtacttgatatcaactactgtaatcttttttttttttttttttttttttgagatggaatcttgctctgtcgcccaggctggactgcagtgctgcgatctcggctcgctggaacctccgcctctcaggttcaagtgattctcctgcctcagcctcctgagtagctgagactacaggcgcctgccaccacgcctggctaatttttttgtatttttagtagaaacggggtttcaccatattggccaggctggtctcgaactcctgaccttgtgatccgcccacttcggcctcccaaactgctgggattacaggtgtgagccactgtgcctgcctaactactgtaatcttataaatcctttgttgtcattttattttattttaattttattttattttattttaatttaattttattttattttattttttgagacagtctcactctttcacccaggctggagtgcagtggcgcgatctctgctcactgcaacctctgcctcccgggttcaataaattctcctgcttcagcctcccgagtagctgggattataggcgtgcaccaccatgccctgctaatttttttatttttagtagagacggggtttcactatgttggccaggctggtctccaactcctgacctcgtgatccgcccgcctcggcctcccaaagtgctgggattacaggtgtgagccactgcgcccggcctaataaggctgttttcttatcatttgtgtatccacgggagtagcacttttaaatttcttcaatagcttttcctttgcattcacagcttggctaactgtttggctcaagaggcctagcttttgacctatcttggctttcaatacaccctcctcactaagtttaattatttctcggtttttatttaaagtgagagacctgcaactcttcacttgaacacttagaggccactgtagttactaattgtcctaatttcaatattgttgtttctcagggaatagggaagccagaggagagggagagagaagggggaacagccagtccagtgaagcagtgagaacacacaccatcatgaaccatcatggccacggtttggccaacacaattacaacagtaacatcaaagatcgtcaatcacacatcaccagaacaaacatactaaaaatgaaaaagtttgaaatattgtaagaattatcaaaatgtgacacaaattgagcagatgccattggaaaaatgactcccatagacttaaaacacaggttgccacaaactttcaatttgtagaaaaacacagtatctgtaaattgcagtaaagcaaagcacaaaaaatgatgtatgcctgtatttttttttctatccacatccaccccccaactttttttttttttttggtagagaccaggtcttgctatcttgcccaggctggccttgaactcctgagctcaagtgatcctctcacctcagcctcccaaagtgctgggattacaggcatgagccactgcgcccagcccccatccccaactattttaaaagtctaattactttttgacgattgccgacttacctatagaagtgttcctttcagcccggcgaggtggctcacccctgtaattccagcactttgggaggcctaggtgggcggatcacgaggtcaagagatcgagaccaccctggccaacttggtgaaatcctgtctctactaaaaatacaaaaattagtgggacgtggtggcatgcaccagtagtcccagctactcaggagactgaggcaggagaatcgcttgaacctgggagatggaggttgcagtgagccgagatcgtgccactgccctccagcctggaaacaaagtgagactccgtctcaaaaaaataaaaagaagtgttcctttcatcaactatgaatggatcaagactatgaatgtttctgagaaaattattgctgttagtaagaatgtttttagtgtttaagggtagctttggggcacagaaaaaaacaaacgtacatttataagaaaaaggggaaagagccactgtagtatacctgttttacagatgaggaatctgagactcttagagacttgtccacgctagtaaatgaaatgcccagtaccaatcctgggccgtatttccacttagtgtctcagaattacctggactctgttaaaaatgcacatttctgggctccactgagacacgttgaatcagactttctagggctggaactgttattttttttgagacagagtctcgctctgtcacccagctggagtgcagtggcatgattttggctcactgcagcctctgcctcctgggttcaagtgattctcctgcctcagcctcctgagtagctctgggattacaggtgtgcaccaccatgcctggctaatttttgtatttttactagagatggggtttcaccatgttggccaggatggtctcaaactcctgacctcaagtgatccatttcaccttggcctcccgaagtactgggattataggtgtgagccactgcacctggcctggaacctttacttttaccaaactctccagtgatccttataccatgaaccgcttgggtcccacactccggtgctttcctggacccagacaaaaataagaacccagcatagccaaattaacagtcacgacaggctggaaagagtgcggtatatgggcctcagtcacccattattggatggatggattttagtgcttatttataaggtgatttgtaaactttcccatatggtcacatttattcagcacaataatacaattaattccctgggaatgaagtagctttatcccaagtgtttccaaacaaaactaactgaaatgttcccaggttatagacagttgcctgcacccagtccatctgttccggcccagctggcagtagaaagactggtcctggttgtgaatctgagcagctctctcccctaaagccccgcctgggaactgcagtgcctctggttccatttgtcagctgtgtctctctgaaaactggggaaagcttcccgatgcctttctgctcttggcagtgtaccgttgatggcattggctggaacttcttcaccccgcatttttgttaggtgcagtgcaagaccctgtcggagactgaaaacaaaatgtaaaggtggtcttagcactgaagcctgggggctcctgtggctgcgcctttggtctattgtgagagggggaaaagccagctcccagtgctcatgtgctgctgagaacatatcatagggtggtggcgaaggtagcctctgcagtcactcatcccagaaggttccataaagagctgagctcctaacacttttttttttttttgagacggagtcttgctgtgttgcccaggctggagtgcggtggcacaatctcggctcactgcaacctctgcctcccaggttcaagagattctcccgagtagctcagattataggcgcctgccaccacacccagctaatttttgtatttctggtagagacggggtttcaccatattggccacggtggtcttgaactcctgaccttgtgatccacccgcctcagcttcccaaagtgctgggattacaggcgtgagccaccgctcctggactttttttttttttctttttttaaaaagaaattgagtcttgctctgccacccaggctggagtgcagtggtgcagtcatagcttactacagcctcaaactcatgggctcaagcggtcctccagcttcagcctcccaagtatctgggactacagtcacgtgccatcacgcccagctaaattgtttatagagatgggatctcgttatgttacccaggctggtctcaaactcctggtctcaagcagtcctaccgccttggcctctcaaagtgctgggactacaggtgcatgccaccatgccaggccttctaccacttttacctaggcctgctcaccccaggctggcacctccctcagaggtgggaggtgaaggtggctgctgctgggcatttaggaggtacaggtgcagactatgttgtggattctcagaggactgagaagctctctgtctctctctctaggaggctttgatagtgttatcaaagtgggtctccagtgtttctggaactttcctccccttccttccttacctaattccttctttaaattccaggacctggaatttatcctgtctcgacacttcttgtccaacagtgagccccctgtcttcacccccctaatcccctgtcttcacatccctcttcccactttatttgctttccccatggacccatactcagggttttgggaggatggcagcggagtatggtggaggagagcgattatttaaagtagaaacccaaagcttttattatagtaaacttggaaaatacaagagaaaaattcacccctagaaaattattgtaaacatctagtttgtttccctctgcatattttaaaaactggattgccgcattttaccttgtgttagtgtcttgatttcattgttacgccgcctaccccctccacagtgtacacttggagtgcgtccttctgtggtctagttattttcacttggaggaaggaactttcacagaaaatgtgttgtgtcagtcctttctactcattaaccaagaaatcacaatgttgttttctttctcaatgtagagaagtcattcagaattcaaaagaagttctaagtttattgcaagaaaaaaaccctgccttcaagccggttcttgcaattatccaggtaagccgagaacaaggttcagtcctactattttaggatgcctttcaatttagaaaatgattgtatacaaaagagcagctgcatttcttgccaaagaggagagggctcagttggcaatgctgttttctttggtcttttgcttctttggggtcacgggtgaagtactgccctgcttgagtgtgtcttcttttgtgaattttcctctctgaggtatgggtagctttcagaggtctaggaggtaagcacttacatgcattgcattacacaggatatatcgtggtccatgtgtcctcacaaatgcttaccaaatgtgatttgaaggtgctgggggaaaaagtggcactttgtttcaatggacacagatgctagatgaaacatggatatttggtaatctttttactctatcttttaaaacctgccataaacttaatgggacaaaagtcattaccctgtcaaaagggctttgcattccacatacttcttttggctgcaggctctggttctgagccacagttggccccagttgccatcctgcttggcacacttgtgtgatggcaggtgctgagaaataaggaggtgagccaagcctggaagcaaacacagcctgacagttgggctgctaccgcagggcttggcatgcccttagcgtatcaaaatagcagcctctggttccaccgtgctgcgtatttcaggattacagagctgtgctcaagttacttacattctctgggatctgtagccacatcttgttacaaagaaagacaagttagaacaatagaaagaaaattagattagggctcgggcctcctgggaatctgcttactccctggctttccatctaaaggcaaaccatttcaactcctacctttggtatccccattttttggcttctttttgtgatggggtcttgctctgttgcctgagctggagtgcagtggcatgatcttggctcaccgtagctttgaccttctgggctcaagtgatcctcccacctcagcctcctgagtagctaggactgcaggcatgcaccatcacgccgggctaatgtttgtattttttgtagagatggggtttcaccatgttgcccaggctggtctcgaactcctgggctcaagcaatccaccgcctcagccttctgcagtgctgggattacaggcatgagccactgtgcccagtcggtgtcctcatttttagagaggaaagctggctaggttactatgtcttctaataggagggatattattttccttaaaaaagtgacataatttgaaggcctgaggaattactctgttaaatactggccccaagtccctttttataagcagcaagattgtttttctgcaccttccatattatctttgtaattagatcatctgtaatcacaaaattcatctctggattatcttttgtgccttttcaagctatttttatgttgttatgttgtttttaccttcctaaggcaggtgacgacaacttgatgcaggaaatcaaccagaatttggctgaggaggtgaggactgctgcttttaaaaaattcactataacttttaacaatacattctcttatagtgacgaataaccttgtgttcctttttcaggctggtctgaacatcactcacatttgcctccctccagatagcagtgaagccgaggtaataatggcagagctctaaactcttgcttcttctttcctcttgagacttaataggcccattggcgtctcttagtggtggctgggacagatctaagatttgcttgtgactgaatgttagagggaagacttcacttcttttctctagggtaaatgcttcatgatatccttgtttcttgtcatttgtatgtttctactgaagacttgagttgcgacttgttgagttcggttgtgtttcttcagctgcggtggcagcgtcatctagtggaaattgtcaggccgaggcgaggaaactggaccttggaccacagatccctgtgccagggcccggcccttctgtggttagcttttcttcctactggcttcatgtgacagaaaacctcaaataatggaatcttaaataatgtacaagtttatttctctctctctctctttttttttttgagatggaattttacttttgttgcccaggctggagtgcaatggtgccatctcggctcactgcaacctccgcctcccaggttcaagcaattctcctgcctcagcctcctgagtagctgagattacaggtgcgtgccaccacgcctggctaatttttgtatctttagtagagatggggtttcaccattttggccaggctggtcttgaactcctgacctcaagtgatccaccctccttggcctcccaaagtgctgggattacaagtgtgagctactgtgcccggcctagaagtgtatttttctgggacatgaataaagtttggaagtaggcagtccctggttggtgatatcaccaagtcgcaggagctcaggctcctgtccctctgctctgccgcctttgtggtttggttaacaagcactttgttctgattgatcagtgaggcccagcaggtctgctagtcatttgtgagacaaagaatgggaatttgtagagtttgtatctggccttgtgctatgtaaacaagggggcattggtgagtcttatttgagtcctatggagaagagcagttctttgcagtacacagaggctgcagggatttgttaaccttccctcttttccaggatcacagggctcaggtaaagttcgttgtcaccaagaagaaaaaggaaggacaaagacaggcccctgctgtctttaaagacatttcctgaaagtcacagttctacatccatcccgttgtcccctacttagttgcctggccaactgcaaaggaggctgggaagtgtagtttttataccaggaagccttagatcatttattagcaagctaaaaaccaagagtttattactaagaagagaaaggaaactatatactgggcgataagtgtttgccacacttgccattgtagcgtggtacaaatatgaagtgttaaatatgtaacaaatacctatgataccagcagtgacagcatgcaaaggaagttgttgttcatttgcacgatacccactgtctgcagcagaatttgcttttctttctttttttttgagatggagtctcgctctgtcaggctggagtgcggtggtgcaatcttggctcactgcaacctctacctcccgggttcaagtcattctcctgcctcagcctcccaagtagctgggattacaggcgcccgccaccatgcctggctaattttttgtgtttttagtagagacagggtttcatcatgttgaccaggctggtcttgaactcctgacctcaggtgatggcctgcctctgcctcccaaagtgctaggattacaggtgtgagccactgcgcccagctggaatttgcttttctttaggttgttttgccactggtgtttttttttttttttttttttctgagacggagtctcactctgtcacccaggctagagtccaatggcgcaatctcctctcactgcaacttccacctcccatgttcaagtgattctccctgctcagcctcccaagtaactgggtttacaggcacccgccattatgcccagctaatttttgcatttttgtagagacggggtttcaccatgttagccaggccgttctcgaactcctgacctcaggtgatctgccctccctggcctcccaaagcgctgggattacaggtatgagccacctcacctggccttgacactggtattaatagcccttgattttcgtcgttgttgtttataattgacacataataattgtgcatgtgtgtggggtacagtgtggtgtttcggtacttgcatatgttgtgtaatgatcaaatcaggttagttacattcatcacctagaacgtttatcatttctttgtggtgatagctttcaagatcttttctagctgtctggaaatatacaatacattgtcattagctttagtcactctactatgtaagagaacactggaatttattcctcctatctaagtgtaactttatacctactgatggaccaacctctccccatttcccctcccccatccctctccagcctctggtaaccaccattctattctctatttctatgagatcagctttcctagattgcacatgtaagtgacatcctatgatatttgcctttctgcacctggcttatttcacttcatgttatgtcctccaggttcatccatgttgccacaaatgacaggatttcattcctttttatggttgaatgatactccattgtgtatacacaccacactttctttatcctccattaatgggcatttggattggttccatctcttggctactgtgaatagtgctgtaacaaacatgggaatgcagacggcttctcagcatagcggtttcagttcccatgcgtatatacctagtggtgggaatggctgggtcatatggtagttgtttttttaattttgtgagaaatcttcatactgttttctctaatggctatattaatctgcattcccaccaacagtgtacaagagctcccctttccacatatcctcgccagcatttgttattgtcatttttgataatagccattctagcttgatatctcattgtggttttgatttgcatttccctgataattaatgatgttgagtgttttgtcatatacctgcaggccatttgtatgtcctttgggagatgtctgttcacgtcttttgcacattttttatttgaattatttgtttttttgttattaagttatttgagttccttatatattctggatgttaaccccttgtcggacgcatactttgcaaatattttctcccattctgtaggttgtctctgctttgttgattgtttgctttgctatgaagaatgtttttagtttgatataatcccactgatgtatttttgctttcgttgcctattttgttgaggtcctatccaaaaaaaccttgtccagaccaatgtcatgaagcatttcccctgtgttttcttctagtagttttatggtttgagaccttatatttaagtctttaattccttttgagttgatttttatagaagtgagcgatgagggcctactttcattcttctgcatgtggatatccagttttcccagtgctatttattgaagaggctctctttccacaatgtgtgttcttagtacctttgccttgacttattttttgacaaggaatcatttattccgtatttttctttgggaaaattctcatagagtgaatttgtatggtgttatattgaaaaagagtaggtaccttaatttattagttaagatttgtgttggcatttgttgcttctaccaaatgcttggtacaggtggcaatagtttcctcgcttcattctggtctctgcttggacatcgtggcctctgaccaccctccacccatcatcactctgttagccttttaccccactgaacctttatttttctgcatgtcatttattctttccagtgattttattattattattatttggaagggaggaacttccctcctccactagagtataagatccacgaggacagttttgtttatagctgtatttcctttacttagaactgatacagagtaagtgctcaaaccatttgttgaatgaatgaaagaatgccaaatgaatgaaacaaagctttctttctgattttgtacctcaaatggtttcccctgccactgcacaggtagtgatttttgctaggcaatgaaacaaaaatggtaaaccaacccttccccagagcctctgagtgagatctatatgcaaagataagtatcttctcacttgtgagcaaatatttttgttaagtgagatgaatcaggatcttatctcctggcataaaatagacagagaggacaaagcattgcttatttagagacacacccagacatttattagcttcccaaaatgtagcttggtctttttcctaaatagtgaattattttagtgtttcccataaaaggagctgtgcatgctaagaatttttctagcataagcctttggaaaggcttcttgtgtgtcattgaggtccagataacccgagggcctctgtgactgcttggacgtcatgattagtgagctgtgttgaacacattgtgtttgaaacgcacaggcttagctgggccagattggaatgcttcagattcatgcttcctgtccttcctgaaaactggcagtgtgtttggcttaaagtatgcttgttgacagagaagtgtcctttgtctatctaaaccttaatagctgttgagctttggttttgttctgttttgtctttttctggcacagagtagagccatagaaaggcagagaagtcactaaaaaattcagccaagccttttaattttttttttgagccttgtacacatgatgaaaagaaaaaaataggctttttattatgctttacaccaagtttccaacaaggagcaaaacaacaacaaactataacagatgcattttcatgaatccactttttatataaagcttcctttgttgggtctcattttcacaaaactaatttttattttgtttttttgttttctctttagattatagatgaaatcttaaagatcaatgaagataccagagtacatggccttgcccttcagatctctgagaacttgtttagcaacaaagtcctcaatgccttgaaaccagaaaaagatgtggatgggtaagaaaataaaatcaaataatcaacctttatggctaaatcactttttctattgtgcctgcttttatttttctaaatttcttctatttatttcaactgtgtcagtaattggataaaaaaatcattttaaatatttcaggagtctataggatttttttttttttgagatggagtctcgctctgttgcccaggctagagtgcagtggcgtgatcttggctcaccacaacctccatctcctgggttcaagcgattttcctgcctcagcctcctgagtagctgggattacaggcatgcgctaccatgcctggctaatttttgtatttttagtagagacggggttttaccatgttggccaggatggtgtctatctcctgaccttgtgatccactcacctcagcctcccaaaatgttgggattacaggcgtgagccaccgtgtctggccatctgtagccttttaaaattctgcatgcaaaagttacatattttggaaaatacattagcccttttatagtgcttcaatgccatatgatcttacaccatcagattcatttaataaattccggtctgacttatacaatctttagccagctctattcttctaatagttttttccttggtaattctaccagaccagagaagaaaacttagaaacctgattccccagcagtaccatattctgtcttagtcccaggccagttgagaaaagcaaaataaatacttttcttaatgacacaaggttttatttgaaatttggaggggaacatcataactattgggtgctgtaatgttggcctgtgattcatgtcatggagtgacataagcttcatagaacaaaggataccggccgtctccagtgggggataagcatgcttcctggggattaaaaccccattttcctccatggaaatataggaagtgttttgtactgtggccaaaaagaacacaatgtgttaatggttataggttgtaagcagatttataaagttagattccagatccggtagaccctgcaggggctggatggggaggctaccaccttcctgagacacccagcaatcttccattctagccttttattgtgacttgagtagacccaaacacaggctgaaaaggtgtcatgaacacctccagtcctggctgggcacagtggctcacacctgtaatcctagcactttgggaggccaaggcaggaggatctcttgatctcaggaggtcaagaccagcctggacaacatagtgagacctcatctctattttttttttttttttttgagacagagtctcactctgttgcccaggctggagtgcagtgacacgatctcggctcactgcaagctctgcctcctgggttcacaccattctcctgcctcagcctcccgagtagctgggactacaggtgcccaccaccacacctggctaatttttgtacttttagtagagacgaggtttcaccgtgttagccaggatggtctcgatctcctgacctcgtgacccgcctgcctcggcctcccaaagtgctgggattacaggagtgagccaccgcgcctggccccttgtctctatttttaagtaaataattaaacatttttttaaaaaacgacaatctccagtcctgtcgtagactaactgtaaaaggagaagaagcactaatccatgagaaaactttcagaacttgaaggtcctagggcatagtttcaagtctttcataaaaggaggggaattcatgctgaggcccagccaggaaaaaccaaccaaacaaaaacaacagagagtaaaaggagaaattacgaaaatggttctaaatgtctccattctgttactgagattgacgtgctcagtttaggctagatagctgtggaatgttttgtcctagatttgaacagggaaaggcacagaacccttcagaagtgtgtggtcactcattttttccactgccccccaccccgacttctcaaggagataaatatcgaggtcaagttgaaatcagacctgtgacctgtgcctcaatcccaggtcttactgggtcactccagatttataggattggttctgggttttgagtggactgcaggaccatgcttctgtgtaactctagggatgctagtccattggggtccattgaaaggagctccctggagttgcgaagtgaagccctgtatggctttaggctgtgtcctggtatattggcagaaccggaacacccaatgtcagggccagggtgaagtttcctaaggtactgccttagaattttctaagacctttattgaatggcctttattgcctgctttctctttaattcattttttatgggtttttttttttttttgagatggagtctcgctctgttgcccaggctggagtgcagtggcatgatctcaactcactgcaacctctgcctcccaggttcaagcgatcctcctgcctcagccccctagtagctgggattacaggcacgtgccatcacgcccagctaccttttgtatttttagtggagttgaggtttcgccatgttggccaggctagtctcgagctcctgacctcatgtgatccacccgcctcagcctcccaaaatgctgggattacaggcgtgagccaccatgcctggtcctctttaattcatttttatgtattctgtctatcaaacattgacttggatgttatttggggttaatatatgtacattacacgtgagtgatttttttggctgggctttgacttaacctacttctttattttctgattcagagtaacagacataaacctggggaagctggtgcgaggggatgcccatgaatgttttgtttcacctgttgccaaagctgtaattgaacttcttgaaaaatcaggtaggatgctccttgagaaatgccgctgatttctatttattggtatttacattatttttaataaggatttgtttggggaagaattaaaaatttttttaaattattattctgatatccttttaggatgtttctagaagattctaattgaacatagaagtgatatttcacgttgactttttttatttttctcatcttttgggagatacagatgaatacctagaaactttttctagtaagaccatcttataaattaaaagagaaattagtagagataaacgattagccctgttttaaacatgctcaatttctctcatgaaacagtcaaaataaccacagtaaaatatgcttccagtttcagcttactaaatctatcaatatgtagccttagataagacttacgttgaagacttaaatgaggccaggcacagcggctcatgcctataatctcagtgctaggcgaggccaaggccagaggatcacttcaggccaggagttcgagaccagcctgggcaaacatactgagaccttgtctctacaaaaaaaatttaaaaattagctgggtatggtggtgtgcacgtgtagtcccagctatgctggaggctcaggcgggaagatcgcttgagcccaggagtttgaggttacagtgagctgtgattgcaccactgcactctagcctgggcaatatagcaagaccctgcctcaaaaaaaaaaaaaaaaaaaaaaagagaagaagaagaagccggtagatgtagtttagggcacaggagcctaggttgggatttattggtgagcagcttgcttttcagtagtcaggacttaatttccattgttgtccccttgacttggcgtttttatgtcagtgaaatagaaatgaatattttctctttcttcattattaagtttaatgagtaaattactaccaagtatttatatatttaagggctttctgagaacataaagattcaactaattgggccggcacagtagctcacacctgtaatcccagcactttgtggagccaagatgggaggattgcttgagcccaggagtttgagaccagcttggggaacatagggagactccatctctaccaaaaaaaattttttttttaattagccaggtgtggtgacttgtgcctgtagtcccggctacttgggaggctgaggtaggagaatggctggagcctgggaggtcaaggcttcagtgagctgtgatcacaccgcagcattccatcctgggcaacaagcaagatcctatctgaaaaaaaaaaaaaaagaaaagaaaaaattcaacgaactaaatctttttctctactccagtttgaatagaaatgaagcaaatgcccctccctacccctgaacatccaacaatcaaagaaaaatttcaaaaatatatggcaaagttttattaaaaggttaacattcaggatatatatgctttttggacagtaatattaagctcaaatctatgaaataatccatatatacagtgctttttcattacgtggattatcaagatgaagattctgagccacttcattagaaagtactcaaagaaaagagtaaattaggctggtgagttatagttacatattgtggaaagaaattcagcaacaggaattggaaccaaaagggtttgaatagagaatttttgttgattacaacaccccactcctagttcctagtcattgtaggttggtgctgagaaagttcaagttttaaaagggttttttgttgttgttgagacattcttgctctgttgcccaggctggagtgcagtggcgtgatcttggctcactgcaacctctgcctcccaggttcaagtgattttcctgcctcagccttctaagtagctgggattataggcatgtgccatgacgcctggctaattttctatatttttagtggaggcggggttttaccatgttggccaggctgatcttgaactcgtgacctgaagtgatccgcctgcctcagcctcccaaagtgctggaattataggcatgagccaccacacccagcctaaaagggtctttttttcttaagataaagttcttaaaggaaggatctgaagttttgagtataatattgaattttcatttggttagtaggtgtcaacctagatggaaagaagattttggtagtgggggcccatgggtctttggaagctgctctacaatgcctgttccagagaaaagggtccatgacaatgagcatccagtggaaaacacgccagcttcaaagcaaggtaaatttcatgttagaaacatacatcttgaaggcttctgttagaacagaagaaagtctagaaatgtataagctaagtgcttaattcaagaaattagaggaagaaaattgaatagacccatatccattaaagacattgaatgagtctactcaccagacaaacaaacaagaaaaggcaacaggtggttttacaaatgagctctatcaaacaaagaacagatcattctaatacaatccttttctccagcaaatggaaaaagaaggaacgtggcctaacagactttatgagtgccaaaaccaaagaagggtaacatgctaaaggaaaattaacaggccagtttcagctatgaatataaatgaaataatcgtgagcgaaatctgagaacaccaaatacagcaggaagtagggtttattttaggatttccaggtgattgaacatgagaaagtctgtcactgtaattcaccacattgtgattaaaaactaaattctcaccatagtaagtacagaacagtcatttggtaaatctaatatgcattatgaccttttgaaagtaattataattttgatgaaaattattaagaagacccatataaaagcagaggtatcatcttcatggagaagatgcaatatcttaaagatactaattgtctgcaaattttgtagaatttgacagtctgattctgaaatccaaatggaagcataaaggacaaagagagtcaagacaattttgtggaaaaactaggtgggagacattcccagccacacagtgtgaattattatgcacttacagtaattaggataatatggtagacaaacagacgatcggaacagaagaaagtggaaatttatgcatatatggaagcttgagagcaggtaccacagatcagtggggaaaagattaactattaaaggccgggcgtggtggctcatgcctgtaatcccagcactctgggaggctgaggcgggcaaatcacttgagctcaggagtttcagaccagcctggccaatatggtgaaacaccgtctctactaaaaatacaaaaaaattagccgggcgtgtcggcgcaagcctgtaatcccagctactcgggaagctgaggcaggagaatcgcttgaacccgggaggcaggggttgcagtgagccgcgatcgtgccactgcactccagcctgcgcgacagagtgagactccgtctcaaaaaaaaaagctaaaacattaactattaaaaatggtgctgacttaactagttatgtatatgagtctagcataggattactaacctgccactacatataaaaatcacttctatattaaaatacctaaatgtggaaagcaaaactgtaaaacttatagaaaaaaatataggcgtatgcatttaagaggttggcgttggaaggatagcttaagagaccccaaaagcacagattgctaaagaaaaggtatataaatctgactgcatccaaatttttaaaaaccccaaagtttttctttctgaaaagaagttcttaaaaaagtgaaaagacagctatagtgtagaagatatttacaacaaacatttagccaataattagtgtcttataaaagattcctacaaatcagtgagacaaagacaatctgttagaaaaatggacacatgacagaccactaacaggtgaggaacccgaggtttaaaagacacgtgaaaagctgtctggtttcctgctgtttttgctcaccagtcatattggcagtaggtaaaaagtgccagttagccatattgacaaatgtctggagctatgggaattcatatattgctggcgggagtttaaatttgaaataggcatttcggaaagcagtttaatggagtttgagctactctttgacccaggaatttcactctaaatatatatgatatggccaggcatgatagctcacccctgtaattccagcactttgggaggctgaggcaggcagaccacctgaggttggggtttcaagaccagcccgaccaacatggagaaaccccatctctactaaaaatataaaattagctggatgtggtggcacatgcctgtaatcccagctattcaggaggctgaggcaggagaattgcttgaacccgggaggcagaggttgcggtgagccgagatcacaccattgtactccagcctgggcaacaagaacgaaactccgtctcaaaaaaataataataaaaagtgtatatatatgtgtgtgtgtatatatatatataatagacaaaacttgcccatatatatacaaaggtgtgtttacaaatggtcagagcagcatgtttatagtgcaaaaagttttgtttgtttgtttaagacagaggggcagtggtggttctgtgggtcttggcccctttctgctgtcagggctgagttggctccatgagttggtgaaagcggtatctagccaggttcaagggagacaggggcaggatttcgccttcactgatgggcaggccagcggtcccctgtggaacggtgactattgaatattgagaggacagtatccctccctgagcatcttctggagcttgatgaccactagggaatgtatctgagtcacgcgcaccaaatgtgttaccggtggcagctattcgagttatcccgagttcgtgctggtgtatccgtacagttctgcagcaacttcagctcttgcctcctcggaagaaagaattggactgagggccataaggcagaaggagagactgaggcaagtttcagagcaggacggaaagtctagcaaaaagctctagaacagtaaggaaaggaaagaaggaaagtataacttggaagagagccaagcaggcgacttgaaaaaccaagtgcactgcaacaagtatttaaacagtgatctaaatgcccatcagggtgaaaggataaatcagtatagttgcatgtagagtatgcatagtcatagttcataaaacaatgatatacaagcagtgaaaattaataaactagagctgtagatagcaacatgttttcttgttttgttttttgtttgtttgtttttttgagacgaagtctccctctatcccccaggctgcagtgcagtggcgcgaactcggctcactgcaacctctgtctcctgggttcaagtgattcttctgcctcagcctcctgagtagctgggactacaggtgtgcgccaccatgcccagctaatttttgtatttttagtagagacagggtttcaccatgttggccaggctggtctggaactcctgacctcaggtgatccgcccacctcgacctcccaaaatgctgagattacaggcatgagctaccgcgcccgggctggaagaattttttaaaacactgttcagtgaacaaaaacccaagttgcagaaggatgtatttcatacaacaccatttatatgtgtctgaaagcaacacaacatatatatatatatgtaatctaatacatacatacatataatatgtattacatataatccttatatatatatagaatcttaatatatatatttaggtcaggacatttagatcactgtttaatatatatattaggattatatataatatatattatattattatgtattaattatataatccttatatatatattaggattccatgcaaatgaagtaaaaatataaagaaataatgcaaactacgaaccaaatccgaaaagcatttattgaggcaaggatgtggatatagatggaaaggaaacctagacaccttcatgccttttttcttaaactgggcaataggtgttgtctaggtatgttaggttattgttttccatttctatgtctgaaatgattgtttttcattttaaaaaatgatggtacagctcacagatctaaagcaaagtgaagttttaaatgaatgcattaagtacaatcagtaactacagaatgtgatctaaaaatacatgttcctcatgttgcagggtgagaatggaaatgaggagtaaattgtaatcgtgccagggaagccaggtgtctcagcagatttggaatctttgcatggcaggtggatccaatttatgtaatgcttgggttaagacagctcaggaaggcagccttgcaatgaaacgtgaacctgtgtgcgtttttagcagtcaccacatggtggcagcctatccaagaaaattcaagggcaatagtttgcacttgagagcccagaaattttgatttggaagctcagtggaagaggaaaataaaccgtgccctgcactgaacagctgtggtgaagagagaaaataccttccttggcaattgaatgttttcgcagctgtcacagatacttttgctagttgtatctatatttttgaaaaacaaagacatttttcaaagtacttttttattacgggaataaatcaccttgtctctgtactttgggatgaatctcatctgaactttgagaacgattaagtggcttcactttctggagaatctggtcattgggtaacattcttgttttcatatggaccagaaggttctctttcatagttgatgttgcacacacgtttttttccctaagtccttggtatttatagtggcaccattgcgaatgttagaggctatcaactttcattcttattattgcttcatctttgtagccaaaaatatgggaagaaatgttcatagccccgccccatacttgtccccctctacctggcctacctacctacgtcaggctcctgtcccaccacaaatgacagcctgtgtctttcatgttagcagctagtctttcactagccacatacttccccgtaacccatatgcctccctgtgtctgcctgacgtttgaattgtcactattctgttgttgtatttttacaagaagaatgtatggggcagaaaacccttgccattcatttcctgagtaggaattctagccttccttggagtcgtggtaatatggagacatggtaatatgtggattgtaccactcaatggctgtctggaggccacagtggtgcaaaaagccacctaggcatgggttagtgtcctggggcacccaatcaggacaggacacctggcacacccttggaaaagcttcactgtgaaaaacactggaagtaaaaattttaacaacagatagggatttttttccccttgagacagaggctcactctgttacccaggctggagtgcagtggcgcgatctcggctcactaaagcctctgcctcatgggttcaagagattctcatgcctcagccacctgagtagctgggattacaggcgagcaccaccatgcctggctaatttttatatttttagtagagatggagtttcgccatgttggccaggctggtctcgaactcctgacctcaagtgatccacccacatggccctctcaaagtgctggaattagaggcctgagtcactgtgcctggcccacatggggatttttgttgcccagcttaatcaaccaagaataaaagtgcattttaagattataatctatttaacttctccttattggcaatggtaaaagagttaaggaaaaaagagaataagcttaggattatggctactaagtagaaggacgttatctttgacgggcatttctgttgtgcttatttgtacctgacatggaacaagacccccccatcccctcaacacatacctgctgtgggacatctggctagagatttccaaagctgagggtgaaaggtttgggcatcggtgtgactgtgtaacactagagttctatctaccatctcttaaactacaggtagtcttaccggtgtgggctgaccttccggttatcaggcagcctgctgcaaccactagaaactgcctttgaaggtttccagtccggcacaacatttgtgttctcattaaacagtagagcataggctttggggacacacagctctgggctcaagccttagctgttgctgctctgagcctgttccctcgcgtagaaaggcaatcataatactccctactttatggggcagttgtgggaatggaattaaatgctaatgtgggccgggtgcagtggttcacgcctgtaatcccagcactttgggaggctgaggagggcagattgcttgagcccaggagtttgagaccagcctggcaacatggcgaaactccatctctaaaaaagtacaaaaattagccaggcgtggtggctgtagtcccaggtactttggaggctgaggtgggatgatcacctgaatctggggaggtcgaggttgcagtgagctgagattgcaccaccgcactgcaacctggagtgcaggctggaggaagagaaatatatgggtcaattaggcaaatcactcagatcgtaagtagatatactagtaaaatagcgtgacttagggtccttcactggaagcctggtattaatgcttccattgtgtgggtgggggaaggagagagtgtctccagctctctgtctgtgaggtctcccagccgaatattggccaagggagtgaaaccagaagcaagactaccatgagacaacgttccagagaaaggagggactaaccagagcaggtgcccagctttggccagtcaggctcatcttccagtcctcagtagattattatcaactttaagtgatgtcacagactcccttcctccaaagctgtggacctcttccttcccatgcctcttgttacttggaagtcactctacttccaaacatgtcggctggagatccctgatgggccagttactactttcaggctctgtaggtttaaagaatggttatatccagttagttacaaatagaaatcgatcctttctctgtccgtctgtctaaacggaaggatattctgtggacgctgattaggtataaaatctccacggagcctgagcatgaagaattgaccttcttagggttccacagaaaccagaatagacttctgtgtttggtagctttgtaacttacgcccgttgaggtgtacggttgaaaattgagaataaatttcctgttctgtttctgagcatcttttccaggcttggagatgcgttgagcatttccacggagaccctagaggtggggaggggaagaacgcctgggcatttgtccaaattagccatatgctgtggagtgtcacatgtcaggaagccaaggcactggagctagtgtttttgggcagggctagggaaccccccgcctttcctccacccaaacgcaggcccccacacccagcgtcctgggccctgcaggggaatgacactgttggtttcactctcaggaatgagcctagatttggaggtaacctcttcctgaccccgatgatttcactctgatgccaaaaccagtctgaagtgggtgtggttttgcatttggtgtttacaaggtggagtggtgccctctgcacggaagggagaggtgggcaggtacggcagggccctgctccctcgggagtctcctctgaacctgtggttagggcacagctggacaatgctgaaatggtctccagctgggagatgaggtaaacctcagctgcatgccgaagaaataacctagaaatcagagaaccgttttattttgtttttctcagaggatctcatttctccctctcctcctgagcacagagaccctcaaaactggtattcacagaaggaaaaaatataggtctttcacctttgaaggatcaaagtgtctagggttttttgtggttttttttttttttttttgaacaaagctgaactattacaaagtccttttcagtttaaatttagtgcatggcatggctcatgaaagacttttaaaagtgaattggaaaattctaaatgtacttgtattatacatgtgaaaggatgacttcttaaaaaaagaataatgtctgtcccaaacgggagaaggaaggaactctagcttttaaactgcactacattagtgagttacatgacaattctccttttaacaggatggaatgcacttaaagcagtaatgtgctatggtgacagtaatgacagacaatgttaattgacagaatggctactctgaaccaggcactgtcttgtactcctgttatctcagtggtcttcacacttattctgttaggcaggactgtcatcctccccacattacagatgaggaaactgactgaggcttagagaggagactttgcaaagatcatgtgattaaaaaatggtagaggtggcaaaacagcctgtgtttttaacactgtcccatgtcagctcttattccagatcatcacataaagtctaatctctaatcttgaaaaccgaaaagcacctgccacctcagataagagagaccaagaccctagacattcgacttgtgttgaattcactcttattttgttttgatgtttgtaatcccagagccatacttgttaatgagctgaagtagagtgaatgctgtcccctccctgaggcctggggctcatcatcagctctccaggctcccctttcagaggggatggtgagcaccttcggagagggcagggatggacacacaagacagcctcagttatgtgagttcatcccctcccctgcctgctgtgggtgagatggagaaaaaagcactggaccctcctgggcatcacagccttgtacttagcgagtggctgaggtcatcagtagcccaggtcatcagtagtgtggaattaagtgcactgaatagtgttggcccctgagctttgtttgacagatttagggggtcagctcaccactttcccctcttgcttctgtctgatcattgctctgtttgttaataccaaggaagaaagtgaatagaactttttagagagccaaaaaaactttattagactttatgccattcattatacttagcagtgttgagggaaggatttgtgagacgatatattcaaactaatgggcatgagaccaagaaggggctgtgtggcgggcgcggtggctcacacctgtaaccccagcactttgggaggccgaggcaggtggatcatgaggtcaggaatcgagaccatcctggctaacacggtgaaaccctgtctctactaaaaaaaaaaatacaaaaacaaaattagcagggtgtggtggcaggcacctgaagtctctgctactcgggaggctgaggcagaagaatagcatgaacccgggaggtggagcttgcagtgagccgagatcgcgccactgcactccagcctgggcaatagagtgagactccatctaaaaaaaagccggttggggtgggggcatgtaattaacagactgattggtcttaggtggctcagaatttaagctgagaaattaagattgagaagaaatgatgtattgtcgttatatcaaatatgtgagtaaaaacataattaaaacaccatctatctccagttttcccaacattacctcccttttatgatgcccttcctgtaccttattaggcaaaatattctaatttcagtctcattggattatgttctaaatgtttgaaggttggtctgaacatggaatgtattttctcatagatataatagtataaatggtgttagggtcatgggattgcgaagccagttccactgcagtagaatcatattgacttgctttccgatttttctgtgggaaacttcatctggagctttaatgcacttcttagctgtggggtaagtttcagcctccatgacgcttgtgttactttgtagtcacctgtggccaaccacaaataaatctttgtggtcatcaggggccagtgaagtgtatactgcacaaaagagagcctaccccaattctggaagaagggctgcaggcctgtgtcccacaaagaacaggcaggaagcatcaccttcagcccactggcagcaggtcatctcccatttgcttttctgcactatcagcagagtctggcttccttttccaccccctctccaatgtgaatgctttttaaggtcgtggaattagaatttaaaaaaaaaatttttttgagacagagttttgctcttctcgcccaggctggagtgcaatggtgcaatctcagctcaccgcagtctccgcctcccaggttcaaatgattctcctgcctcagcctcctgagtagctgggattacaagcatgcgccaccacgcccagctaattttgtatttttagtagggacagagtttctccatgttggtcaggctggtctcgaactcctgacctcaggtgatccacccacctcggcctcccaaagtgcagggattacaggcatgagccaccgcgcctggccagtattagaatcttttaatgggaacgtcttaaacataacctataacaatgaagcaccttataagtgtgtggagatttccttttcatggcttttcatatatgcctcgcactcacccagcaaccctgcaaactggatgttatactcaccagagagccttgaccctgattgtcactggcaaggagcagtgtctggacttgaacgcaggtcgcaggactccactcatggtgctctccccactgcacctcaattcctcacttttcaaaggaggcagcggaagcctggagagtttctcaaaggaaacggaatgcagaaatctgtctgtgtgcaatgtgaggctcagaactgaaaaccataaatgtcaggaaatgcaaagcagaattttcccctgcaacggcagtttgcatgaatatgaagacgctgtatggatgaaagtttgtggctgcagcatgagcataaatcctcggggctgctgttcgtctaggagcctgacttgcctggtgttgccctgagaactgcaacttgagcatttccttaattttgtactaaaggaaccaaaatgaggtattttggttctaagtctttgtcatgtgaaggaagcttcctgttaccaccccccatctacatacacattctctttcttagccccacgtttgaattttatgtttttcctaaagtatagggaagattattattattattattattttctttttcagacggagtctcgttctgtcaccaggctggagtgcaggcgcgtgatctaggctcactgcaagctctgcctcccaggttgaagtgattctcctgtgaaagggaattatttttgatgagtcattaaagtatatccattcccagaatggtgctgcatttttccttttatcatctgtcatgacttttttaagtgtgaagcttacttccagaggaattgtcttttctagcattttggacacaactaaatatctttgatattttcttctcatatgttgagcagtaaattaagttgaatggtgaagtcagaggtgaacttaggaacatttagaaaaaggaaggtcatttattatttttcaggggaaaagtttggtagaaaaatgctgtaatcctaattcccagatgtccatttggcttgtagtcattttgatttatgaaataatcataagaaatgtcttcaaattttaaaagccaataatttgttctactaatcacagatgagagtagaaataaaagaaacacacccaattcctgaaaggaaaaaaattctcccaggatgagatcactgggtggacgtgaagtgggtaaaataccttttgctgcaattgtcatccccttatcttgccaaagtacgacaacatctgaatgaagatggtttgatgttcttagtttagagtagttatactattattttaacattcctatttaatgatatgttttaatactgcaggggaaaggtagatacagattcatagctacaaagcaatactcttatgatcaatgttcatttaatttcaaatacaaagttagacattcagagttaaaaaaaattaatgcataggctgggtgcagtggctcacgcctgtaatcccagcactttgggaggccgaggcaggcggatcatgaggtcaggagtgtgagaccagcctgaccaacatggggaaactccatctctactaaaaatacaaaaattagctgggtgtggtggcatgcgcctgtaatcctagctactcaggaggctgagacaggagaatcgttgaacccaggaggcagaggttgcagcgagctgagattgcaccactgcactccagcctgggccacagagtgagattccatctcaaaaaaaaatagatatatatatattttttatattatattatatattatatatttatatttttatatatataaatgaataaacaaggcatctgcttatgaaacagtctgcctgaatgaaatctccatttgcaggcaacacagtctacagtaatggcaggactgtattaggcatggttcctaatgcccatttctgtagcaaagtcaccagtagttcctaattgccaaaagtgagtcaccggtagttcctaattgccaaaagtgtattttttgcttttatcttgcttgaccacagctgtcatataaacctgttggccacacccttttcccttagcctgaatgaaaatgccccttcctgcccttcgtagctcctgagccaccaggacatggtggtctccatcatctgttcgttatctctaaccatttaagattagtgctccccaaggatgtctgttaacctgctttccttcccattctgccagtttcccctggggaatccacacttctggttttaaccatcacctaaatgctgtgtgtcccgacccgcatccgcatgctcccaggccattctcagttccagacccgggcccccagcttcctgcagacgcctcctccaggagatctcagtatcttgcttttcctcctaccccttctaaggcattctcaatccagcttccagaggaatcttcctaaaacacatctgactgtgtgagccacatactgtagcccaacctgacagcttcttttctatattaagaaaaagtgcggccgggcgcggtggctcacgcctgtaatcccagctctttgggaggctgaggcgggcagatcacgaggtcaggagatcgagaccatcctggataacatggtgaaaccctgtctctactgaaaatacaaaaaattagccgggcatggtggcaggtgcctgtagtcccagctactcgggaggctgaggcaggagaatggcatgaacccaggaggcggagcttgcagtgagccgggatcgcgccactgcactccagcctggacgacagagtgagactcgtctcaaaaaaaaaaaagaaaagaaaagaaaaagtgcacacattttgacatctgagaaaagtgatgtttttcttagaaaagtgacatctaactctttatagaaactttgccacaaggtagtctaggagtccccttactacctaagattttcatggacatgccctgtctgatcataaagcatgtggcacagtggctcacgcctgtaatcccaacactttggaaggcccaggcgggcagatcacttgagcccaggaattcaagaccagcctgggcaacatggtgaaaccctgtctctacaaaaaatatttaaaaaacaaaatgaactgagcatggtgaagcacatctatagtcccagctacttagaggctgaggtaggaggatcgcttaagcccagaagtcagggctgcagtgagctgagactgcagtgccactgcattccagcctagaggacagagtgagaccccgtctccaaaaataaataaattaattaaataaagccttgtgaagaatctgccgtggagcataatgtaacccataaagccacttaactgggcgcacataaactacataaactacagtgtgtcccagttcattgagagtgaaaatcaagcaagggaccacctcagtgtggtagagccccctccctgccctccagaccctgctctgttctctgtgtctgaccattgactggccatcactcaggcactagttgagaatgccaatgtctttagttattgtaatttcagaagcacatccttgctggacaaagaacctacctgttaattttttaaagtaatgttcatcattttgaacattgttttctttcttttttattcagctgaccctcatgaggaatttaacttggttttctgaactgtgttggtaacatttgaaggacatagaaacagttttcataggtctcaagtgatataaaccacaattctttagaaaatatctttttttttttacccattctggattttgaaatatatacagatctcatacctcagattctcatatgatatgaactgtttcaaaacacattgatagcagaagatacatactgtcttctagtcaagagggtagcgctgtatttagtttaaaacattttaatgcattttatttgctaaatacaaaattataatattctgtataactttccaaatctcatctgtcctccctttcccccatctctttatattcagatgcttgtccctccagcttaaaaattcatgactttgagaaaattcgtcttcatgttatctaaactactgcacccccacacgctccctgttaagtgtctgcatatctgtgtcttactgttgtttaaaattcacttgtctgcctggggagtggggtggtttgctttaagctgctccactcaagtctcagcagagaaagcaataatttgttatgagatagagttttaagccaagctttggccagggtctctcccatttgggaggaggaaaataggaacaagtgagatgataattttccttgaattttagctcattaaaatcttcccttgtcctgggcaggctatttactgatttaagcatctagcacttttcctttccagaaagaattaacatctatgatgcaatcattgctaagggaggaggtttttgtgttttctctgtggaattagctgttctccagttgcagatgagcacagcccactttagagttgtgtgtaggtatggagttgaggggtcggaatgagatttccaagatttataggtaatgaaaagaacaggttgtatcaaagacaccacgtgtaggaaactaactgttcttaggggacttgtgtgaacctgtgatccttggctttctccaaaatgaacatttcagccttgttcatattaacctcctttttacagttgttttaccgtgttctggttttgctgctattctgcctgaaaatctagcaaaatggcgtttcttatctgcagaactgcgacaaagcttaaacatttgtatttctcttgaggattactgtggttgaatttttgacagtactatatataaatgaagaaataaaattttttatacagatgtttaaaatcctctttccactagaacatttctttctccctaaatatactattacctggaactctagctgtttttcagatctgtagagatcataggtggcttaagggactagattgctggtgatattggctgcaaaattttttttttttttttttttttttttttttttgagacagagtcttgctccatcgcccaggctggagtgcagtggtgcaatcttggcttcactgcaacctctgcctcccaggttcaagtgattctcatttggctgcaaagttcttagtgaggtttagtggtattttggccctgtggcacagaagaatggttatttagcaaatgtgttttgcttttgattttgttttgtttttgagacagggtcttgccctgttgcccaggctggagtgaagtggctcgatcacagctcactgcagccatgacctcctgggctcaagcgatccttccacctcaacctcccaagtagctaggaccacaggcatgcctcaccacacctggctaatttttattttattttatttttgtagagacagggccttactatgttgcccaagctgttctcaaacttttgggctcaagcagtcttcccaccctggcctcccaaagtgctgggattacccagcatggcagcatgagccaacaggtctggcctcggcaaaggttttagtagggctttctcttttcttttgaagatgattaatacagtagattcatacagccagaagctgaaaagcagggaatactgtttggcttattaatggataatcaatcagtgttaatacacttttccctatttacatggtcaaattgatcaaatatttccaaggtattagcttttaaaagttgactttgtcagctctatgaaaagacatgcatttacatttttatcgtgctcctcctctgtcaggggacttggatctgtccttgatcttggcttttctgttcataaaccaggtaggactgtcatgggtttgctcccattaccatctcttgtcccaagatttctaaaaggcatcacctgatgcacccttttgcccaaatagtgttaaaagtcctcaggctgaggagctgtcctggttcttctacaggatctttaatgatcagcctgtctaagctgagaatggataagggtgtccccaacacgtttatttggtggtttggtgggggtagtgacactggggatgcttttgtgtgttgtaatctgcccctctgtctgtttgaccccagagactctgtggttagttgcaggacatcaaaatacgcaggaaagacagtgggggaagagaccatcagtcgccctcttgctgcctaggttcactagaatctctaagactgaattcactaggagacacaggacataccgtagagctgtttatgtcttgagagccccagtttcctagtctgttaaatgagcatagtaacaccaatctcactcctttggaatattcaatggtgtaatacttacaacatctagctgacctgtacaattatagctattctcttctgcaagtctaatattcctattcacccctccctctgcatagggatccagtttgaaatcatcagttgctcagtagggcctggggagctagctggtcattctttggttaaagtcaaagccaacctctttgcctacctttttgtcttaatgtcaacttcctaccagacatgttcctcccgcactggatgatcaaaatgcaaataggatggacacgatcaatgcattttgttggagtggttgcattctttctactttcttagggcaaaaaaatgaatggttggacaagagactaaccaaggcctcaaagaaagtgaaattctttctcaagctcctgaaagtcctttcatgggtatagtaacagttctataggggtctcattgtgatggtgccattatacaggccagcaagccccctgtgtgagccagacctcatggccttagcccttgttttcctctttttttttttttttttttttgagacagggtctcgctctgttgttggagtgcagtggtgtgatctcggctcactgcaacctctgcctcctgggttcaagtgattctcgtgctgtagcctcctgagtagctgagattacaggcccccaccagcacgcctggctaatttttgtatttttagtagagacagggttttaccatgttggccagtctggtctcgaactcctgacctcgtgatccacctgcctcagcctccctaagtgctgggattacaggtgtgagccactatgcccggctgccccatcctttttcttgatattatagttagtggtgaaaacatgtaaatgataatactccatgcagtatgtatgctgaagtgactaccctgaagacattttttaagtcctattttcttttctttctaggatatgataatcattttctgtttgtattaatacatgcttgaaaggaattagtaaagcgattccatccttgtcagcagcttggaacaaagctgtggatctgggattgtgtagaactcatttgacatcagtagttacttgtgtctttatgcctcagatcaagatgtgcgtgtttttttctttctccttttagcttcacgaggctgacattgtggtcctaggctcacctaagccagaagagattccccttacttggatacaaccaggaactactgttctcaactgctcccatgacttcctgtcaggtaaatgtcttcacattggtgttgagccactgattaggtcagatagttcaaagaaatgttaaccttttcctaagaggttatgtttctgaaatgttagcagtcgtcaacattaatatatagggtaggaaacttagactgtgggctacctgatagaaccatgctgttgagcaaagagagaccaagatggcggttgaggtgtctgctcccacagtgaagtgccccctactggcctctagcagtcaggtcagttgtgacctcaagtagatgatttgtatgtgtgtgaggtaaactagaaatagcggttttcacagtttcttaaaaattagtaaaaccctttcttccaaagaaatcttcgtggaatctcactatgtaaaagcagatgagcgccggattgttgggagggatgggaataggatcagcctgtgtgtctccctgatttcctcttgcattgacccatgaagcacatccttggagccccagagtcatctcagaacagtatgaaaatcaccactagatgcagaaactgttgtaggattggtcctgctatttgatggcattttgccaaggtatccaggaatactcaagaccacaccaggcccactttgggggcagcccaagcagtgcccgcaacagggcagccagcagccccgggtccagcaggagccggcccagagtgggttcctttttccagttcgtagaaggactgaggctaagaaagccttggagcacacccaggccctcagcaagtccctgagtagcacaggtgagccagagacgatggcacagggaggcagaggagagcccctcttcctgattccttctggctttggcctccaaatgtttgtgtggaagagaggactgtgctgagctgggctggaggacaggggcagcttttatccctaaagctgggcagaacatgcaccaaggttggcagcctctgctctccttctcctccaccaggaccatacttgaggttgaaatcttgaaaccttgtaggcagctccataaaagcatgagccctagccagaggttgttactgaccctcctctctaggaaatgtagctcctgccagaattgaccgatcagattaaaaaccccttgggggctggagagggtggaatggaacagagtccaaggaaagaggcattaagagctgtggccctaatggctctttttaacaaacagaaagcatgtactaaataacattttaaaaatatgtgtaatttattcatataactttttttcccctgaaaaaaaaaaaaaacaaagcctaacctattaatagtggacagggcttcctctgttcagcatcccagtcagattaggaaaatcagttccaacatttgtttcttgtaaatgaatgctgctttgctgtaatatttacttgctgtgttttattaaagttttcatgtaggacagttttggcagtcatggctggagataggagtctactttgatgttctggaatctctttgagctctgtggttatatgacagtgacatatattttgttagtgaaagtgctttatttttaataaggtttccttttaggacccttatttttgaaaaaaagtattccctgaaatattagatatcaatgtaatgattctctgggggaaaaaaagaccaaggcgttacagatgttcctcgactgaccatggggttatgcacagataaacccatcagaagttgaaaatatcattagtaaaaaatgggcatttgtagccaggatgggatgtgaaaacagaaaacaacgtccaaaaatgctggcagcacagtacgctgtagagtattggttgtttggcctcgtgattgcatggctgaccggaaaccacgatttgctgtcactgctgcccagcgcctcaagacagccttgttctttgtatagctggcctgggaaaagatcaaaatttaaagcacagtttctactgaatgcatgtccctttcccaccatcataaagtggaaaaatagtaagtgaaaaggttgtaaatcagggatggtctgtgtatttcaaaatgattctataagtagaatttatttgaaatttatctggcccaactgtaatagttttcttgttggtttttgaatgcccagtgtccagaatagtacctgacgcttagtaaccgctctgtgaaattttttttttttttttggagacagagtcttgctctgtcaccctggctttagtgcagtgggtgtgatcttggctcactgcaacctccaccttctgggttcaggtgattctcctacctcagcctcccaagtagctaggattacaggtccctgtcaccacgcctggccaatttttttttttttttgtatttttagtagaagtgtggatgcaccatgtttgccaggttggtttcgaactcctgacctcaagtgatccacccacctcggcctcccagagtgctaggattacgggcatgagccactgggcctggctaactctgtgaatattgagtgtttgacaagttaataagcatgaatcaaaattctactctgcttgtagttttaagttagtggcatgtttagaaacatttccttgaatttgtctcccacttaaagatggggctgatggccaggcacagtggctcacgcctgtaatcctaacactttgggaggccgaggcaggtggatcacctgaggtcgggagtttgagacctagcctggccaacatggtgaaactcttgtctctattaaaaatacaaaaaaattagctgggcttggtggcaggtgcctgtaataccagctactcgggaagctgaggcaggagaatggcttgaacccaggaggtggaggttgcagtgagccgagattgcaccattgcactccagcctggatgacaagagcttttttttttttctcaaaaaaaaagaaaagaaaaaaaaatgggctcaactaggcagtcattgagataaagatgaggaatgctatgttgatgaaacagatgaacagtttcggggtggtgctacccataatagcacatttctaaatagtctacaagttttaattttagcaactttgtttagtatgaaaatttgatctaggaataatggagaaaggttttttttcccctctttttttcataatcccactactgtaaagaaatgaataaactttttgaaatattaaaaagaaaagagctcttatttaaacttaagatgagaagaacttttaataaacttgtggctgggtgaagacagagttttataatgaaatttttattcttaccttcatggtacagagtccctcctccttacccccgtaaaaatagatgggatgttgtgatttatgatgaggcaattctgtagagacattttatggaatacgtaatcctaggagagattttcctgatggctaatatcccagacacagagctcagaaaacaattatacccagctagttggttctgttcactctactattgcatgagtccaatgtttagattttaaaacaaggaaatttcaacattctgttttctagctgtaagagtaactactttaaaaaaaaaaaaaaagacaaccaaaaaaacctatttcttagaaaaagtcttgctctgttgcccaggctagagtacagtggcacgatcacagcctcaaactcctgggctccagcaatcctccctcctcagctaattaaaacaattttttttgttgttgttgaggcagggttctcactgtgttgcccaggctggtcttgaactcccggcctcaaatagtcctcccgcctccacctccaaaaagtgctgagattactggtgtaaaccaccatgtctggcctaaaaaaattatttcaaatgaaaaaactacgcactgctcttgtagtgccctgcttgctaaacagcagatttcatcataagcaaaatcattttgtaccctaaatattaggacttatttactgatgtaacaaatgggaccaaggagaagctggtcttccgtcttaggctcagaaaacagtatcaaaacagcaactctgtggctcagagtaatttatagcatcattttaagctaatgtaattctatttagtgtggaagaggggaagagccctgggatgctgatgtgctgggggtcccgagggaccttgagactttctctcgtatggctctgaagggagacattagaacttactggaggctgggcgtggtgtggctcatgcctgtaatcccagcactttgggaggccgaggccagtggatcacttgaagtcaggagttcgagaccagcctgagcaacatagtgaaacctcatctctattaaaaatacaaaagttagccgggcatggtggcaggcacctgtaatcccagctacttgggaggctggggcaggagaatcgcttgaatccaagaggcagaggttgcagtgagccgagatcacgccattgcactccagcctgggcagcaagagcaaagctccatctcaaaaaattaaaaaaaaaatgtagtggaaagaacatggactttggagtcaggattaacctaactcaaggacaagggagctgtttttgtaaaaaaaattcttggccggatgcggtggctcacgcctgtaatcctagcactttgggaggctgaggcaggcggatcacctgcggtggggagttcgagaccagcctgaccaacgtggagaaaccccatctctactaaaaatacaaaattagccgggcatggtggcgcatgcctgtaatcccagctactcaggaggctgaggcaggagaatcgcttgaacccaggaggtggaggttacggtgagctgagatcgcgctccagcctgggcaccaagagcgaaactccatctcaaaaaaaaaaaaaaaagaaattcttaattgcattgcacttacaggctgtgtgactttgaggaaataagctctctgattaattaataagattcccaatttctttgtgggtaaattgggagcaaggctgttgggaggaatgactgagatgatacctcggggcagtgcctctttgatggtagctgccaataaatgctggtccacttcctgcattcctccctccacttccttgttgccatgtcacctgcacacaaaacagctttcagactccatcttggcacaatatacatttatatttgaaaaatcaaacccaagaaaggaagaagtccaatgaaattctgaacatgtaagaaaagtcagctttagagaaattggacatccgtgtaattttcattatgccaaagcaattgatataaaattaggatctttgcttgtgactcttgaactttagtaattccaaaatccattgtacctatcactgttttcttttatttattttttcctgtaaattctggatattctagatctatccctgaagtatattgccagttttccatttcaaattttaattagttctcaatacaatgtatttaatattttgctttttttaaaaaaagtaaaggttcatgtcatttagaatatgcagcactgtataaatttccttgttaatttggtttcagtggtccaaattaagttattactaatagcttattagtatcagtttactaatattttaatttttttaatcatgtcttacattgcattcttttaaaaactagtgatatgctgtcatttgacagtaagaattcaaataatttaaactaggattgcaactctcaagaacactgtcacaaaaattttaccaaatgatatgtattagtccattctcacactgctataaagaaatacctgagactgggtaatttataaagaaaagaagtttaattgtctcacacttccacggactgtacaggtagtatgatgctggcatttgcttggaaggccttctggaaggcctcaggaaacttacaattatagtagaaggggaaggggaatcacatatatcttacatggccagagcaggagcaagagagagggagggcgtattagtccattttcgcactgctgataaagacatacacgagacggggaagaaaaagaggtttaattggacttacagttccacatggctggggaggcctcaaaatcatggcgggaggtgaaaagcacttcttacatggcagcagcaagagaaaatcaggaagatgcaaaagcggaaacccctgataaaaccatctgatctcatgagacgtatttactaccatgagaagagtatggggaaaaccacccccatgattcaaattatctcccactgggtccctcctacaacacgtgggaattatgggagtacaattcaagatgagatttgggtggggacacagccaaaccatatcagaggaggaggtgcatactacatacttttaaaaaccagatctcaggataactcactcactatcatgagaacagcaccaatgggatggcgctaagcctttcatgaagggccacccccatgatcctgtcacctcccaccaggccccacccccaacactggggattacaattgaacatgagatttggtggagacacagaaccaaaccatatcatgatactcattttatttattgcattttactttatatcctacaaagtcaatatatttaactgaaaaactggctaccagtgtttttgtttttttttttcaagttctacctgtactgatttctaatttttagccattcctgattttaaaacctcgcatacattttggggataatttgttctcctagatggcgagaaaatatttaagtctgtgggcttggagaatgcttttttgataagaaggatgcccttggccagactgcatagaagctgagatgtttccgcagagccgagatggcatgaaggctgaagaattttcctgcatccctcccactgcagtgattgttctggcaaagttcccagggtggtctctgcactgctcatattagtgaaagggtggttctgatttctgaggaaggcatgataacactttggccttaaattttctttttgcagaaagtttgattatcattagaagaatggccatcttttaaagtgattcattgacttgtccctggagaaatcatgagttagatgagagtgtttagtgggaagtgaaaagacccgtccacggtttcggatgagatcctcgttggactgtgatcccaggatattacccaggcccagatcgtagacaacctcccaatggagtcctgcccctacacgggcagggggtgaaataatgattccctttcttaattttctttagccatgaaatttattaaaaatgtatgtctgattctgagttgccagtcttaattgcttgagattctctggattcagaacttatttttattttttttatttttattttttgagacagagtctcgctctgtcatccaggcaggaatgcagtggcgcaactgcaggcccactgcatcctgagctcaagcgatcctcctgccccagcccccaggtagctgggactacagacatatgccaccatgcccaactaatttttttttttgaggcagagtctcgctccctcccccaggctggagtgcagtggcatgagctcggctcactgcaagctccgcctcccgggttcacgccattctcctgcttcagcctcccgagtatctgggactaaaggcgcccgccaccacgcccggctagtttttttttttgtatttttagtagagacggggtttcaccgtgttagccaggatggtctcgatctcctgacctggtcatccgcccgactcggcctcccaaagtgctgggattacaggcgtgagccaccgcgcccagtcccaactgatttttgtaccttttctagagacgaggtttcaccaggttgctcaggctgctctcgaactcctggacttaagcaatcctcctgccttggcctctgaaagtgctgggattacaggtgtgagctactgcgcccagcctgaatgcagtcttaaaactgaattagaaaatctgagtgcaggctagagttatatataattaagagagtgtgggttttaagttgtgtcttaaaattgtgttgtttttggtcgagtctggtggctcacacttgtaatcccagcactttggggggcctaagtgggctgattgcttgagctcacgagttcgagaccagcctgggcaacatagtgaaactctgcctctacaaaaaatacaaaaattaagcccaggtgctgtggctcatgcctgtaatcctagcactttgggaggccaaggctggtggatcatctgaggtcaggagtttgagaccagcctggccgtggtgaaaccctgcctctactaaaaaaatacaaaaactaaccaggcgtggtggcacatgcctgtagtcccagctacatgggaggcagaggcagaagagtcccttgaacccaggaggcggaggctgcagtgagccaagatcgcaccactgcactccagcctgggcgacagagcaacagtccgtctcaaaaacaaaaaacaaaaattagccaggcattgtggcatgcgcctgtagtcccagctacttgggaggctgaggtgggaagatggcttgagcctgggaggcgggggttacagggagctgagatggtgccactgtactccagcctgggtgatcgggccagaccttatctcaaaaaaaagtgtttttaattacttgtaattttaattgcttgtaattaaaaaacagtaattaaaaggaccaaaagttaattttgcaggtagtaaaccttagcctactgtacgtaaaaatcagaaggccaaggcaggaggattgcctgagtccaggagctcaagaccagcttgggcaacatagtgagaccccgtctctataaaacaacttaacaatgtgccaggtgtggtggcacacccttgcaatcccaactactcaggaggctgaggtggacggattgcttgagcctgggaggtcaaggctgcaatgatcgtgatcacatcactgcactccagcctgggcaacagagcaagaccctctgtaaataataacagtaataatcagaaagcaacactgtatgtgaataaagtcaccttacctagctgccggtggacagcctttggtgtttcaaggacttagtttttatgcgttcctgctttcgatatttgttgactgtgagctttgggcttatccagggtccatgaagaagaaatggctcttccttatctcaggcttttgttattttggggtgttttaaattcctctcctgtggttactcaatccgaccctacttgcctctctcttccacaaatttctcaaatgtcattcatggtacccttttaactcttacggacttacttgtttttaacatatcttttattcactttgaatggagtttcgactggaaatagagggtagtgttgtgtgtaccacctaccatcttcagctagacactttcaaagagtttgttttgttaattatatcttcttacatggctcattatgcttgttgaaatttgcaagatgctttaaaccaatcctgtccaaaccacagcctgtgggccgcatgtagcccaggatagctttgaatgcagcccaacacaaattcataaactttcttaaaacacgaaattttttttgcaattttttttttccttagctcatcagctatcatagtgttagtgtattttatgtgtggctatggcccaagacaattcttcttccagtgtggcccagggaagccaaaagattacacattgctgaaaactttagatgtatcaggaatcatatagcttttcaaaataaaatatccacacttttgctaagttctatgctatgcaagtgactgaactataccaggacttatcttgtaaacttggaagtgaaatattcttcactcgcaagggtattttgtgattaaattctggaaatatgcatttataagttgataccagctcctggaatgtaactttttcttttttctttttttcttttttagattttttgagatgaagtctcactctgttgcccagggtggagtgcagtggcacaatcttggctcactgcagcctctgggtcccgaggtcaagcaattcgctggcctcagcctctgagtaggtgggactacaggcatctgccaccacagctggctaacttttttttgtatttttagtagagacagggtttcaccttgttggccaggctggtcttgaactcctgacctcaagtgatccacccacctcggcctcccaaagtgctgggattacaggcgtgagccaccgcacccggatgctttttctcatttctccatcgcttaaagatagaggattgagagaggcccgtttgtggacacgatcttaagtacagatctctagtggttaaaacgaaacacaacaattctctctcatcctctagactcttggcttttgcctaaatatgattcataaagctgaagtgttgctaatctttaaataacacccaagggatatgattatatgattacccaacaccctaatacagtttaagaatagagtgatccaaagaaggagaaaatagtgtcttcaaaaatgttgctattagaaatatttcttttctctaagggaggatgcaggctaaagtatttagcatgtgtgtttacttttataaattttctaagtgatgaaggaaggaaggtagaatctttttttttttttttttttttttttttcagatagagtttcactcttgttgcccaggctggagtgagtggtgtgatctcggctcaccgcaatctccgcctcccaggttcaagcgattctctgcttcagcctccctagtagctgggatcacaggtgtgcaccaccacgcccagctaattttttttttttttttttttttttttttttttggtatttttagtagagatggggttgcaccatgttggccaggctggtctcaaactcctgacctcaggtgatccaccctactcggcctcctagagtcctgggattacaggcgtgagccactatgccctgccagaagtagaattcttatcaacatctttctaggttgataatcaggtaatccctaaagttaataccctaaaatgcaattttttagttttgatggaaaattgattctatcccttttttttttttttttttttttttttttttttttttttttttgaggtggagttttgctcttgttgcccaggctggagagcaatggcacgatctcagctcactgcaacctcggcctcccggttcaagcgattctcctgcctcagcctcctgagtagctgggattacaggcatgtgccaccacgcctggctaattttgtatttttagtagagatggggtttctccatgttggtcaggctgttctcaaacccccgacctcagatgatccacccggcttggcctcccaaattgctgggattacaggcgtgagccaccatgcctggccggttctataacttctatgatagagaatttttaaattatcaaaaaagcctgatctttcatgtaacactttgaccagtcttaccctgtgagtgttttcatctgccttctcacgctttgcatccacaagtgaaagtgcttctatttttctatgtattgtacagtaaagattttagagctttctaggccaggcatggtggctcgcacctataaccccagcactttgggaggccgaggtgggcagatcactgaggccaggagtttgagaccagcctggccaacatggtgaaaccctgtgtctactaaaaatacaaaaattagccgggagtgttggcaggtgccgtaatcccagctgctaataaggtggaggttgcggtgagctgagatcgtgccattgcactccagcctgggtgacagagagagactctatctcaaaaataaaaaaaaaaaatttttttagatccttctaataagatgaagcccactgtgtcaaaaaaaaatctaaaggttaggatatgaagtcattctgacagattatgctgtggaagaatatatatccctgttcctttcttctgagccttactttcatgttaatagtttaaactacatactatatgccaagaactttatataccttatcatatttcattttcacaaaattttaggaggttgatattactcacattaattaacaggcccaacatcacaatttctagcaagaggaagaggtatgcttttaatgcaagtctgactctgaattctgtggcctaatctgcagtctatgttgcatccacatgttttaaatgttcgctatgaattctcttgagctattatttctatctctaattatgccataatttaaaaatcagaatacttgggctcgtgtgaagagatggtgtgcctagatgtttcttcctggctcagtgtgagatatgattttgaaagcacatgatgtgcttcattacattttttaaatccatttatcccaggttaatagcttagatggcctttttttttttttttttttgagatggaatcttgctatgtcgcccaggttgcagtgcagtggcgtgatcttggctcactgcaacctccaccttccagcttcaagcgattctcctgcctcagcctcccaagtagctgggactacgggtacacgccaccatgtccagctgatttttatatttttagtagagatggggttttgccatgttggccaggctggtcttgaactgacctcaggtgatccacctgcctcggcctcccaaagtgctgggattacaggtgtgagccactgcacccggccagatggccatttctctaatgtaaaatgtgaagcaggcccaatggagggccccaagcctgtgccagaggtgaccagtctgcagccgtgccccgacatcctaacttccttggtgaaaaatgagaccactattcagtgtgctagctgtttacaaggagcaattggttagaaatgacagtgtactgaaagtcttttttttccctccaattttttacagggaaggttgggtgtggctctccaagaatacattttggtggactcattgaggaagatgatgtgattctccttgctgcagctctgcgaattcaggtttgttcaacatagctgtctgagaatcttgagtttggaagtttgattaatagttgctaacattttgcaagtggtttctgtttaccaggtacagtgttaaacacttcacacacagtgttaggcccatttgataagtgaagaaatggtgattttgaaaaatgaagtgagttgcctatgatcacatggcagtgtggggcagggacccatcctggggactgtgtatgttatcttgtgctgtgtaataaattatcccaaaatttagcaactgaagcaacaaggcatttattatctcacagtttcttcaagtcagagatttggtagtagattagcagattaggtggtatgttagtccattcttgcattgctataaagaaataccagctactcaggaggctaaagcaggaggatcgcttgaacccaggagacagaggttgtggtgagctgagattgcaccactgaactccaacctgggtgacagagggagactgaaaaaaaaaaaaaagaaatacctgagactggttaacttagaaagaaaacagatttaattggctcacggttcttttttttccccttgggacagagtctcactttgtcacccaggctggagtgcagtggtgcgatcttggctcactgcaacctccacctcctgggtttaagagattctcatgcctcagcctcctgagtagccgggactgcaggcacacaccaccacgcctggctaattttttgtatttttagtagagacagggtttcaccatgtcggccaggctggtctcaaactcctggcctcatgtgatccacccgccttggcctcccaaagtgctgggattacaggcatgagccaccgcgcctgacctggctcacagttctgcaggccttacaggaagcataacacaggcatctgcttctggagaggcctcaccaagcttccaagaatggcagaaagtgaagggaaagcaggcatctcacaaggcgggaacaggagcagagagtgagggatggtgctatatacttttaaatgaccagatctcatgagaactcattcactatcacaaggacgctaccgagggagatgatgctaaaccatcatgagaaactagcccctgtgatcccatcaccctccaccaggccccacctctaacactggggattacatttcaagatgggatttgggcagggacacacatccaaactatatcaaattgtttaggctcaggatctctcatgcatttgaagtgaagatgtcagctggggctgcagtcatctgaggcattaactggggctggaggatctgtttccaagatggcatactcacatggctgtgggcatgtgtatttcattcctcactggccatcagcaggatgccttggttcctcatcatgtccacctctctgtagggctgctcacagtgtggcagctaacttcccccagtgtgagcaatccaagggaggcaaccaggaggagtctgcagtgtggatgacctgggctctaacctcatgtgccgccacttccttttatcctgtttgttagaagtagatcactaagtccagttcacattcaagagaaggagaattgtcctcacttcttcaagacaggagtattaaagtatttggaggcattttttcaaaccaccaccacctgtgtgacctaaaggcgaaggtcatcagtgttccaccatataagctgagtgttctcatggtgctggagcctgcagcagtggtggcctctggcagtgacatttagttcatttctttcttatgtacagggtaatacacaattgaaactctttacctcaaaatgggtcattagacatttttgtaaggattataagttacatttccatcaaagccaaattttatttttatttatttttatttcatttacttataatttatatgcatacataacactactcagtagttcaatttgcttgctcttttataccaactatggaaggatggtatttggaagctgggcatccaagctgatcattcacgcagtcctatattttcttcatttttcttttctaaattggatgacgaacctattcagtataagtttatccatgtacatgatgtcttttgtgaacacttaatctatttatttatttatttatttatttgagacggggtctcactgtgtcacccaggctggaatgcagtggcacgatctcagctcactgcagcctccacctcccaggttcaagtgattctcctgcctcagcctcctgggtagctgggattacaggcacatgccaccacacccagataatttttttttttttttttttttttttttttgagacagagtttagctcttgttgcccaggctagagtgtaatgtcgcaaactcggctcactgcaacctccatctcccgggctcaagtgattctcccgcctcagcctcctgagtagttgggattacaggcacatgccaccaccacgcccggctaattttttgtattttttgagatggagttttgctcttgttgcccaggctggggtgcaatggcacgatctcagctcactgcaacctccacctcccgggttcaagtgattctcctgcctcagcctcccgagtagctgggattacaggcgtgtgccaccacacccagctaattttgtatttttagtagagacggggtttctccatgttggtcaggctggtctcgaactcccgacctcagttgatcccgcctacctcagcctcccaaagaggattacaggcgtgagccactgcacctggcctaatttttgtatttttagtagagacagggtttcaccatgttgcccaggctggtcttgaattcctgacctcaagtgatctgcccacctcggcctcccaaagtgctgggattacaggcatgagccacctcacctggcctatttattcatttatttttaaagagacagaatctcagctaggatgaagtacagtggtgtgatcttgactcactgcagcctcaaacttctgggctcaaacaatcctcccacctcagcctcccgagtagctgggattataggtgcgcatcaccacacctggattttttaatagtgtattttctcacattttcctgtttttctttttaaaatttaacaaaaacaatgaacatagtcagaagttctggcctgtgacttgaaataaccctggatgtacatttttaaaaacattctcagattcattgctgtaagtatgaagagctaatagtctgcaagggaactatagaattaagctggatcatcaagttcatgcatgcatatttaagaaacagagcagcttcttttaatactatcaaactcttcagtgcgatattgaatagttgtatatctaactagtggttttcacgttttcctttttaagaaaaacctacaaacctagttacacgtgaataaaaatattcctaatatcctcctggcttattgtgcgactcgataatcttgttttgtaacatccacaaacaatatttccatggtttaagtgtgtgccctgtcagcttttaccattctaacatgttttcccctctatccctgctgaagaacatggtcagtagtggaaggagatggcttcgtgaacagcagcacaggcggtggagacttcactgcttgaaacttcagcctctctcccctgtgccaaggtaacactggtgttttatttacactgatgtcagctcagcacagtgccttagccctagttagtcatgggggagaagcacaactcatggtactgtggttttgatggtagataagtttctctattcattaaattgccaccctattttctctattgtaaattctccaaaattaaatcataatgaatgtattactgtgttctgtcaattctaagaaggcatatttttttatttcaatgatgttttctatattaaatggcagttttttaatgatgttttaaaattaatttatattaatttaatttcaatgatgtttcctatatttaatggcagtgttttccccccccacccttttttttttttttgagatggagtcttgctctgttgcccaggctagagtgcaatggtgcgatctcggctcactgcaacctctacctcccaggttcaagcgattctcctgcctcagcctcccgggtagctgagattacaggtgcacgccaccacacccagctaatttttgtatttttagtagagatgggggtttcaccattttggccagccggtctcaaactcctgacctcaggtgatctgcccaccttggcctcccaaagtgctgggattacaggcgtgagcgaccacgcctggcctggcagtggtttttcttcttagtggtccatgaagtaatggttttaaatttgacaaaatatggtaatgtaatatttggaatatgcttttcaatgtcagaaatgcccaacacgtatatatccgcctggtgttaagggccatataggtttctactctggggataaaggaccgtccaaaccaaacattattccacgtgggaactgagctcagctttcttcagaacgatctgatagaatagtctgtgctcgtcaaggtggatattttcctcagagtgctctctgatgaggtctgagctacatattctatctataaatttggaaatataaactgtaggtcatagtctcagcttgtggtttagaatgattgggtagggatgatgtctgaatcagacagctgcattttccagcctgatgatgagtcatctgtgtctgtcccactccaaggaattggccccacccccattatccaggtgtgcataatactaggtgtgcatccccaggtaatctcatccagcaacgttggaatgcacacagtgccgaggagataaaatccctctagtaactgacactttatttatttatttatttatttatttattttttcttttttttttttttttttttgagacagagtcttgctctggtcttgaactcttgacctcaggtgttccacctgcctcggcctaccaaagtgctgggattacaagcatgagccaccgcaccggggctgactcattttttacctgataaccagttgctttatagaattgaactccatttccttggacagtcagatgaacaccctggttcagttctacccactaggagggtgtgaccctcctggacatgttttcatccctgcaatagacgaaacatctcagttatgctctctgttcattaattatataagttgcaatgaggaatgttattctttgtaatatcatccctgggcttgtgcaatctgtttcataaaatatcttattttagagttatttttgttgttataagaccttagattttaaaagtaaatcaataatttctacttacaaagtgctaaaaaagattaagatagattccaccaaattgtgtaccaaagtttcaaagtaaattcttcttgttaaataattaaatccttttctcccccaagaagaatttactttgaaatcattgatttctagacccactgggcaaagagaagcaggctgagtagtttataaatcaccccaaaaatcggatgatgtctctgtgactagctagtaaagagaaaaccttacaggtgtttgttttgttttgtttttgagacagagccttgctctgttgcccaggctggagtgcagtggcttcatctctgctcattgtaaccttcacttcctgagttcaagcgaggacatctggctaatttttgtatttttagtagagacagggtttcaccatgtttgccaggctggtcttgaactcctgacctcaagtgatctgccctcctgtgctcccaaagtgctgggcttacaggcatgagccaccatgccaggcctgttttgtttgcttgtttgttttttgagacagtcttattctgttgcccaggctggagtgcagtggtgcaatctcagctcacctcaacctccgcctcccaggttcaagtgattgtcctgcctcggcctcccgagtagctgggactacaggtgccaccaccacacctggctaatttgtttgtatttttagtagagacgggattttgctatgttggccaggctggtctcaaactcatggactcaagtgatcctcccgccttggcctcccaaagtgctgggattacaggcgtgagcctctgcagcctgccaaaagcttacacattgttcaagattaagctcttcaatttaggagattgtgggaagagagagacagaaaaaaactatggccaggaaggcaaaacaaagtaggaggctagaaaggaaaggtcggataggtggaggcctggaaaggaatactcagcggtacttgaggggggtaacctgaactcctagtttctctggtgccctttggagaagtctgggtggaggtgtgtttgctgttgcctcttacccccgggtcaggcccctacaggatcctggaggagagtctagggtggtctgaacactgagggtagattacctgcagtagctacagaaacagtcagggccaaggggctgactaaagtccactgagggggttgatctgcccaccgcaaggaggcagaccacaacaaaaataagtgttctggggtgagtgaaggaatagctgtcctctctgatgcaacctttaagggtagtcccccgccgcgtggtctcccggggttagtcttgctgctgggggaacaggtgtgccttccatctctcactctcagacacatgaagggcctgactgcccagcaaagaaatgactgagcacatgagccccagaggaaagagtccagcattacacatgctggtatccagaccactcctgtaagacgagcagtggtggccagtaaaatagaagagttcagttacgtgcccaatgactctctggagttcctacaatttcctgtctgaacttgggctcagggcactaggtccttttaccgacagttatgtaattaataaaacattttgaaatatgattttagactgtaaatagagagggggaagtgtggacacagataaaacgaaatagcatttccacattttttctttttttttgtacttaatctctaatgtgatagtaatgttcacatttttgaatagccaagagaaacatgtggccagcccgatcggagattattatgcaatgaccctctattcatcgctaatgaataccatgatggcccatacagagcattttgctctgtagtcgaatcacacttgcaggagggttttggacacattataatatgctgttcttgtctctatgccataggtgttatacttccacctggacacaattctaggatctttgtgagttttttggagttgcatttctaaaatgatacaccattttctcatacacgttaattattagcagttgtgcttattactgcctgggagaaaggaccccaaagtaattgcattgatttcatcgttggcgtgatgtgtggctgttttcactccagttgtgaccacctaagctgagaagccttttctctctttcgtattgtctttcccctcagtgacattgagatttcaagaggacaaactccaaaagctgtggatgtccttgccaaggagattggattgcttgcagatgaaattgaaatctatggcaaaagcaaagccaaagtacgtttgtccgtgctagaaaggttaaaggatcaagcagatggaaaatacgtcttagttgctgggtaagacaccatctaacatctacttgatcaagcagacatatttacaaaactcttccctatttatctctctcctcgtacccctcaatccatcctattctcacatttgacatttcgtccatttcatttggcatttctttatttggtgtgagataagtttttattttcagtgcagagcaaactagtcgactctacacaagataaagtcaaacaagttgcagtgctttatcttttgtttctcatattatgttgttattacccctgctcctccttgactttttgaatttcatttttcattataaaaatcaaaataggaattgaaagtaaactattttgaactgagcagtttgttttgtgcgttctacttgaaatattttcgtggaaaaggtacagataatcatatgaaacatgttttcctgttaatatccttgatcttacctacatattcacatttcaaaagctcattatttccctttttctgcatttcaaaactaatgttgggccattttcatttgtgttggttattttataaaagacaaattcatagtttttgtgaaaaggagtgtttgcctttttccccttctttttaaaaaaagaagtacattcactagctgaaaagatgatagaaagcaagggatttcaaatatttattcagtgtgacctgagggaacatcatgagaccatataaattcctttgctgccttgaaatttcatttcagtgactattgcttatgatgtatacaaagcttcaggcacaaaacctatttgtcaggcagagacatttcttgtaattggaattgactcctaggtaactttgtttttacgtatttaattattaatgtaagtgcttttttctttatttctttttctggttataaaaagaatgtagtttcattgtagaaatattctaaaaattcagaaaacagaagtgaaaaagtaaaacatcccaaacccaagcactcagaggaaacaactgttgacctgcgaggactgttttgacgctgatagagtctctcagccatgaggtcacactcacatgctattgtgtaagcaacctgattattcaagcatatgtggcatactgagctccatgtgagtgaatattgagctatgtcaccatttttcatgacaacataacattccatcactcacatcccagattctttttttttttttttttttgagacagagtcttgctctgttgccaagactggggtgcagtggtgtgatctcagctcactgcaaactctgcctcccgggttcaagcgattctcctgcctcagcctcccgagtagctgggattacaggcatgcgccaccatgcccagctaatttttgtatttttagtcgagatggggtttcaccatgttggccaggcttttctcgaactcctgacctcaagtgatccacccaccttggcatcccaaagtgctgggattacaggtgtgagccaccgcacctggccacatcccagattcttaaacatgttggggaagcaggggctgggggagtagcaaaatgcccaggatgagggtggagatcccatcttacacatcttctggcacctctagttccatcaataagtgctaccctggtagttctgagtgtttctaattgtccaagtgcactgatgcagaaaaataatttgaacatagaatagggatgttccacaacttacttgaccaattttctattgatgggcaatcaaagtgttcccaatttttgccattttaaactgctagaattaacaaccttgggcatgtggatttgtgcatctgtttaattatctccttaggaaaaatccccggaagtgagttcaattatttataaccacaaataaagcaaaaatattatccaaaacaggccaagcgcggtggctcacacctgtaatcccagctctttgggaggccgaggcaggtggatcacaaggtcaggagatcgagaccatcctggctaacatggtgaaaccccgtctctactaaaaataccaaaaaattagccaggcgtggtggcaggcacctgtagtcccagctactcaggaggctgaggcaggagaatggcgtgaacctgggaggcggagcttgcggtgagccaagatcacgccactgcactccagcctaggtgacagagcaagactgtctcaaaaaaaaaaaaaaaaaaaaaaaatcacctctttaatgatatagtgatttcttcaaatcctttttccctcctcctgtcccactttcctgtcctcctctttctccttctctttgtgtagcttttcttttttttttttgagatgaagtcacccaggctggagtgcactggtgcgattttggctcgctgcaacctctgccccctgggttcaagcaattcttgtgcctcagcttcccaagtagctgggattccaggcatgcacccccacgcctggctaactgtttttgtatttttatagagacggggtttcgccacattagccaggctggccttgaactcctggcctcaagtggtccgcccgcctcctccttccaaagtgctaggattacaggtgtgagccatcatgcccagcttctgtagcttttttgtaagagggacagacagccagggcctctctgaatccctcagcagttggcattgtaaggaattcatcctttgctccacaccttggttgcctgtggcttcacccttctcccgcaggcttccaggctcactgcagttagattcctgagcccctttccaacctagaaccccaaacttaatgtccccataatcgagtgtgggaaagttcctggctgaggggaggggttggctccacctgcaggcaccctctgggcccacaccctgcaaggagctgcctctggttagattggctccggggtctctgagtttagggcacagtttagtcagggttgttttatggcagtatgcttgatgcatatttgtctgcaattaataaacaaactcttggccattaagaccttgaaaaagcatttgatttgtgaaattggttcctttcttccaggcttcagatgatcttggtaggtgggtttgcaggctttctcaccctgttcagataggaacacttaaggaaaacttggtaggatgtgttgtctgtttatgaaggaagaatcctgcagcagattttcttatccagtccttgtgctttactccattttgggcttgtcaataaaatcagaaatccagatatggatggctctgaccttagcttggaacacaaaactgatacttctaaaacaaagctgtgatgatactgttttcaggttccttacttgtaaacaaagctgggcctccagcctcatgctggagaatgctagctagcacgactgcctggggttacagccaatgcagtccatggccagtagaacatttctccacgctggctttttgctagcattaatatgtataatcaagctgaaattggcctgccatgttgtaaatagaaaagaagactaaagatgaattttcaagaacagattaaacaccaagggatcaacaattctttttctgaaattctaagtttctttacctaacaaagacctttgaaggaacaaaaattaaatggcctgtctcttttttaactgtagtggaaaaaaataaccgtgctggtaagattatgatatatgtatgcatttgtggcacagcttgaagatttttaggaaatagccacactggattctataagggaagaatgaacagccccttctccccaacacaacaaatgatatattttttagggctgtaaactgtcatcagtatctaatcccttaatagctgaatattgatatcagtttagatcacaggcaactattttatcgatagcctaaagtgggcctggcatgacgggttgtgcctataacccaattactctggagactgtgggtggatcacttgaggccaggagttcaagaccagcctgagctgcatagcaagaccccatctttaaaaaatacaaacaaacagcaaaaagcagcactggtttaaagcaacatttgtaatctaaagtgaaaagtcaatttgaaataaaaatcatcttcatatttttacatttgaccaggtcaagcgttagggggaaatgactgttatcaaaccattatatgcactgttgcaacttctttaaaaatataaatgacccctccattaaatggagaattatttcctttttctaaaagtcttttctaattctgaaaataatattagcttattgtaaaaaatttaacataaagtaaaaaggagataactaggtctctcataactcaatattttatttatatattcatctttttacacattgagatcatgctataaatatcatttttgtcctgcctttttctctgaacactgtaacataaatctttttccatgctttagaagaattcaaatacccaagtaatttttaaataatactaaataacaatatatttgttattacatattttaatttatatagaaatgtgatttaaatatatcagcaatgggattaaaatataaaacaatgagatttttttaaatcttctattattaataactcaaatgcagaacagattaattcttttaaaaagccattcttcaaactttaggatttcttattcagtcagaatcatctgcatttcatcaactacatatcgcatggtatttacacctacacatcactttatttgctttgcctgacaaaatgaaaagtattgggaattgttcagggaaatatgccaaaagaatcttagggactcatgagttttacatattttcccagttacactaatgaaaaggaattttgtttgagaacttgacttggagtgcagctgcagggcatttgaatctcagtctccatcaggcctgcacccatttctgtgcagaagtttctagaatttccctgaattggttggacagagcagctaaaaaagcagcccaaactgatctgggaatagactgaatttcacattaaagaaaaatttgaatcattcacatcatttcatctttttttttttttttttttttttctgcagagggccaaatacccgattggattttttaaaaatgtttcaaccctttatttcggtacaatgttaaaataatctgacttttctatgatttggcttttctgccttgagtaactatttaaatatctgtgtgattttcttttatttgtgctacttctagaacaaaacagaggtatttagaagaaaccacttcccacagggcctttgaaccgtttacctaagtcaagtgtaatgagaaacataaccaaatgcaccatggggtttattgttagataataaaaggcttaaaaagcccctagaccctaaagatgcctgggatggatgatttatgttcatatgctacttgagcatgtagttttggagtgcatggtgaggcccatggctaatggcagtggtgctattcaacaagattctgggtctttagaatagttcaaagttttaccacttctctctggataagccatctttttgacctttgagtaaattataaacttcttttcagattgtgtccaaatggtcacaggtactttgacagtttttactgtaactgccaataagtaatactcatctttaaaaagacatcattctggcagggcatggtggctcacgcctgtaatgccagccctttgggaggccgaggcgggcggatcatttgaggtcaggagttcgagaccagcctggccaacatggtgaaaccctgtttctattaaaaatacaaaaattagctgggcatggtgatgggtgcctgtaatcccagctactcaagagggtgaggcaagagaattgcttgagcccgggaggtggaggttgcaatgagcagagatcacaccattgcagtccagcctgggcaacagagtgagactccatctcaaaaaaaaaaaaaaaaaaaaaaaagcatcattccattgtcaacccttttttgctgttctgtgccctgaacaggtgatgtgatagcggtgcaaagagggtgagcattgtcctttacctcaacaagtgtgtggcctggtaggcgagacaggcatgtcagaatgcttatcatgaagccatctgaaaaattctagaataatcatataatcaatgctctagatatcagagagggggtacagaaatctgccgggagaagtggaggaatgtaatgaacaaaaatcacagttccatctctatgaactctaagctcccatagaaaaagaaattagagggctgggcgtggtggctcacgcctgtaatcccagcactttgggaggctgaggtgggcggatcacaaggtcaggagtttgagaccagcctggccaacaaggtgaaaccccgtctctactaaaaatacaaaaattagccaggtgtgatgacgtgcctgtagtcccagctactcaggaggccgaggcaggagaattgcttgaacctgggaggcagagattgcagtgagctgagattgtgccactgcactccagcctgggcaacaagagcgaaactccatgtgtctccaaaaaaaaaagagaaaggaagaaagggaggaagagagggagggaggaaggaaggaaggaaggaaggaagggagagagagtaattagattaccttaaggaaagaaggaaggaaggaaggaaggaaaagagagaaagaaagagaaattagattaccttggtgctcattctttcgtatatccccgttgatgatttggaatctgagctaaagatactggggggaaaactaaaccaaattttgataccaaatacaggaaggaggtgaaataagcttttttattgtagctctccttttattgctcacaataaatacttcctactttgtgattttcccgaactgtattagttggcagaaagctgagcagtcctgtgtttctaattaagaattggatggttagctggagttttgaggaggtcatctctgggcgtgtctgcttttggctttcttgggcagctatgctagcatatccttgggaatgaaaatgtaatccttcatgtgacacagtttaggtaaaccacttagtcctttgcaaacaccaaatgctcagtgcggtacttaaatgacaccatatttgatgccacagtttctttacaggctcttctaagattgtaatgcctgtgggcttttaactgcccttattgatgttgtatccaagaaaacagaaagttgactccaagcagaagtattaatatctttgtataactttcagtcttcacgttgaccccactgcagatctgctgtttagacagatgcagaggtgactgataagccggggtcatgtggcttcaggagtcttaggtttctccatgcagcggtgtcaggataggctcaccagctcctggccacagtgggtaccagcgacctccttgttgctgaatccaccgaccactctcggtcctcatcctgcttcctgcctcagtggcgtttgactttcctgttctggaaacagtctcatccttggcctccttctgagacttcctgtcatgttctgccttcttctccagggtcctcttattttttgtgtttttagagacagggtctcactatattgcccaggctggtctcaaactccctagctcaagcagtccttttaccttggcctcccaaagtgctaggattacaagcatgaaccactgcacacagccgggttctcttattttatactacgccttcttagtttccttttggactctcttcttctgacaactcattacaagcaaatgtgcttaactcttctgtccttatcccttttctcactcggtgcactgtccttgggtgatcttacccattccatgctttaaatggctatagttatgatttccatccatggagaacctggttaagtcagatggctggctttgcctcccagctctactgcttactagctgtgtgactgtcggcaagttgcttacactctgtgcctcagtttcctcatctatcaagtgagcgtacaaataattaaccccataaatatgaagcatagcacctctcctattaactgccccaatccactctcagttttatctagttaacatttattaatttgccgggtctcacctaagatgttacttcctacaggaaacattcccagatgttcaaatctagttagatcctttttccatgtaccctcataattcagtctgactgccctatttccctgtcttagtgtttgtcacatttatcgtaattgctgatatattcagatcagctggaagctcgtgaggatagagatgaagtctgactggatcatcattttgtccccagcgtctagctcagtgcctggtacatagcagtacttgacaaatatttgctgaatgaatgactcatggaattgtagggtatgatgacgcctctaaagacattctttctttgtggttacatccttaggttttgtagatcagaaaactctattagattggttgtggttgagtatccttgacaacatggctgacagtaactcatggaagaccaaactgtaaaccctaatgacagcctttaaattttttaacgatgcttgagagctaagctggaaggacgtggggtgcttatccctcgtagaaatgcctgccaatgctttctcatttggacccaaactccagatcgggagcagtcttatagctggatcagctaccaagagaaattctaaagcaagaagagaaaagcatttcaatttgggacatttatttgcacctggaaatggggaatgggctatcagaccagacttctatcctgtccaacctgccttcattcagtccttccacattgttattctgggtttggactgtgctggaaagacaactgtcttatacaggctgcagttcaatgaatttgtaaataccatacctaccaaaggatttaacactgagaaaattaaggtaagcttgggaaattctaaaacagtcacttttcacttctgggatgtaggtggtcaggagaaattaaggccactgtggaagtcatataccagatgcacagatggcattgtatttgttgtggactctgttgatgtcgaaaggatggaagaagccaaaactgaacttcacaaaataactaggatatcagaaaatcaaggagtccctgtacttatagttgctaacaaacaagacttgaggaactcattgtctctttcagaaattgagaaattgttagcaatgggtgaactgagctcatcagctccttggcatttgtagcctacctgtgcaatcataggagatggcctaaaggaaggacttgagaaactacatgatatgatcattaaaagaaaaattttgcggcaacagaaaaagaaaagatgaatatcaatatctattatatctgtgtggagtaggttttctctggtctgattttgacaaatagaagagtgtctacagcgtggtttgcctgtctgccctcctggatgctattaaagctttgttttgttgaacaatcagatgcccaactctgttgccttgtggaagatgagtaaatgcagtgcttcttaaagtggtttcttctccctaccccacacatcttttggtactaccatttggggaagccaagcaaggatagtaaattgatcagaacacagttgtgggaatttggcctgaagttagtgaaataaaactttaaagagtggaaaaaaaaaatttttaacaatgcttgtgatgtactaaagaacaattttatgaggccttacttggtaatgtaataggctctcttcaatacctaatactgtgatgttatgaacatgggaacatttggttttgcaaagtgttgtcatcaacaataagattctcaagagcagaagtttccgccatagtatgcacagggcctgtggactttttgaatatttgaaggactgtcatatggaaagggatcaggcttagtgtgtaggactccaagagctaggacacaacatgaatgcagatgccttctctctagaacaaagaacttttgaactgtaacagctgtctgtaaatgagtgggccaccccagaggtcatgaccttatcaccatctgtgttcaagcatggcagggagaagccctgggcagggatatctggaaggagaaggacaagtggggactttagggtcccttctaatcctgagagtctggcagtgccctactcacccaaggaccgttgagctaggccctgtccccaaaccataggccctgtgcccacaccctgccccaataaatggctcaggaagaacaactgctatatactcatcagcaagaaatgccccaccatcagctgaattatttaaaccattttgatgagtggttttatggcctttcttgaaactgatgttgttattagcactgcctaataccttttccttttttggtttcttggtaaaggtgtgtctgtatcttgactttagcttatgcctgtcctgtgtgatgtgagtagaccataatagcccgagaaaattaaattatggagtgcattttgaaatgagcaccctcagatttgattctggtgtcttcggctggttttgcataggttgtctgggaaatattataaaattcactttctccccccgaactcaggatcacacccacccctcttggagaagggaagagcacagtcaccatcgggcttgtgcaggctctgaccgcacacctgaatgtcaactcctttgcctgcttgaggcagccttcccaaggaccgacgtttggagtgaaaggtactgtctttaacaactagtgtacttttcagggcaaagttggggggagagaattgtaaaaagaacattgtcaacagataaagagttaagacttttcaggggacttggtacatttcttcactgcacactcagtacatagtggtcgccccatgttggttcccccgggcatgaaaaagagcagtgggagccgccagggcttcactggatgcctcaggagcctgttcctggggctgcgttgctcaaggctcccgcctcgagtgcggtctcccatttcatcagggccttctttgccaagtgatcttgaaacacggccatccatatcggtgtttgatcatcccagtcccggggaaaggtctttccctctgctttagtctcggctcattggagttgctgtgtggggcccgcagagctctctggagacggactggctgtggacagcgagtcgtgatgaaattcctccttggccgtggtcgggctgatatctggcacttccccattcattactctttcttccctgatttatcatgaaatcattccttagctcactttacagtggtggttattgctgcaattacagtttgtccttggcacttcgtgattttttaagaatattgcatttgtattactgttaaacatattaataacgtatctcataaagtactgataacgcacagagtgtcatgcatcgtgtagtggaatgaacactagggttggagcgagaaagccaaggttttggtcacagctgtgtttcctaccgccatgtgacccttggccacttgagccagtcacaacctctcggagccgcatctctaaaagtccaaaatgctgagagcggcaccaggctcacccagttgttgtgaggatcaaatgagaaagcacgtaaagaacgagggctactgtcaaatgatacacacatgggcggtgttgttctgctttaggaaagagcagtccttttactctaacaaccaacattttgagggatacgcagcatgacaaatctcacatactattatctgaaataaattgaagtttataatttactcatttgaggtggttatgcggtggtttttttgtttttgtttttgtttttgttttgagacagagtctcacttggttgcccaggctggaatgcagtggtgcaatctcggctcactccaatctccgcctcccagtttcaagtgattctcctgcctcagcctcccaagtagctgggattacaggcacccgccaccatgcctagctaatttttatatttttaatagagatagggtttcatcatgttggccaggccggtctcgaactcctgacctcaagtgatccgcctgcctcagcctcccaaagtgctgggtttacaggcatgagccacctcgcccagccacagtgtattttttttaaacaaagtttgctcagatatgaaatcatatacaattgatttagataaagtatagtcacagagatctaataataaattatcaaaatattctcatatcctggtatgttttacagtaatgacatctgctctatttttaccttttttttttaagcaaagaaacagaggtatagttagacaaagtgtcaactttttttgttgttgttctgcttggatataaccattagtgtctctcactgccttttgttacttcatcttgggtgtgacgcctctctgttgggtttggggagctgtgtcccttggcctgtgtccatcgtggcagctgtacttggtgacccgtttgaaatgcctcttgctctgttgtttaggaggagccgcgggtggtggatatgcccaggtcatccccatggaggaggtaagaccttgaagagatgcgggtcagctatcactgtgtttccttcctgacatcttgtctctgctcccatccacacaggcccacagaccctcatccataatcccaaagtcattaaggctctgaaaccccaaaatgtttgcataactcatgcagtgacaaaccctagtatttactgtgatgagctataattatatggattttgtacgtgctacttggcgtgaatattcatatacattgctgtggaaaaattatttttgattaacaggtgctgacctagcccctgcttggggtgttttacaaataaactacatgtaaatcacactgccttcctaaacttcaaaaaattcagaatcttgaaaccctgctggccttgcgggtctggatgagagaatgtgggtctgtgcctcccttgatcatctgctgtactgccaagttcacgaagacttgacgcttcccctctgtcaattcaggctctagtgcgtgcctcggcagcatagatactaaaactggaatgacacagagaggattagcatggtccctgcacgaggatgacacacaaatttgtgaagtgtcccattaaaaataaaagaccccaaaataaaagagttccagaggaaaatgggcaaaaagaactgacgttgttaattctcacttctgtaagaactccacctttgttccacataacctctttgttgcctgtaactaaccagtgaccagctcttttcagtttcactctctgcatcagccttatcattcagggcctggacaatcttccaaaacccaaatctgagcaggtcactttcctgttctgtcatttccgccgttgcctgtcaccctccagcacagcacaggaggtcctcgtgggtggctgctcctgcttccctgtccacaagtccccacctgccttctctctactgcgtcaagctccttgcagactctttttttttttttttttttgagacagagttttgctttgttgctcaggctggagtgcagtggcacagtctcggctcactgcaacctctgcctcccaggttcaagcaattctcatgcctcagcctcctgagtagctgggattacaggcaactgccattgtgcctgactgattttttgtattttagtagagacggggtttcaccatgttggccaggcttgtctggaactcgtgagctcagacaatccactggtctcagcctcccaaagtgttaggattacaggcgtgagccactgtgcccagcccttgcagactcttttcctgttctctcttggttccaggattttcccatgcctggaacattcttccttttctgtcctctttacccagtttagtcaaggttttttgtcaaggttcttctctaccccacagactccctctgtgtttacggctatctggttcagttggctgtggcgagttgcgggcctttcttgaggtctcaggtcccagcattgagcagagtgcccagcacatagtaggaactcactagaaagtacttgttgactttgttaaaggaatagaagtgtttacccatggaggtctgagtgtcagggaagctaaagagaaaatctgtaggaacttcaagtactgggagtgggggtgagaaagagtagtccaaggcactgctgaaaaaaatcgtcccaggcctcaggtcagaatggggatgggtaccattcatgagccagcaagacccagaaccaggaggccaaattagaggtggtgtacaaggggcatacacaggggaatggctcgggtttagccagcaaattggaaggacattggtgtcccgctggtttagggcatcagctgcgtggcttggaggagagagctacttttattttattttattttattttttgagatggagtctcgctctgtcacccaggctggagtgcaatggtgcaatctcggctcgctgcaacctctgcctcccaggttcaagtgattctcctgcctcagcctcccgagaagctgggattacaggcacctgccaccatgcccagctaatttttatattttaatacagatggggtttcaccatgttggtcaggccggtcttgaactcctgacctcaggtgacccacccacctcggtcttcaaaagtgctaggattacaggcgtgagccaccgcgcccagccaagaagactaccttatgagggtagagtgggccagacacactcaggcaatttgttccttgaagttgagtgcctccagtcttttcttcatctgtatcctcccagctctgagcaccgtgcctgacacttggtggatgtttgttgactgtgtgccaggcacagacaatatgtactggacggaacataataaatcaccataggggaaaatgttagaataaattccagatgggctgaggaattgaaagtgaaaacactatgactggaaggatgggaaggagccggccttgtgaagaatgagggagagcattcagccagtgggaactgctggtgggaaagtcctgaggcaggaaagggtgtggcctgttcagggaactggaggacaccagggtggctggagccccgtgggccagcgggagttgggggggttgaggtagagaagtgtgcaggcgccagctctgtcgagcgattgcaatttgtagccaagaacctggattttatttgaagtgccaaggtcagccattgaagggatcttgacagataacacaatgcagattgagttttattaaaatcaccctgtcttctgtgtgatgaaaggaccaggggcctctcagtagacacgatgaatccaggaggaagactatggaagtagcctagggaaagatgtcagtgacttggcccaggatgggggcagtgaggatggaaaagaggaaaaaacagtttaagatttgtttgctgatgtttgcaggattagatgttgggggttagaaaagaggaggattcaaggacgacatccagggtactggcttgagcaactcagtagactcatttgttgaggcagagaacaggggagtgatggtatgaggtttgaactgtgtggtgtggggtgtggtggagggtggtagtcagaaggagggagtcagtttagaggcctatgaaacatgcaggtggacatcaagtagacggctggaaagaaaaacttacattccagttgtgaaatggccaaagagttcaatagaaacatcgaaaaagaaatattaactaaatgcatattcatcttcaccaataatcaagtaaataaatctacattaaaaccactatcaggccgggcacggtggctcatgcctgtaatcccagcactttgggaggctgaggcgagtggatcacctgaggtcaggagtttgagaccagcctggccaacatggggaaaccctgtctctactaaaaatacaaaaagtagctgggcgtggtggcaggcgcctgtaatcccagctccttgggaggcggaggcaggaggatcactcaaacctgggaggcagaggttgcagtgagccgagatcatgccactgcactccagcccaggcaacaagagcgagactccgtctccaaataaataaataaataaaaataaaaccactatcagttaccattttacttgtcaaattgacaaaattggatttttcaaaatagttatgataccaaattttggcaaagaaattgaaatggactcccacacactgctggaaagtgtatgttgataaaaacacttcaggaagaagagtagaaatacatattaagtgttttaccgtgcatatcctttggcccaaataaattcatttttagtgtaccctaaggaaaaaatgaatgtatgggaatatagatcattttaaattaaatataccctcacatagtttataacattaaaaaatggggggataataataggacatcaggttaactgtattttgaagaatctttaatgatgtaaaaatgcttgctatgttgagagtgtaagagctaaagtataaactgttacgatgttatgattccaatatttaaaagtacaaatatatatttataaaatatatatacatatgtaatttttcatgttttctccagttaacattattttatgttataaagtaaaattttaacaagaaaatatttaaccttccaagaaattaaggaaatgcagctttaaaaagaataacactttctcaactattaaattatttcttagtctaaaagttactttatttctgaagtaactgatctactactagtgttttgcagatgacacttcatctctttcaaaaagcaatttggtgatattatcaagatctcaaaggccggatgtggtggctcatgcctgtaatcccagcactttgggagtctgaggtgggcagatcacaaggtcaggagtttgagaccagcctggccaacatggtgaaaccacatctctactaaaaatacaaaaattaaccaggtgtggtggcaggcgcctatagtcccagctacttgggaggcaggagaatcccttgaacctgggaggcggaggttgcattgagctgagatcatgccactgcacaccagcctaggtgaaagagcgaaactccgtctcaaaaaaaaataaataaaataaaaatacttcatccctttcaaaaagcaatttggtgatattatcaagatcccaagggctgggcgtggtggctcatgcctggaatcctagcactttgcggggctgaagcgagaggatcacttgagtccaggaatctgagaccaacctgtgcaacatagtgagactgtgtctctacagaaaaaaaaagaaaaaaaagaaaagaaagagagctcatttaacctagtaactacctcctgaaaatatattactcattagcaattaatttttttaataaaaggaaaagctatttgtgtatattctttataactgtggcctttcttgtaaaagtgaacatttggtagtagcgtatatatccagcctgaaacttttggtacatctaccgtatacagcttctataaactatacaaaagattattatagaaaaagttttgtgaaaaacgaaacttggaagtttgtaggaagatgattctacaaatgataatcgagtgtgctcatgagactggaaggaaaataacagaatgagtagagtcatgagggtaaaatactctatttctccaaagttctgtaatatttcatattattttattgttactgtttattttatgccctgcctcactccaaagtatatttgatatgatactgttttctagataataaaacaatgaataaacgtagtgagtgactataaggagattcattattaaatgcatcagaatgttttgccttaacctgaggatggaagaatttatgatctgagtaattgctcaaaggttctttgttgtcacgtggaaggctttgaccttgattttctgatttaggcattcctatagactcagctcattataaggatatgtaatttgcatgctattttatttattcagtccttaaattccatagttgtttaaaacaaataggaagatgtcttagccgagcacagtggcccaagagctcataaccagcctaggcaacatagcaagacccccatctccacagaaaattcaaaaattagccaggcacaatggtgtgcacctatagtcccagcctactcagtaggcttaggtgagaggattgcttgagcccaagagtttgagaatacagtgagctatgatcatgccactgcactccagcctgggcaacaaagcgagaccctatttctgaaaataaataaatagaaagatatcttatttctctagttcaaccttcacttgactggagacatccacgccatcaccgctgccaataacttgctggctgccgccatcgacacgaggattcttcatgaaaacacgcaaacagataaggtgagaaggatgccttgctagccattttgggtattgtatcctggaattcctggattcttaaggagtttgtggaaagaattctggtgtctgcaaactctgaaatgttattcaattcaattttgtgatttttacatatgtccctgtttcccaaggagaaggagccatcctttgatcagattctcaaatgggtttatgagcactgccaagttattgggagaattgtagtatgttgtaaaagccaaatattctctaagatgagtctttagttttaaagatggtaggtagaccagttctcttcattctggtcataggtccaatctctgatctgttctaaggggattggacagatgtcgttttaagactaatgttatgtggagctattttagatgtgctgaaaagatgtcagagacccttattgggcttcatgtgcttgtaggttaagagttaaaccacacccccaaaggggacagcccaccagaagctaattcctcacagatataggacatagataaaaggggtaccttctggcacattttacaacaagggtcctcactttctttaattaaagtagttccttagtgagtctttgctacataatccagatacatcttcatatggtagttgtagcgatatagatcaagaaatatatttatgcaaactctttgcaatgtgtattatttcagatcttgtcagttttatgaaaatgacagaatttaagtcaacattgtttatattagcccacaaattttaatagggtcttttatctaaatagttcggttataaatgcaatgaatttttgtcatatcctgtgaattgtccaagttcatggacaactaacttttgtgtggtctcatttttgttttgtgtttttaggctctgtataatcggctggttcctttagtgaatggtgtcagagaattttcagaaattcagcttgctcggctaaaagtaagtttccagttagcaattctttaaaaagaaaatatcgtagaaacgcatcagaaagattgtcaaagcctgaaattttcaacttggtttgattttggttttcagatatccttttgggtattaaactctatagagaccgaacactggagcagagagagcacagtgttggaagcctgaaccctggttctacacgaaagagccaggtggacaaattaattaaccttttttggtctcagtttcttcgtctatgaaatgagaggactgttttgctaatttatgagtactctagtcaactgacaagttagctgggcacaggagcacatacatacctgtagtccgagctactcatgatgctgatgtgagaggtttgcttgagccaaggagttcaaggtttatagtgcaccatgatggcccctgtgaatagccactgcatgccagcctgagcaacacagcaagagcccatctcttaaaaaaaaataacaaattagaatttttggtgagtccttctctttctaaagtgaaatatttttatgaaatttgttaaatttctaggaaattataggataacctttgaaaactcatctatctcatttgtggttttctgttttgttttgttttgttttttgagacagagttttactcttgttgcccaggctggagtgcagtggcatgatcttggctcactgcaacctctgccttcctggttcaagtgattctcctgcctcagcctcccaagtagctgtgattacagacacgcaccaccgcacctggctaatttttgtattttcagtacagatgggatttcaccatgttggccaggctggtctcaaacgcctgacctcaagtgatccatccaccttggcctcccaaagtgctgggattacaggtgtgagctactgcgcccagcctcatctacgtttttgttgcagcaaacactacaattatacttgcgtatgccatcttaattcttaaaacctgtcttatcttttttctgatgccatttgctgcctctggtcttctaatcatattgcttgctactagccctgtttcagagactaaaaaataaccctaaatggtataacttaacaaccttactggttggtattaagtggttttaaaaattcacctcctgcctcttactgaaccaagttcagtgtgttgaattagtgagtaattccatcctcggcagctataacaacatgcagtttctgtttcccagatcttttttatgcttcattaaaaatcactattttgccaggcacagtggctcacgcctgtaatcccagcactttgggaggccgaggcaggcagatcctgaggtcaggagattgagaccatcctggctaacacggtgaaaccccatctctactaaaaatacaaaaaattagccgggcgtggtggcaggcgcctgtagtcccagcttctcgggaggctggggcaggagaatggcgtgaacccaggaggcggagcttgcagtgagccgagatcgtgccattgcactccagcctgggcaacagagcaagactccatctcaaaaaagaaaaaaaaaaaagaaaaatcactattttgtgtgtgtgtgacagtcttgctctgttgctcaggctggagtgcaatggcacgatctcggctcgctgcaacctccgcctcctaggttcaagcagttctgcctcggccttctgagtagctgggattacaggtgcccaccaccatgccagcgaattttttgtatttttagtagagaaggggcttcaccatgttggccaggctggtctcgaactcctgacctcaggtgatccacctgcttcagcctcccaaagtgctgggattacaggcatgagccaccacacccagccaaaaatcactttcttaagatgttttatttacacaaaataaataggaagatttcttggcttggtgtggtggctcacccctgtaatctcagcactttgggaggccaagacaagaggattgcttgagcccaggagttcatgaccagcccaggcaacatagcaagacccccgtctctacaaaaaatttaaaaattggctgggcattaaaagttttaatttttttttttctcctccataaattaggaataacttactttgaaacataggaataaacttaacttgaattactggtatttgtatttgaaaaactaaagaactgcggcatcaattatatggacagacagcagtttatgtctcttctgagcagcgtacatggtggccacatagagcagcccaaggagcccctggctaacgcagccagcagcaggcacaagtggtagttagctgtatgctgtccactgcaggacatcttcagatcaatccttttcagagtctattacgaactcacagtatcttactcgtagaagaaatctggccataggtatttgtctgacttggcctaacctataattcactcaaagttcagtttagtttagtttttttttgtttgttttttgttttttgtttttttttgagacggagtttcactcttgttgcccaggctggagtgcaatggcgcaatcttggctcactgcaacttctgcctcccaggttaaagcgattctcctgcctcagcctcccaagtagctgggattacaggcatgtgccaccacgccaggctaattttgtatttttagtagagacagagtttctccatgttggtcaggctggtctcgaactcctgacctcaggtgatctgcccacctccgcctcccaaagcgctgggattacaggcgtgagccaccacgcccagcttagttttgatttttgttttttggtttttttggagacagagtcttgctctgtcactcaggctggagtgcagtggcaggatctcagctcattgcaacctctgcctcccaggttcaagtgattcttctgcctcagcctcccaagtagctgggattacaggtgctctccaccatacctggctaatttttttatgtatttttagtagagacggggattcaccatgttggccagtctggtctcgaactcctgaccttaggtgatccacctgcctccaccttccaaagtgctgggattacgggcatgagccaccgcacctggcccagtttagtgttttttttgttttgttttgtttttgagatggagtttcgctcttgttgcccaggctggagtgcaatggcacgattttggctcaccgcaacctccgcctcccaggttacagcgattctcctgcctcagtttcccaagtagctgggattacaggcatgcgccaccatgcccagctaatttttgcatttttagtagagatggggtttctccatgttggtcaggctggtctcgaactcctgacctcaggtgatctgcccaccttggcttcccaaagtgccagtttagttttttaaaaggctttaccaatcatggagaaaataaaattagagggataattttggtgaccctttgctttctgtttcttctcaaacttctcaccttttttcttcttaatcattagaaactgggaataaataagactgatccgagcacactgacagaagaggaagtgagtaaatttgcccgtctcgacatcgacccatctaccatcacgtggcagagaggtgggtgctggggagatgccagcaggctgatggccaggtggggaggcgtgttcgagccgaagcgcttaaattcagaaacttacagtttgatcctgtccagtgatcttcccagcctgtgcttcatattcccaccatttatttcagttactattatcgtaccaccctcccttatccttgcctccaattaaaacaaaaattctgtccagggtcaatcccatctactcctgtgtcttctaaatttccaaggaaaattacctaattttctcttctgtttctctctcctttggcctcttgtatctatattaagaaaaaaaaaaagaaactttttttaaagaccacgcctccctggctttgtcctgctcctcctccacccaccatcccaccttcttctgttcacttccttaccactggctctcggcagctctctgtgtgtttccagtgctggattttcctccaagtctgatatgtgctttcacccacttaacgaggcatcgctccactgcttcacatgcatccaggtggagtccccgtgagctccccaccacctcgacttccctgcttccctctcagttgtgaagtccccttccttctcccacactgccctcagtctcatcgctcactatgggatgagacagagggaaatgcactaaacaggaagttaggagccctgagtgtgtgtctcccctgccactgactcactgcatgatctcgagcaggtcgcatgcatgttcttggcgttggagatggagatggtcacatacgctgcacagaaacacggcaaccacattttatgaaccctgtgcaactgcagaaatgttcaatggcatggatccctgattcttcctggattattcttctcatacttgtgccctcatttacctctttatgctcacatttggaacatatttatcagatgcgcattttatagcagttcccgactaatagattatcttgcttccgtttccatcccccagttcagagggttcacattaacagagatatcccgttgtgatcagaggcctccagtggctccccacatcctgggtgatacagttgccatcgcagagcttggtcttcaggacacccgcagtggcttccctcactctgctccctgcctgctttctagtcagcagtgccgacctccatcctcctgccagccctagctgggccatctccatcctgtctcctgcctaggccagtgttgccctctaagatgcacccaggtctcgtcccttcagggagcttcccttctgggaatccacccagccagtccattaagaatttagtgtagtcccacaaaccatgaggtagagagacaaagaccagagactgagcgttggctctgcggtttatgggctgcacaactttggacagactgctcactcagtttcctcatctttaaaatggaatcataattccagctgccttgctgggaggcttcactgaaacataagcatcctttccagacccaaaagctctgcccacacgatcatcagaagtcactgtggtgatagctgtattgagtagagttttttgtttgttgttattttgagacagagtctcacttgccctgtcacctaggctgaagtgcagtggtgcgatctaggctcactgcaacctctgcatcactggctcagtcgattctcttgcctcatccttacgagtagctgggattacaggcacacaccaccacacgtggctaatttttgtattttactagagatggggtttcaccatgttggccaggctggtctggaactcctgacctcaaacgatccgcccacctcagcctcccaaagtgctgggattacatgcgtgagccactgtgcctggcttgggtagtttttttgagtgtctttgtctcccaaactaaactaaaatctccttggaaactttatggttttttttttgttttttttttgagacagggcctcattctgtcacccaggttggagtgcagtagtgcaatctccactcactgcaagctctgcctcccaggctcaagcaattctcctgcctcagcctcctgagtagctggaggctgtgcgccacaacactcagctaattttcgtatttttagtagagatggggtttcatcatgctgcccaggctggtctcaaactcctgagctcaggtgatcttcctgcctcggcctcccaaagtgctgggattacagacatgaaccactgcacccagcctagaaactttcaaggatacatttttcattttgaaataagtaataacattatagagattttggaaatgtctcaaaagaattttaaaaaccttgctatactaataaaactactattcatagttttttgtgtgcatctagttttttggtataactctagttataactttagtgtatagattttatatcctacgagtttcattcatttatatcataagcattttgtattttgttagctctttgttgtaatggccattttaaatactctagaatattcctttgtggatgaaccacaacttacttaagcaaggctcagttcttgaaaacaccaacagcattttaaataatggacatgaatactttaagcattttattgagaagcctacatattttctttgaaaattttttttataactaggaagatttattattaaaatgtcatcatgtccaaaatgtattgtcatctttttttttttcaaagcatttgtgattttgtgttactcttcaaaacttttttggaggtttactgatgataggaaaatcaggaaggtggaaattagtgtattttaaaccaagcatatggatgtgctaaaagagaaagttttatgccaattggtattctttggtgtctgctttggggttccagcctgagcagccatcagaaacagggcaatggcttagacatggatcttggaagagaaaggctacatcatcttttatacctgggtctggtctgcaattggtttctctctggagccaggaaggactgaagtgttttgtggttgtgaatcacttttaatggaagtgacaactttacaaaattcttccggaaaaaaatttgaattccattattgttcagggcactgaagtaaagaaaactttattgctgtggacaagctacctgggtcagaggaatttggaatgacatttgataagtagtttggctcttatgaccatgaattaataacagaaataggactcttcatcaaaagaattgagaacatttgctagtagggttttttggcttaaacctagaactaatgtaacccttgtgatgaaattggatccttatttgatttgacaactagagcaggacagtcagggtgcacggtggtgggagtgagaccctcttctcaggccatatggatgttgcgccatttaatgaccaccccttcctttcagcctgtgtacaaaatctgatgattgtttcatctttttttttgagacagagtctcactctcttgccaggctggagtgcagtgtgcgatctcggctcaccgcaacctccaactccctggatcaagcaattatcctgcctcagcctcccgagtagctgggactacaggcatgcgccaccatgcccagctaatttttgtatttttagtagagacggggtttcatcgtgttggccaggatggtctcgatttcctgacctcgtgatccgcctgccttggcctcccgaagtgctgcgattacaggcgtgagccaccgcgtccagcagattgtttcatcttatgcctcataccgaaagtttaaaggcctcatgttcctggacccagagtggaacaaggaacccacagacctttccagaaatacttaacataagcagaagaaaatatagacatacagccattttgttacagagcataattttgcacagatgagcctctgcctgtccgagccccggggcctcacaggcttgccgtctctccatctccctcgcatgcccaactcctggccatggaccaagggcccacaagcctccctcagcctcagggaatcaaccatcaagtggctggttccttgccccaacaacactctagggaatcagtaccgtgtcttccactggggccgaaacagtggacctgcccctgattgaacaccttgtactgccaggctcttggccaatattggctgtttcatcagccattaggcatactgtggatgttccttaggacatagtcagcactgtagtatagtcagcactgtagtactaaaagggatggtccagagcaaaaaataagcaaacagatctcccccggctgcctccacccccacacccactggcattgtcctagcatgccttacataagaggctggcactgtcttcactatatctctgtacagctggctcgggactaggcacaagtagcccctcaatacatactccaggagtgaataagtgtttcttattccacctttagttctatcattcagagaccaggaattccattttggatcactaacttagggttactttctagtatctttcttgtgggctggaatttaaccttcacatttcttatgtatcactgatgcatcacttaccgggccatgttaaaggcagaggtgggctttggaggccactgattctagttgatcttgccagacatttttttttcttgttttctctttgctagataaaaaacagctgaatttctcttgttgattttaaagaaatttgataaaaagattccctcaatctggtgccaagatcgtgtatactacagagcaggaaagaggtttttagttgattgactttgcaccccatgtacatcttgggaagaacagtggtggctgaggatactattgaaaagcaggcctttcattttgtatatgctctgcttatagctgaaaaactcataaagaaggtttctgtgtgtttatatgagtgtcagttggtgtttgtgtgagggtgtgagtgtgtctgagagagagggagcttgttataaagactaacaacagccgagtcagggaacagccataggccaagagggcaagctggcctgctggtgctttgcgtatgaaagaaaaggttaactttcttcatcctacggatgcctatagtaccaaatacgtaatttccatcaccattttcataagtgctgtatcgtatacattgagtaaagtggatctaaattgtcaatgtggacagcttgttatttgaagctgcataaattaacaaagtcagtgtactggctttgttttgttgcattggtattcactaaaccaaacctaattttcacaaaatgtaaataactgcaattcttgttttgttttgttttgagacagggtcttggctgggtgcagtggctcacgccagttatcccagcactttgggaggccgaggcaggtggatcacatgaggtcaggagttcaagaccagcctggccaaaatggcaaaaccccatctcttctaaaaatacaaaaaattagccaggcatggtggcaggcgcctgtaatcccagctacttgggaggctgagacaggagaatcgcttgatcccaggaggcgaaggttgtagtgagccaagatcacgccactgcactccagcctgcatgacaaaaaaaaaaagagagacaaggtctcacttccatctcccaaatgggagtgcagagacacaatcatggtcattgcagcctcaacccccaagactcaagcaatcctcccacctcatttttgtattctttgtagagacaaggtctcactgtgttgcccaggctgttctcaaattcctaggtgaccctcccgcctcagcctcccaaagtgctgggaggtgtgtgccaccacacccagccaataactgaaattctaataagccagtgaagaaaataaagagaactggtacttgctctattcaccattcacccccgccaccccccacaattctactttatttacttttgctttttaaaattgtggtaaaatatacataacgaaatatttttccccatttgtaagcacacaattcatggcattaaatacattcacaatgattgcactatcatcactatctatacccagaaccttttcattatccccaacaaaaactccttatccattaaataattactcccctcttctgcccctgcctattctaggtgcctgatataagtggactcatatagtacttgcctttctgtgtctggcatatttcactatgcaccatgttttcaacatccattcatgtatcaacatgaccttcttttatagccgtctaatattccattgcctgtctgtgccacattttgtttatccattcacctgttggtcgcttcctccttttgactattttgaatagtgctgctatgaacatgggtgtacagatatctgagtgtctccttttggttctttcgggtaatgccaagaagggaagttgctggttgggtttttttttttttttttttttttagagggggtctcactctgtcgcccaggctggagtgcagtggtgcaatctcagctcactgcaacctccgcctcccaggttcaagtaattctcctgcctcagcctcctgagtagctgggactacaggcacacacaaccatgcctggcaaatttttatatttttagtagagatggggtttcaccatgttggccaggctggtctggaactcctgacctcaaacgatccacccacctcagcctcccaaagtgctgggattacaggcgtgagccactgtgcttggcctctagtggatttttttgtttgtttgttgtttatttgattctttctctatgtctacccactagatggtcagcttgggggagcctgaccttttctctttcaccctctgcaacttcctgagcatcagaacaatgccagacacacaccaggtggctggtccatatttgtcgactgaatgactaatctgttctctttcagtattggatacaaatgaccgatttctacgaaaaataaccatcgggcagggaaacacagagaagggccattaccggcaggtaggtggtgctttcttcccgggtgtggctctgttcttacgttcatttctactggcctgggagctcactctttgcctttcttgtctcatccccaacctgttgtggccagtggttctctcactgttttgggtgctcagcagggctgggagaggatcagaagacatagaggctccagtgtctttttaccatcttttctatgtatgtttatttcattttctttttttcatgtatgtttccaattgtgtttccaggaagagccactcagggtattctttgaatataaattctcacttattttattgggaaccatccaggtaatactacatctgcataactgataaatgaaaatctcagacacattactcaaatttcatatatcaaagaacaaacacctagttattagacttaatagcatgaggattttttaaaggataatggcttattaatacaaaaatggcttattaataaaatacagagaatgcagaagaaaaattatgtctgacttcattgtaatagatattggatgtgcgtcaatggcacttagggaatacaaattaattcctatgatttttcatccaggcacagtgggcttctaaattgtgttgtgtttttttttcttttgaattgattataaactgtacatttaagaacagttttagatttctgtcctttatgttaagtttttattagtgaaaaaagagtcaccttactataataaccaatccttacgccaaatagacttgtgaccttttgaagtgtcttgaattaaaaagtgaatgtaggtattggattaagaagagaaacttaagttcgtggacctcgtctcctcccagtcctgtaacttacacacacacacacaaacagatttcaaatatccatgctagcaaactggaatcattgccatgaagttttagatagttctgaaaaataggaagatggaattagattgatgattaaaaggacagcccaaaatatggtggacttccatccttaacaagcattcttgcttttcatgttcttagcctctcctgctaaagtgggagctttataaaagcagaggttattcccctttttatttgctgctgtgttccctatgttcagaacagaactttgttacatatagtcgtaagtgttcagtaaatatctgttgaacaaatgagtagaataagtaaaagacaatttatggatacagaactaaaatgccaacataaaaagatgttcatgaataatcataaaactgcaaattgaaacaatggagtatcatttacctaggagcttgtcaagtgaaaatagtaggtactaaatgctagtgaggatgcaatgaaatgggggcatttatgcagcgttagtgggagtagaaatcctttttggatgagtttgttattactaaaatttgaaatgacccaacaattacaactttggaactaaaaatattttaatgaaaagaacaagaaaatgtgtaacgtacaggaaaaaattctgtgtattaggatatttgttgtgccattatttgcagcggtgaaaattggaaacaatccaaatgtccaacagtagagatggttgcatatatttggtccgccattttgtcccatgggagagttgaaattaataaatgtgcgtatgggtgtcttgacatgagtagagagctctcatacaccattggaaaggttgtaaaaaccattttaaaactttgaagtaaaatactgatattgtaaacctgtttatgttaagaaaaacccagcgtgtttacttacattataggcacttacaacttatttgtgtatataagtgcctagaatgaaaagtagaaagatgtatgccaactgttggcattagttgcctgtgtaataaaagcgagtattgaaaaggccctttctctgcatagttttttactgtttaggtactggagagatggaagattcacagtggccttgatttcagtgcctactctgtgcattgtattgatagttccattacatatattagcacagttcatttgtaaagctgatttgcaaatgaggaaattgggatgttatgttaaaaaaacttgcccaaggttatatcttgtgttgcttcgtgcatagatatttttaagtaaaaaggggttatagtgtatttaagagctttaactgctttttatttatcataagactgtagtgaagacatctttttatgtcgataaaggtagacctgtatcttcatttttaatgaccacatcatatctcatagaggtaccatagtagattcagccatttccctgttaatgaacatgtagagtgtttgcagtttcaggctatcacaagtaagctgtagtaagtatacacatatatttgtgtgtatacttgatactatccttaggatattattccagatgtgtgattgcagagtccaagaggatacaaatttccaatgttgacatatgttttgacattaacttccaggaaattcataccaattcacatccttgccaatatcccatattggcctttgtttaaatgtgtgctaaatccctcatttgccctatcgtgattattacacattgcatacctgtatcagaatagttcatgcaatccacaaatatatacacctactatatacctaaaaaaatgaaaaggtaaatactaaatcaataaatgtgtgataagctgatgaacaataacgttttcattggcatctttatatgattttgaaatattttatttgcaaaacagaaatgagcagccttccgctatgcacgtcatttagtcattaaagtgaatgacagtgatactttaattgacccagtgtgtttcattttttttatgctcaagatgtgaaattttgtaattgtaacaattacaaatgaagagcttgaatatcgattatatattattcttatttacacagctaatatttcaagaatgtttctagtctcatgttttgtacagaaaatctccatattttttagtcattttctcatatgcactgtttataatagaatggtagtatagagaaccctaaatttcatacaatgaaagaccacttatgtttggaatgagttatattgagaatgtaataattgaatatagttgtatttgactttcaggtaatattttttcactaaatcagtgactaatgcaatctcaaccaggaagtagccagaaagctccttatttccttcctttccttacttgtcagtgatggaaatggataataaaatgtctcataaggtgatcccaccagggcacagccattctctctctgcgtaagcttgaacttgtctggctcacactccccttgggaagaagagaattaagctggggcgtaatgaagtggttctgtccagagaaacattcctagtggctgaattatgaggaggaggaagtacacattcctgtgtcccttttattccatgttggacttcgtacaacgtggagccacagccaagagatgggaataggaagtcctagaactttttgcaaaaagtctgtgctctctagctttcactactgaaagcttcaagatctgatgtggccatatcctcctgggcagctgaaaattgagtctgtgccaccagttgactgggttgccctccctgctgtgttgagatccagctctgggaaagtagcctcacatgcaggaagccagcatctttcactgccccttatctctgtgccagacagacaatgcagccttcttgacagacctattactaacaagggaggtggcccgtaggctagtcattaattcatctgatgcatattgtatgcctactgggtctcatgctccgtgctggggattcagaagtgaacctgcctaatatagtccctgccgtcatggcacttacggtccagtggtagactgataatgaccacactagactgataatgacattagtaatcaattaagtctgagacatgctacaacagcaaaccatgtggtagtgctgtgagcgggtgtaacaggggtcctaactcagcccaccctttgctgagcagagcatggcaaagagcacattccgcctgggaggccaccctagggagcaccaggcacaaaccctgcatggtccagacacgcagaaaactgatgggattgcatgcatggccttttgagggtagactctctgggcctgtggttgcttcatggctgaagtccagctccttgtgggaatggccatcccactggcactgtcgctgaccactacctgtgtttgggctggttcaggcgcagtttgacatcgcagtggccagcgagatcatggcggtgctggccctgacggacagcctcgcagacatgaaggcacggctgggaaggatggtggtggccagtgacaaaagcgggcagcctgtgacagcagatgatttggtgagtgtttccaactcggaagcttcagggagtggacggtcctcgttcttcgttaccagaaaaagaaaggttttcttccttttatcagtgagtgtaatgaggatacagaaaaagtttccacacacacatttcttccccgacaagcatgtttgcctaactgcttcctaatgttctcatagtcatatatgacgtgcttatgcctggctgcaacaaaaacatgtgaaatttatttcaggagctttccaccatccttgccaatcctgatctctgcttctgcctgggctggggaggagtcacccccctgcagtcacttggtgacttttaaaaaatgtaccttctatgcctgcctgaaattgagggcaaatcacctttccaaggaacagaaggaagtggctctgcttccatgaacaggaagataaagttaaaattggcacatttctggcaccagcctggcttattatttaatttggggccttagatttgggttttgtattataaaagcaaatctctgcctcaatcagtcttgcttttctagttcccctttgagtagttgtggtgctttctgtaaagcttccatggaacaccatttccttttttagtgctttttctaattggcatgctagtcttcttttcttcttcgtctttctggtataataacaacctttcctgttaacttttttttttttttttttttttctgagacagtctggctctgttgcccaggctggagtgcaatggcacgatctcagctcactgcagcccctgcctcccggattcaagcgattctcctgcctccgcctcctgagtagctgagattacaggcgcacgccaccacgcccagttaatttttgtatttttagtagagatggggtttcaccaggttgtccaggctggtctcgaactcctgacctcaggtgatccacccaacttggcctcccaaaatgctgggattacaggcatgagccaccacacctggccttttccagttaacttaaactccacatattccataggtgttttgtttgcttgcatttttgtatataagtgcatgggtgtggacacaggcctctaagatagccattactccaaatttaagtttactttcccatatactgaatctcctacaataatggaacttaaaatgcacactggtgattggtaagcagttgtgaacagagagaggcaaagtcatattttattaatttcaagggcttagggtataatttgaattctttttcaaagtgtccggattgtttttcagctgcttttgaagaaatgaatctaactcatctcagaagtcttgtcaagtaaattcaatagatcaacgtatgtcgcagcctatggaatacttagtataaaaattgaagagaaaaccctcaggttgctataaaagtgctgctttattaaaattaccaaaatctcactatttctatctaaactgacatactacagtttctgtctaaatacattgctctgtattttattaatttgtatggcaataaatatgtgtcaggaacagttttaaaacttaatcctcaaatactgcttccttaaatctatttatttatttttatttatttattttgtttttgagatggagtttcgctcttgttgcccaggctggagtacaatgccgtgatcttggctcactgcaacctctgcctcccagattcaagtgattctcctgcctcagcctcccaagtagctgggattatgggtgcccactgccacacccggctaatttttgtatttttagtagagatggggtttcaccattttggccaggctggtctcgaactcctcaggtgatctgcccacctcgacctcccaaagtgctgggattgcaggcatgagccaccacacccagcccttaaatgtatttttgtgtgagtgtatgataaaaatcttggatctggaacaaacccaaagattactctttttagttacctttttaaataaactctttatttatctttttaataaactctttttagttatcttttgtgtttcttgtttgcaaaaagtaactaatttattaaattgtgcttcatccagtgggagctattgagagttggccacccatagaaaattgagggaggattttaggaactgctgaaggtttctgccacatgcatgattctgatataccctggaagaatccatctgagccttccccacatggacacagagtgtggaatgctagcagcacacagagggtggcagagcttgccctgcacgtgacagcacaggcgctgagatgtgtcccagaaaaatgagcaggtagaagcctacctgagacatccaacagaaacatccctcttaacttccttcctcctttagtgttttgaatcagtttatttggttgggaagtgtaagcaaggatagtgtacagagaagtaggaaaactactcctcttcttccacctgctctgcattagcacaacaggacaactctcactgagccttcctgtcctgaagatttcttttttcttttcttttctttttttttttttttttttgagatggagtcttgctctattgcccaggctggaatgcaatggtgcaatctaagctcactgcaacctccaactcccaggttcaagtgattctcctgcctcagcctctcgagttgctgggatgacaggcacctgccaccatgcctggctaatttttgtatttttagtagagatggggttttgctatgttggccaggctggtctcgaactcctgaccccaggtgatccacccgccttggcctcccaacgtgttgggattacaggtgtgtgccaccatgcccagcctgtcctgcagctttcaaagtgaaccatcttcgtgtatgtataatgagtgggttgcattcatatcatgtgtgttttatacactgaggtagattccagttacgtaggaatatagttagtaatagtgtattcctgaaaattgctaagagtggttataaagtattctcaccaccaaaatgataactgtgaggtaatgcatatgttaattaactaggtttaatcattccacagcatatacttcaaaacatcatgttatacacaataaatacatacagttttatctgtcaatttgaagttaaggaagaaaatagattggattttcttacaccttttaaatgattaaatattataaaaatagaaaccaatcacatgagagaaacatttactactgttgttgataaaagtacggggagaatgtaacgcactttagagtgaggaagattctctggattctaccactgcatctgttagcgccatggcatactgtggtaaaatggcactgttttccgatgctatgtacagcaagggatagcgccctgttttccccccctagagctaccgttacaagcatttgcttatgttatagccttccaataactaatatgttgaaaacaccaagacaccacttaaggtctttacaaagtgagaaggaattgggaaaaaaagaaacaaaggccgggcacggtggctcacgcctgtaatgctagcactttgagaggccgaggcaggcagatcatgaagtcaggagttcgcgaccagcctggccaatatggtgaaaccccatctctgctaaaaatacaaaaaaaattagccgtgtgtggtggtgcatgcctgtagtcccagctactggggaggctgaggcagaagaatcgcttgaaccctggaggcagaggttgcagtgagcctccagcctgggcaacagagagagattccgttctcaaaaaaagaaagaaaagaatgtgaatattgacatcacattaaaaaataataacaaactttagccttgtggcctttttttggcacatgttttccgctagttctcatgcatcatccctattctctctcttctctgtcttttcttcatccaggaacagagaaagaggacttagaaggaactcaacccagtacttcctaggattggaaggaagctgccttatttcatgtataagtggcaccagcttgactgtaggaagagagatagcgtgaagcctttcacatctaaactagaaagcttttaaacgtggtagtttgttgagttattctctctctgtggaatgaatgatgtagagatggtgagaaatcagagtgggtgattttagacatttccctttaccctacttcattcctgctctgtacagagccttgtttctgttcttcaccttatttctttgagcaagagtaaagcctctgattatgaaaatacactgtgcataaatagccagaaaacacattttcttgcaatgaaagatttgttttatggaaaatctcataaacaccatcaaggaaggttttggaagaaggtcaaatgtccttcaaaatgctattaccccatcaccattcacatcttagtgtgactgacatccgttctcagctctggtggggagaggtggacagagacagcagcactgtcccctgtggcccagggttgcctgtggggacgcccacccaagaagcaggctggagagaagtgccaaggggttaaccattgcctggatgatattttgtcaggaatctaatgtttttctctctcctgtagggggtgacaggtgctttgacagttttgatgaaagatgcaataaaaccaaacctgatgcagaccctggaagtaagtggttttcttcttatagtaattgtttgcattaactggattgccacacaatgtgaacatttttagccaatatgaggcaggcatagagcatgcctggggcagcagtgtgctttgcaatctcaggcagaaagagtgaggatctggttaggaacctgtattagtccattttgacattgctacaaggaactacctgagactgggtaatttatgaagaagcatcagaataacttcttggccaaccaaaaaaaaaaatttttaagtgtattcatagcttctttaatataagtcatgtcttggcttaattgacccgagtagaaacttagaaagtcaatgtctgaggccaggcgcggcggctcatgcctgtaatcccagcactttgtgaggccgaggtgggcggattatgaggtcaggagttcaagaccggcctgaccaatatggtgaaaccccatctctactaaaaatacaaaaaaattagccgggcattgtggcacacacctgtagtcccagctatttgggaggctgaggcaggagaatcgcttgaacccgggaggcagaggttgcagtgagctgagatcgcaccaccgcactccagcctgggcgacagagcgagactccgtctgaaaaaaaaaaaaagagaaagtcaatgtctaacatttcaataggttgtatggccatgtttacaatttattttctgtgttcccttaatctctcataatcattgagttgtggattttttggtttgcttttttattgttgtttgtttgtttccaagcaaaatacaataaatgccaagactttccaggaaagcatttgccaaaggcaagtcaataaacacacagcatgttagttggtggtaaggtctggagaagaaaaatcagaggtcatgaggggcagagtgatgtggggtatgtgtgtctgtgcctgcccgcctgttaaagcagtaccagcacagagctgagtaaaccaagggggtgagccatgcacgtgtcttgaagaacatttggacagagggttacctttagtgcaggggccttgggcagcaaggtgttttgcaatttcagacagcaagagcgaggatctggttaggaacctgtattagtttgttctcgcattgccgtaaggaactacctgagactgggtaatttaagaagaaaattggtttaattggctcacagttctgcaggctgtacaggaagcatggctggggaggcctcaggaaacttatcatggtggaaggcgaaggggaagcagacaagtcttcacatggcagaacaggagagagagggcgaaggaggaagtgctacacacttttaaacaactagatctcatgaggactcactcacaatcatgagaacagcaagggggaaattcactcccagaatccagtcacctctccccaggcccctcctccaacattgaaggttataattcgacatgagatgtgggtggggacacagagccaaaccatatcagaaccaatatgacagaaatggggggattggccaggcacggtggctcaagcctgtaatcccagcactttgggaggccaaggcgggcagatcccttgaggtcaggaacctcgagaccagcctggccaacatagtgaatcccatgtctactaaaaatacaaaataaattagctgggcatggtggcacgtgcctgaaatcccagctccttgggaggctgaggcaggagaatcacttgaacaggaggcgaagattacagtgaactgagattgcaccactgcactccagcctgggcgacagagtgagcctcttatcttttaaaaaaagggaatagaaaaaaatggggggaccatttctgaaggtgcccagtgaggatgcagactgcaggtgtcccctgagctgaggaagggaggactgaacgcctttgaacaggtgtctgcagccccgggggaggggtgcaggatgcacaggtgccaaggccacacccttctgcggcaggttgtccttcccgtctttcctctcccctgatcattctgccagcatgcacgtatcctcagaggtaggccatcttaaaaagcaaacaaaaacatttcaaaaacctcctgcccccacctgcatcctcatctagcttctgcccagctcttgtctgtcactggggtctccatgttaactgacctcgggttccacctctcctgactgcccttgtccaggtcacttttcccttggagacaccaagtctttgttgctgtgccctcctcagagaagctcagcagagtttgacacagctgcccttgtcttccttcaggagcacctggttcctctggcgtctggggtccccccctccccaggcctgctcgctgctcctcctccgctttgctggcttctctgatgacccctcaccttttttgccccgttctcctccagaattagccaggtgatgactcccaaactcttgtttggaatatcatgcacctggaatttcagacttgcaggtatagttaccaggagccacgtgggtggggaaaagccatttcaaactgatacataaaccaggacccacctcctacctacttccttccagctcgctgcttccctgaaaccttcccagtcattcaaggcagaaacccgaggatgatcctagaggcctgttttcccttcccctcttcctgtgtccatccctgcagagttgtccttggttacatgactctgccctgtccacgatgctcaatgcctccctccttcctgctttagctgccagcacgccccacctgcacgagtgcagcagcctcccaaccagtctctctgctgctactcttttcttccaaaatactctctcctcagcagccatagagactgaaacctaatgaagccctgttgccttcctacttagagttcttccatgatttacccatgtttccaccccggtctgaaaagccctagggatctggctctcaccccttcccgctccttgtcccttatcctcatctctcatcctctgggggacctttgcacggctaacaccactacctgggccacttcctgatattctcatgtccagctccttcgcctccctctgttctcatgtcatgtaagcatcagctgctcagagaagccacaggaatgtgcagcccccgtccctctgctgtcattgcagtacatggcacagaatgctgagagcttcctatttccttatctgttttctgtatttctcctcccaccgagatgacagcaagaccttttccatcctgttcaccaccgtatctccagcttctagaaagtgcccgacacctattagaggttcagtaaagacttgttgaataattaagtgaatgtttattatttttactacattctcctaaaaatacacatttattaataaataactgaataagagaaaaaatacgaagtgatgtgatattccttcataacacttctccctcaaagatgaatacttattattagggataatcattttctttattgttgttgtttgttttgttttgttttgttttgtttttttgagacggagtctctccctgtcgcccagcctggagtgcaatggtgggatctcggctcactgcaacctctgcctcccaggttcaagcgattctcttgcctcagcctcccaggtagctgggattataggcgcctgccaccacacccggctaatttttgtattttttttttaagtagagatggggtttcaccacgttggccaggctggtctcaaactcctgacctcaggtgatctgcccgcctgagcccccaaagtgctggaattacaggcgtgagccaccatgccccagccaggataatcattttcttgttttaaataattctttttttttttttttttttgaaacggagttttgctcttgttgcccaggctggagtgcaatggtgtgatcttggctcactgcaacctctgccttccggtttcaagcgattctcctgcctcagcctcctgagcatctgggattacaggcgcccgctaccatgcctggctaatttttgtatttttagtagagacagggttttaccatgttggccaggctggtctcgaactcctgacctcatgatccacccacctcggcctcccaaagtgctgggattacaggcgtgggccaccacgcccagcaaatttttgtatttttagtagaggcagggtttcaccatgttggccaggccagtctcaaactcctgacctcaggtgatccgtctgcctctgcctctcaaagtactgggattataggtgtgagccaccgtgcccggcctgagcactttttaaaacataatctaaacctgttatttctttgctgcctaataaatcagagattcagaacccttaaaaagcaaataaaagtaagggcaataagacctgctgaggctgaggcaggagaatagcttgaaccggggaggtggaggttgcagtgagcagagatcatgccactgcactccagcctgggcgacagattgagacataaaatagactgagaccctgcctcaaaaaaaaaaaaaaagagtcctcaaactgttcatatacaggactgggcttgctagggaaagaagggggaattcttcagactactttacaaggacacaagaactcctcaacctaaacaaagtatgaaggtacatagacaagtttcttgtaagtcggaaaacagagaaatccacagtaactataatacatcccttaaaggataagcatgcatttgtaggaagcaaacaaagctttccatagagaaaccacttccaccagatgattatatggacttgggttttgtttctgcatctgtcacttggcaaatgaagataccatcttcaggatgttccgtgtcatcgatttcatttaaggcataggctgttttaagattactttaaaagatatggacctttttacaaaataaaacactgcattcacttaaaatatttgcagacgtgaactcttgtaccctgatcctatgttgtcactctgggttttatgtatctaatcattgactaggaatctatctcagcagataatccaaaaatctagtttgactagttggtagattatgctttcccgctcacatctgaacacacctggttgttagtctggtaggaggtcatcaagggccacatccttacaggttgccaggagaccagtagttcttaatcctgactgcacttgagaagctcctgggaaggtttaagaatattgattgattgatgccgggctccccatcagacccagtgaacgtaatgtctgaggataaggcttgggtatcatgtattgccagactgaggaagacttaagacaagaaaacagtgagagctgttaacattttcccacaggttagccgtgtgtggtgttgatggaaacttcacatgcgagagcacactgtccaatatggcggccactggacatgtggccatttcaatctaaattacctaaacttcaataaaatttggaattcagttcttcagtcattttagccacatttccatttatgcatttatttgtttatattttactgttcatatttaagtgcttagaactctggtaagctaacaattacttgaaattacttgaaatattaatcttatgaaatgtttgaaagggccattatggagaatattcatagcaagatagttcctgccttattttcctgagtgttctgcatgtaaaataaaacccagaactcaagataaatgtgtgtatgcctttgagttagtcatagaattttttaagcaacatgtttaatttgatgtactgtatcttatagctatatccatgtttgagtgtgcaagtgtgtgtgtacctgtgtttggaagtctaacaatgacattccaatatttttttctcaccaactccatactgggagttttaaaaccagagccctaatcttgacttaattattaatttcctccgtggccctgaagaattcccttagcctctctgggccttaaatttctggataaagaagttggctgcttcgtgctctcaacattatctgattctgtgatttctagctaaagctacatttatacaaaaatataaagtgcttttgcaaagtaaagagtagaatagtggttatcagaggcagtgggggatggagaagttgaccaaataatacaaaattccagttagacaccacctgtgtattcataaacatgtgtccctaggttttatttatttatttttatttattatttttttcatttttgagtcagagtcggtctgtcacccacactggagtgcagtggtgcgatctcagctcactgcaacctccacctcccaggttcaagctgttcttgtgcttcagcctcccgagtagctgagctgggtttacaggagcacaccaccacaccctgctaaattttgtatttttagtagagacgggtttcactgttggccaggccagtcttgaactcctgacctcaggcgatccgcccatcttggcctcccaaagtacggggattacaggcgtgagtcactgtgcccagccaattgtaatgatttttatggttaccttttcttgaatggaatcatttcttaattaaaaaaataaatataccttttataccatcagggtttaatttcattcttttaaaaaaatatagtgcatggcaacataaaataaggtaaataatttatttcatggtcattgaggcaactaacaaaatggtttaacaatattttggaaggaagtgactgtattctcacagttttgtctctcaggttcagcattaaatgtagaataacatttttctagaatccggagggaatttggtcctttgattgagtcagggtgttttgactgtctttgaaatattttatgcattaaatatgcagtattcataaaagctttcctaccccatttgccccaaattgatcttggtttccatgcttctgtttgtcttttgggattttgatttgctttttcacttctctaggggacacctgtgttcgtgcatgcgggcccttttgctaacattgctcacggcaactcttcagtgttggctgataaaattgccctgaaactggttggtgaagaaggatttgtaggtaagttatttcttttaaatttagttgttgtagaatattgaagaaatctaaaagctgatgactggaatggagtgatatccatcctgacatgaaacatattctttcaggcaccctctttcatagagggtctcaataatggaaaagccctaaggtctggtctatactcgtgaaattatgcttgtgcttgaatcatagagtctggtatcaagtacatatgggtttgagtataaactctgactcttgcaaactgagtgacattggacacattttaattactactgagcttcggttttcttgtgtgtaaaatagtgataacaatactgtatcaaaccttttagggttgttatgaaaactgaatgagatattttagtcattcagcaaatgttttttgagaacctaccacttagaaggcatgttagctagggatccagtggtaagcaaaacagataggcgcagtggcacatgcctcgctactcaggaagccgaggcaggaggattgctcgagcccaggagtttgtgtccagcctgggcagcatagaagaccctgcctctgtgaaaaaattaaaattaaaacaaccagccttagcccctgctcctgtggagcgtactgtctaatggtaattgaataagagaaagtgctcattgactgtcagccattactacccttactatgtagtactgataacttgaagtcgtgggtttatttccatgtacagtttctccttgttttttgtgagctaatataggagagattcccaaccagtagacttagaaatgttaattggtagtactgcacaccttttgctgctgtcaagttctttgcagaacctgttcctctttggcttttcttgcatattccagctagaaagaaggggcaactctcatagagtttactaagtcagtgccagccccagtctcacccacaatactaaggcagcaaggaaacaaaagacaaaaccaaaacacaggcattcatggaggagtcccttaatctgacatatgagggactgcattggcagatttcccatgctaacaggtaattcccattaaccacacgtatacctataatcggagacagcaatctcttctttcactcttatcatcagctttggatcaaactcaaaagagttattttattagaagagagtgtgctggacaaaagaacttggcactgcattttatgctcagacatcacaaagttcattcagtgttattgagactcttttaagaattccttgtggactggcagtcaggatcagatgaggcttggtggagctccactcctccatgatctgttttctgcagctctcatgtactttgctccttcggtagcaaatccactgcaagagtggctagacatactgtctaagtggatttgctcaattgatcgctgcctaattgtagagctaatggacgaggaggctgggtcagggcgggcactggaaagttgggtgcttaagtgaagtggtggttctgatgcatcagctctgcaaataaagtagcttctagaaggaagcactctattttatgctgacagagatctctgcccataccagttcttactttgtcaaacacatatttataaaatacatgttatcatggcagaatactttcaaagatataaactgatgatgtatgcaaagcaaacgagccctctgtgtgaccttgaacaagccattagcctctctgggtgtgtcccctgtagacattctcatctgaaaaatgagaagttggaccagatgaggagttggatgtggatgtgtagccgtggactcagagttagacactgtggaattggagccctgactggtagtgtgttttcatttctctagggctcaattttttatttaataaaaagaatacttctgtattttaatgaataggatcaagtgagaaactgctttgtaaaatatgaactatgttcaggtcagcaattatactaattctttctatgatctcatctagtctaagatgccgtaagtgggggggtttttcatgaggatgaaatctgtccgttgccagatggttcaaagggcaagccctaagtcagaggttttacctcaactgctttcaagtcacagataaccttgggcacatgaacccttctcttccttggtttccctacctgtaaaatagggctttggatagggcttccctctcgaaaggacttggtaggtttgaaatgaggcatcaatgagatcatggggttgagtcctggcacctgacacatggtaagactcaatccttcttggccactcctggctgtcattgttacccccactattgatacactactgatgaaggttacattttcttttttctttggatctttttattttttggatgattttatttatagttgttataaaatacacgtaacatgaaagttaccatcttcaccatttttgagtgtacgttcattagtgaagtacaccttcattgttgtgcaaccaagctgcagaaccgaagtcccatgcccattaaatattcctcattctccagcccctggcagtgcccttctactttctgtctcaatgaagttgactcctggataccccatgtgagtggaatcatgtagtatttgtccttctgtgactgacttatttcacttagcataatgtcctcaaggttcatccatgttgcagcaggcgtcagaattctcttccttttttttttttttttttttattttttgtgagatggagtttcgctcttgttgcccaggctggagcgcaatggcacaatctcagctcactgcaacctccgcctcccaggttcaagcgatcctcctacctcagcctcccgagtagctgggattacaaacatgcaccaccacgcccagctaatttttgtattttttagtagagatggggtttctccatgttggtcagtctggtctcaaactcctgacctcaggtgatccacccatatcagcctcccaaagtgctgggattacaggtgtgagccaccacacccggctagaattctcttcctttttaaggcggaataatattccatcgtatggatagaccatactttgtttatccactcatcctacattggacatttgacttgtttccacctttggctcttatgaataatgctgctatgaacatagatgtacaaatatattttaatgtctaaaaatcgtgctctatgatgtctaaatatgtgatggcaatgacttatattcacaaatacgtaccacggaactctagccctgtaatgttgaactctcccgaaggtggtgtgtccatgctgtggctctgttggaatgctggtggcaaagccagtgtattgcacagtgggaacggggtgtggtcaggagacagtgttccttgcccattgcttggtcaagcctgcactgtggggctcgttcattccttgcccttggatgaagtttataatagttccctctcattctcagttaatatctagtccctctaacacatatattttttaattcctctggtcactttcaatcataagaatagcccctaaaattaaaaatgcatatccagttgtatatcaaaaccaaaaactccaaatgtcactcagacttgagctcctctcctcccctgtctgggcctcctctggctgacagtgggaaggggaaggtggctgcttgcttctctgccacccttgtcttgcacttgggctcgccctggcccctcctaggttgaagctttggcatgaaatggtgcccatgtagcctctaccagcagacgtcctcacacttttggcagaagccccctgagcagtacctcatttagactttcctacctctgattccacacctggtctcgggtaccacagacctctgacctctggctggggacacgccctgagccttgccaactggtcttctggtcctcacttgtggcttaagggggaagcggggacgccaaggcgggtggatcacctgaggtcaggtgttcaaaaccagcctggccaacatggtgaaaccccgtctctactaaaaatacaaaaaaatttagcggggcttggtggcgcatgatgtaatatcagctactcaggaggctgaggcaggagaatcgcttgaaccccaggaggcagaggttgcagtgagctgagatcacaccattgcactccagcctaggcaacagagacagactctgtctcaaaaaataaaaataagggggaagcagcttcgcatgctcttcactgggagctgggaggggagctggatgtggcacactgataactttctttgaagaaattctttcccaggttctaacccgtcaacccttttgaagcctcaatgggctaaggcatacaaaatctatttcaaactgctttgcaaaccctcccaggtcagccagcaccatcctttggcatgtgagcaaattgacaccaatttgaggcccgaaacaaaagtgagacaaaaagacgttcatttcaacatccttctacagaagttaaatagagtaggcacatctgaggtgtatctgaagtctgagcaggaattcatgttcttcaaaaagttgtcgtttatagtagactatctttatgacctcataatagggaaggatctcttaaaatatgaaaagctcaaaccatagagaaaaatgtcgataatttggcctgcattaagaagtaaactgtatgtgataaaagatacaaggataaaaaacaagtgacagattggaaagaaacgtttgcaaagatagtagacaatgattagcattgagaatatgtaaaacactaaagactaaagactgataagagaaagacaaataatccaatacaaaaatagagaatttgaaaaggtgattcgcagcaaatgagcaatttggtggaatttctaggtagaactgaaaatgaacaaatgatttagcaatttcacttctatgtatactctggaaaagaagtagtcaaaaatatatttaagtcctttgaaataattgacttcagtacccctttaatgagcatttattaagcttctgctatatgtcaagtactatctgctaggagctgggaatcaaatatgaataagacaggtttcttgccctccagtaattgatgatgtgctgtgagagacaagaacttcaatggtaagtacaatgcacttgattaagtactatattagttaaggttcttaactaagaatttcaagggatgatgggcatctcttagatagaactgtctccatattactggttttgctgatttagtctaatttttgttctaacaaaaagcatacacaaggaaggaattattttgtctattctgaataattagtctaagataatagaatcagtagtccatttagacttaaaacagagtgacatttattttaaaaaagcatgaatttgcaaaacactttatgagaatttttcaaaaactgctgtgatcactgttgtggctgtttcttccgttagtcagcagtcctcatgggagttcacctaacttccatttacatgctgtaaaggcaaacagatatttggcatcgaattctaatcatgtattacatttaaaaaataaagcaaaaggaaagaaagaaaggaaaaagcagtattgagttcctggattttaaaaacattattatctcatctttaaactatttgtaggaatttcaaacttacccattaacttaggattttttaatttgttttctgctctctcagttggttttgattccagttttcagataaagatcttgtctttgcagaggagtgcagaatgcaattgtgtatccttataggcaggtgtcattaactgagggtcaccagccactggtggactcctggatagacttcgatctacaactctgtcccataattaaatataggttcgtgcatatggagacatatatatatacaccttttttttttttttttgagatggagtcccactctgtcttccaggctggagtgcagtggcgtgacctcagctcacggtgacctccacctcccaggttcaagcgattctcctacctcagcctcttgagtagcttggattacaggcgcatgccaccacactcggctaatttttgtattttcagtagagacctggtttcaccatgttagccaggctggtctcgaactgacctcaggtgttccacccgcctcggcctcccaaagtgctaggattacaggtgtgagctgccgcacctggccaccttttttttttaacctggagaaaattacacaattcttggattctcacaggggaccatgacataagagagagaaagaactgttggtgcatatctcaaagcctagctctacttttgacggtagctttcgatgtcccatacacatttggcatttattatccttatccagaggtgcttgtcaagaagctacctaattgattgcaactctgctgcttgctctctgtagagaatcacacagacctggctgtgttccccaggtgcttcctgggtacatgagcataaacactcatgcagcagaggagaaatatgagacaagtgcccaattaaaacacagggtgatctttgcctcagacatttcaggattaggatttagaaatcagaatgaatcgacttagcagttccaagacaaattgaatgggattgggaaacaaagccttgttaatattttcattaaaaacgcccccgtttctgagccattcctgagcattagaccggtgctgagactatcatataccttctcactcaatccttaaaaccgtctgtgggatcagtgttactatcctcatcttacagatgatgtaacagaagcttagcaagatgatgatacatgtccacgatcaatcagagagtaagtgacagaggacgtgacctgagggctcctcctcgccaaagcttgtgggtgatcaggcggctattgtgctcagtgtttttctcaatgctctttacctggttgccaccctctcccattaaaaaataattttagctgggcgcagtggctcactcctgtaatcctagcactttgggaggccgaggtgggtggatcacttgaggtcaggagttcgagactagcctgaccaacatggtgaaaccctgtctctgctgaaaatacaaaattagccgagcgtggttgtgggccctgtaatcccagctacttgggagggtgaggcaggagaatcgcttgaacctgggaggcagaggctgcagtgagctgagattgtgccatcgcactccagcctgggcaacaagagcaaaactctgtctcaaaaaaataagaagaattttgggtgagctgtctacagcagatggtcacagttacaggaagtaccaatataactatattgtaccaatatatcgtaatgtgcgccaacagtggtggtcctttttggtcctttttttcttttctgtgttctactttaacatttcttcctcccaagtaggttactgattgaagatgaccttatcgagtcccactgtttccttgctctacctctcaacctgtatttttgggggacagttttttaatttttttattttccttttttgagacggagtctcactctgtctcctaggcttgagttcagtggcacgatcttggctcactgcaacctccgcctcccgggttcaagcgattctactgccttagcctcccaagtagctgggattacaggcacgcaccaccatgcccggctagttttgtatttttagtagagatggagtttctccatgttagccaggctagtctcaaattcctgacctcaggcgatccactcacccctgcctcccaaagtgtagagattatagctgtgcaccactgcacccagcctaggggacagttttataatcagtcttcttggccttcagaggactctgctggtggctatacccagctagtggcttgttctctctttccacttttattgccctgaaattctaaatattccatcattttggtagaagaaaaccagaccaaactaaacattctcatgatttcatccacctttaaaaaaaaaaaaaaatctgacgtcaagtgatcctgcagctctaagctgtaattctcccagaccttgccctgtttacattatttaaaaacactgatctcagcctgggctccacttttgttattatgatgcttccaggttttttgtctttagtaaatttattcataattaaatcaaggttgagaagtgctggcttattagagactctggctgaaggtcatgtgcgaactcaggaaactgctaatcacaggtcgtgtttttcagcccctgtcttcaggaaggcttaactctaagggagggttgttttgtgtcatctccagagctctcatttctcctgtgtggcttggtgccgaagctcattcgtcccctcgctgtctgttcggcccttgtcctacctcccctttctctttccacgcttttgtgtaaagtagccctctttcaagctgctcctctgtcctttgaaaacaaatgaaaaagcaaaatgttcttcatatacactaaacaggaaagtatgcaaagtaatgttacaaacacccatgttcccaccactctgtttcatcaaaatcttaacatgtcgctgtgtgtcctttagtttttttgtttttttaaagagatacgtttagctgggcatggtggcgcatgcctatagtcctagctacttgggagtctgaggcaggaggatcaattatgcccagcagtttaattctcctgggcaacagagtgagaccctgtctctaaaaaaaaaaaaaaaagaaagaaagaaaagaaaagagagaagagaagaaatcagatattagagacacagttgaagttcccgtggaccctcctgatcccgttcttttttctgcttctctcctgatttgagtgattatcgtttccgggtgtgtgtttctactttgaccacacacatatatgtacactagagatctgtagcggaggttctcagactttctctgctcgtgaccattaatggcccagcaatttttttcatggtaccgcccgggcaagagaaatacctaacatgtccatttattaaataggtccaaacaacttaatgagtatttatgtccttacaactaagtggccacctgaaaaaaaaatacatatgaattcgaaggaaaaaataacatcatttcatttttaaattaccaccatatgttatgaatgagatgtgtgtccttgtcaggcaccagacaacttctgaccctttgtaaccagttgacacccgcacctcatttcctgttccacgttgattttcacacgatttttgcattttgctgcggtacctgccaaaaactttgctttgcaaatatatgatgtcatggaaagggatgtagagcactattgttgaagcagtgaaaaacctcacatgagtagtatttgcagtgtccaacggatgtcctgtattaccgcgtttccgtcaaaaatttaaaataccccacggtgcctctgagtttgctgcaatgcctcacggcacctcattgcacattagaatcacagatgtgcggcttttcttggtattttttatgtgttttcaaattttatatattaatagatattaactgactgcattgttctctaatgaggtcactgcactttttctgtaaatggcaagatcataaatagtttgggtcacagagtctctgtcccaagtactcaatttagaaagcagccataggtaaagcatgaattcataaactagtccatgtttaggaatgagtctggctgtgttccaacagatgttattattggttcctaacatttgaatttcatataattttcacgtgtaataatactcttctgatattgttggcaacattttaaaaggtggccaggcacagtggctcatgcctgtaattccactgcttttggaggccaaggtgggaggattgcttgagcccaggggttcaagaccagactgggcaacatagcaagatcccatctctataaaaaaaatttttaattagccaggtttggtggcacatgcctgtagttccagctactcgggaggctgaggtgggaagatcacttgagtccaaaagtttaaggctgcagcaagctatgatcacacctagctacttggtaagctactatggacaacatggtgaaaccctgtcttgaaagaaagagagagagagagggagagggggagagagagagataatactttttaaaagagaaagaaagaaaagaaagaaagagaacactttttaaaaggataaataatttttaaaaacttaataatttaacatgtaaaaaaaaaaagatgtagaccatatacaaaacccagaggcacctggatttgtcctgctagccatactggccaacccctgctctataacttgatatttttgtgcaacataacagttttgcatttctctatgtcactgtgatccaaaaagcctcattttgcctgcagtttagccttctgtgcgtgcatgtagcacgtgcatttgtgcattatttgtcaaggggctttcagattgcttccagtgttctgctgttacaaataatgctacgggggacattcttgtccatgtctctgagatttagtctaaaaggtcttctagggactatatacaggagtgagatttggggggttaaaagtacgcttagcaacaacttaatagataaagccaaattgttctgcaacgtaataccaatttatatcactaccaattgtgtgtgtgagatttctgacctctccacgtttgtcctgacacttcttttttttttttttcttgagacagagtctctctctgttgcccaggctggcgtgcagtggcatgatctcagctcattgcaacctccacctcccaggttcaagcaattctcctgcctcagcctcccaagtagctgggcttacaggtgcacaccatcacacgtggctaagttttgtatttttagtagagatggggtttcgccaagttgaccaggttggtttcaaactcctgacctcaggtgatccacccaccttggcctcccaaagtactgggattacaggcatgagccactatgaccggctgaacgcttctattgttagatttttttagctcttgctaatctgatggtagttcattatagttgtgagatttagcatctttatggctgtttctgggcatttgtgaattgtctattttgtattgtgctatttacctttttcttactaattaatggaaatcctttatagattccgaatacgaatactttgccattatgagttacaaatatcttctcccctgtatggcttatcttttaaatatgcttgttgtaccttttcttgtccacccttttctttatgatttctgcttttggaggttataaagataatcatttgtattgccttataactgttgtctcttgcattgaggcctttaatcatcttagaatttgtttgtgtaatggtgtcttttttccttaactcttacagtttgtgagacttttctgccctggtgatatgtgcatcagtggttgttagcccagccctatgaaaagggccagctggcctccatagatctaaggcagccgagagtgctgtcccctttgtcccaggctctgcagcatccaaggcgagtgcagatggggccagctgttcttccaaaaccatcatctcttctttacctgctccttctgagcttcacctgacatggctgtgcagtccccaggaaaaagaaagtctctcttgtcttcctacttcctaagtcaatcctaggaactgttacgttcaattccaagcagttgtcataaaagaagtttccttggaactttgaaaacaaaagaaagggtttaattttcttcttttcgttttgttttgttttgtttttaattttttgagacagagtctcgttctatcccccaggctaacagctcactgcaacctctacctcctgggctcgagcgatcctcccacctctgcctcctgagtagctgagactgcaggcacaatccactacacccagccaattgttcaatttttttctggagatgaggtctcactacgttgcccaggctggtcttaaactcctgagctcaagtgatcgcctgcctcagcctcccaaaatgctgggattacaggcatgaaccactgcgcccatccaaaaggatttaattttatggtcaaattctacattgtctattgactttaatatttttataaaattctttaaataaaatgtctttacctggaataccttcaatgtacttactggattagaggcaggtaggtcctgtttgtatggctagtatgttcattaaatatgaaagtaatggaaagatgtttatgacataaggagagaggaaccttcgcctgtcaggataatagaaattgaaagatttttatgacctggctcagcagaaaaaggagtatatgatgttagcaattttttagaattgatttttcagaagaaacatgcaaaacaaatgagaattaagtagctagaaagcctttttcccccctttattcagataaagtaactgaagacttttaatgagaagcctggtttctgtctttctacacggtgcactgggaatagtaagctgttagaagtcagtgcttagaagtacctaccatcctaaacacaggaaccaaaaacaagggaaaaaaaaaaaaaaaggaagataaataaagtaaaagtaaaaaagtacctaccgtcccaaattttgtatatgatgatgttcacgtttttgaacttacacatattcttctgtataagtaaaatatttcataaaattaaaaatgttttataaaattaggaacagaatttcttaaagatcaacatggtactaatacatcttacaatctgtctttcaaagtttcaatagacttaacttagagtcattttttaaattgcattttgatgccaatataattcatgtgtcattttccgctataatacaatgaaaatccagataatggagatggattttcttctgagtagccacgcatattaggtttcaggctccaattgcctggttttgaattgctctttgccatgtgctgtctgtgaccttgggtgggtcacttcacctcccccaaatctaggtttctccaatacctacctccaggcttgttctaggcatgaagtgcagtgatgatggagaaggcatggactgtggcacaaatagaagagtcaggggttggcagctcctattcccactgtacgatgccaaggatctttacctataggataagccttcagaaacataatttggtctttcaagtgctgaatacctctgtgagtatacttttttccatcttttttcttttggtaaatgaaactcactgagaaatttgacttctgataatgggaaacagtgctgcttatgtgttctccttgtacaaaggtgtctgggaccattatacttagaggtgatctgagaaatcggaggggctctgattgttttgaaaactctcctttgaggtcgggcacagtggctcatgcctgtaatcccagcactttgggaggccgaggcgggtggatcacttgagaccagcttggccaacatgatgaaacctgtctctactaaaaatacaaaaattagccgggcttggtagcatgcatttgtaatcccagctacttggggggctgaggaaagagaattgcttgaacctggaaggtggaggttgcggtgagccaagatcacaccattgcactccagcctgggtgacagagtgagactctgtctcaaaaaaaaaaaaaaaaaaaaagaaagaaagaaaaagaaaactctcctttgaattaaggtaatccttcttgaaaggcttgtttaaaatgtttccttgttacctgggagagagcaggaagcactgggaaatagcacgtcactggtgcctcgtgccatttccgtgcctttccctgtcttgcctcagccttgcactgtggaatgcaaaagagtagaagaaactccaacgtgaaaattgtcgacaaacaatgcagagaatcttcggtggcattaaacattaaaattaaagacacatggtcttaaattcagctgatatacttgacacctcagatatactcttggtgccaaaagggatgttaagcaaaatttgagggatttgactccttatttgggaaagaccatgactaccaaggggagagaaaccagaggcaaaccttattgaaaaatggagtagctaagtcattttgtatatgttacttttacccagccaagtacagtctgtagttttacacagtgaatttgatctttactctaaattcttttcctttaatgaaagtgctagtcagtaatgcagaacttgggcaagttttataaatatgtttgctttacaaccagtcttattaagtcagggtatcatctaagggcccaatcaaggacttttcatttaaaaaagaaaaactctaaattgcattgtgatataacccttaaattccaactgtcatggggaatcccaagacctacatctgtatgtatgtgctgtgttctaaacactgctccccaacctttttggcaccagggaccggtgtcttggaagacaacatttccgtggttttgggattaaacggttccacctcagatcataaggcgtgggtcctagatcccttacatgcgcagttcacagtagcattcacactcctatgagaatctaatgccactgctgatctgacaggaggtggagctcaggcagtaatgctcacttgcccgctgctcacctcctgctgtgcgacccagttccttacaggggctgcagaccagggggttaggggtctctgtttttgtttttttggagatcaagtctcactctgtcgcccaggctgaagtgcagtggcacaatatcggctcaccacactcttcacctcccaggttcaagtgattctcctgtttcagcctcccaagtagctgggactacaggcatctaccatgcccagttaatttttgtcattttagtagagactgagtttcaccatgttggccaggctggtctcgaactcctgacctcaagtgatctgcccccctcagcctctcaaagtgctgggattacagacgtgagccaccgcgcctggctggggacctctgttctaatatgcttaccatgccaaatgcattatgaagaaaaacagaaacaaggcttttaatgttaaagtcttattttctcgctactgaaataggcaaaatgtttcaattttgcaaaaataatatagtattgtgtataggatcttccctaacctgctttttacatttaattaggcttctacgagtcattcgggtagttgcatctagcaggctatttatccattctttatagaccctttagaggtttgagacccctttatagaggtttgagagccctttcttgccccagttctcttgtctgtaaagctgtaggaaataatatgacctaacatacaaggcagtgtgaggacagcagaagtgacttctgtaatgcatatggtgctgttccaggcatggataaatctttgctaacagtcgtaagagtttacctcctgtgaggacctggctacgtgctgagcaccctgcttggtgctttgtacattgtgactcattcagttgctcaaacaacaccatgagtagtttaccagaattacccccatcttgcaggtgagaaaactgagcatccgagtgagttagtagtttgctcaaaggcaggcagctagcgcaagggggagcaggaatttgaacctgagtgtcggccccacagcctttgcttttaccaccgtgctttgccacctctgaatgttcactttcattccatagcagcatcatacagccctgtgcataacaggaagtgcacgtttgttaaatgagaaactagtaacacttctggtagctgaatgacttaactactggtaaacctgtctgcatggccactaggctttttatggtgaacacaggcatattttccatgtgctgtgttgaagcagcaattaaataaatcaggtaaaagagtaattaaatttaaaaggtaaaacgttttggaaggagttttgaggtttagggctgtctaacctgaccttgactgtttctctatgtgctgtaagatgcagattgattttcaatgagatattcagcccatccctgcttatgatttatatatattctaagtaatatgcttagaatgtagttctgcttaccatcataaaatgtggagttaaaataagatccttgtcaaaacattgtcatgcagagattagtgctatgaaagttaacattaaatgattttaaaatgtgatccagaggttaaactgaagttttgaaattcataaaatgcataagctttttgagaatttttaaaaatatccgttacataataactttaaaattacgttatatgattgctatcttaccccatcttagccaagagcattcagcctgaggatactcaaaaagagtcaaattaccccttccttgtataagctatagtttaggatattgcaattatatgaggtcgttttaaagtttttagcaacgtttggtataattacaatattgtgctgttcttacacaaagaaaacataacagaattttgagctaggaatattgggaaaccagccattgctaaaggaagatgcatttagtgtatctttctatgtacctcttaacatcttttgtggggtgtagaaaaacagattattagggctttctttttttgtggggggggcgggagcggggatggagtttcactcttgttgcccaggctggagtgcaatgatgtaatctcggctcaccacaacctcctcctcccaggtttaagtgattcttctgcctcagcctcccaagtagctgggattacaggcatgtgccaccacacccggctaattttgtatttttagtagaggtggggtttctccatgttggtcaggctggtctcgaactcctgacctcaggtgatctgcccaccttggcctcccaaagcgctgggattacaggcatgtgccaccatacccagctaattttgtatttttagtagagatggggtttctccatgttggtcaggctggtgtcgaactcctgacctcaggtgatctgcccacctcagcttcccaaagtgctgggattacaggcgtgagccaccacgcctggcctattagggatctctaaaagccgcaagcctcttgctagccatagctgtgaatgttgtcttaaccattaatgcttcagtataaataatatcaatttaaaagctgcctaagatttaaaagtactatgcaaattacaaactgcttgggtatctagatcaaaataaagcagagcaaagaagtaactttaggaatgaaagggtatctaagtggaatgataaaggaagacttcatgcaacagaagaatttaagtaaaactgaaaaactgaaactaatgtgatcatggcattaaatagtgtaaccctgaagacgcatccagtatataaggaacaccacagcagtgcctatactcaccgttattattcatcattattctgaagcatgaataagaacaatttcaaaaattataaatattggaaaggaagagacacattttattatttatgtacagaataattatataactagaaaattcaagagaggcaactgacaacttattttaagtaataaaagttttagtttgctagtggatgcaatgtaaatatgtaaatgtcaatagttttctttttttgttagccataaatacatactgtaatagagaaaatgtcctacttatacatgtcccccaaaggatagaatacttaggaaataagtttagcaagaaatgagcacatagaataaaactataaaactttattgaaagacaaacaacaagacctgaataaatggtaagacacatgacatactcttagatgggaataactggtattaatcatccttcctctgtcaaactaacacctaaattactataaaattactatactatatcatgccacactatactatactgtatttactgtaaaaactgcagaggaaaatgaacttcgtggttaaattaatcacagcatttgtctagattctgcaagaatgaattcatgaggatggatttaaaagctttttcaaggccgggcgcagtggctcacgcctgtaatctcagcactttgggaggccaaggtgggcagatcacttgaggtcaggagttcgagaccagcttggccaacatggtgaaaccctgtctctactaaaaatacaaaaattagccaggtgaggtggtgcgtgcctgtagtcccagctacttgggaggctgaggcaggagaatcgcttgaaccagggaggcagaggttgcagtgagcctagattgtaccactgcactccagcccggcgacggagtgagattctgtctcaaaaaaaaaaaaggctttttcaagaaccatgatggatgattaaactaattgtaagtatcagaacaagataaccctatagcaaaacagttaatagcagaggaataccctggagtgtcctgagatagatttcttccagtagtaatttgataagatgacattttatttttatttttatttttttcttttcttttatttttttgagacagagtttcactcttcttgcccaggctggagtgcaatggcgtgatcttagctcactgcaacctccacctcccaggttcaagtgattctcctgcctcagcctcccgagtagccgggattacaggcatgcgccaccatgcccagctatttttttgtattttttagtagagacagggcttcaccaggttggccagcctggtcttgaactcccaacctcaggtgatccatctgccttggccttccaacgtgctgggattacaggcatgagccactgcacctggccagatgacattttaaattagtggtgaatggatgggatactgattaaatgatgttggaacatttgactaataattttaaaacataaaccatagagtttgttgttgttgttgtttgaaatgtagtctcgctctgtcacccaggctggagcgcagtggtgcgatctcagctcactgcaacctccgcctcctgcgttcaagtgattttcctgcctcagcctccctgagtagctgggattacaggcacatgccaccatgcctggctaatttttgtatttttagtagagacggagtttcgccatgttgtccaggctgctcttgaactcgtgacctcaggtgatccatctgcctctgcttcccaaagtgctgggattacaggcatgagctgccatgccctgccaaaatataaaccatagagctttgtatcacaatatattcaaaataaagatagagtgactttttactttttagtgtgcaaattaaacataaagcttccaggaaaaagcaaaaaaaaaaaattattgttggtatcctatcaaggctagtaaaaagaatagataaatgtatacatggaacatgggaaaacattcacaaaatataaagttaaaaaaatcaggttgtaaaataatatatctccaatttgtatgagatttatatctatatatggaatgaagagatatagaagtatatcaaatgattatttttgtttgcctggaggtaatggaatcatggtgattttcacttcacactttgtgatttggcattctcaaatttttacaattactgtgtattacttttgtagtagttttttttataaaaggaaaaaatgacttgaaaaatcaagtaatttgacatgtagacacagggaaattacattcgaggcagagagcaaacgacaggcatgtgactgtagctgacaagtgtcagcagattgtgggcatagtttagagtctaagacatctgggggagatgagtttcatcattagatgaagtcatattctggaggggaataaatgctaatctgaaatactatgctttcaattgccagtgaggagaaattgacagttttgaaatagtggtttcaggaaggctctcctgagaagatggcactgaggcgagccttgaagaaggtgagaggggagaaagattggcctgtgttcaaggaatcaaaatagttcgctagttcagagacagggtaaagcaaatagactggagtctcattcaatgtctttaaaagtcatggagaagagttagtatagtttctaatccatgaggacttcctgaatgattttgccaggactgtactttaagatactgtttctttccaaccccccatcagataagtcataccacttttctgaagtcgaataagtgaagggaaagagtggacaaattgttatctaacagggctccctccccaggaaaggactccttcgtcagtaagagatgtgcacgtggtataaccaacaatgctacttctgggtatgtccacactgctggagctcagaaatgcacaatgaaaaaacaaaacgggttgtggaagtgtgtatacaatctgttacatttttgaaaaacacataacacaatgctatattctgtttatgcatgtgtgcttatgtagaaaaagtctgaaaacctgatctgcataagctctgagttcataggagttatgaccatgggaagaagtagaggggtgggatgagcgcatgggatactgaactcagctatgctgctttacttctctgaaagaggaacaatcttaagtaatcatggtaaaatgttaatgtttgtccatttcagggtggggaaggaaatttaggtctgtaatttaggagagaggttgaggccagagccaagattggcagttgtgatgagtatgtggttacatcttcactttttttagaactaaatctggatgtcaatggccatgtttagtgggccaggggccttacattactttcttgcagcactgatggcttttgtttgaggctgcacaaattcctgcatttcccttgggttgaatggtagggatgcgggcagttggtgactgggtgaaccacctgacttgagcagggctacgactctctctgcaaacgaaacccagagacatgaacagtgctgagatttctcagtggtttcccatgtaggctgctttccaagggcagcaagcatggcttcatcactcacccagtgcttctgattcagcactgtgatgctcggttaagttttaatgaggttttaaattttttcgtatgtttgagtgtttatgcaaacaaagatgctgaattgtaaacaccagcaatctgagtaccttcttttgatttctctctccatattgtttagtccctttttctttgtttgttttatgaaattgcatagatgttttggttgagagtagattgtttttacttttcagggacaggcaacaatttcatgatataacttctaaaaatattttaaacaagtatgaaaatagttttttcttccaaaaaaccatttcttcatttggcacatacacaaacaaatgagcagaatttagagtaatttagagacagaatttagataatttgggtgggtttttttttggacagtcttgccctgttgtccaggctggagtgcagtgatgtgatctcggcgcaccacagcctcctcctcccaggctcaagcgattcttgtgccttagcctctcaagctacaggcacacaccaccacgtccagctaatttttgtatttttattagagacgagtttttgccatgttgcccaggctggtcttgaactcctggccttaagtgatcctcctgcctcggcctccttaagggctgggattacaggcatgagccaccacagccggcctagtgtgaaagcagtttttaaggacagttgaacaggaaagctcctggattcctgcacatagatcttgtgcccctccaaagtgccgtaagtaccgatttctgctgtcttgatttaactcagtgtctggagcttacgatccttcctctctgtttccttcagtggcgtagcttgggggtgtcaattaaagagttattgcaagatctcagcctctgaaagtttagcttattcatcagcaaaactttaagcaagtctcacctcttctaaattagaattgtaaccttgactttagtctcagagttaacattgtgcagaaaaagaaaacactgcgcagtgttgaagcagtttgcaaactgaaatgatacaaatgaaaaatgctatgatgtttctcagtagtctctgtatttgcaaatgagtcagttaggattagttttacccacaaataacaacaacagtaaaaaaaaaaaaaaaagaaagaaagaaagaaagtgacccagcactataatacaagtttatttctctctcacatcaaggaagttcagggtagccagtctgggctggtttagcaactccttgatcatcatgggttctgtgctacctggtagtccaggatggttgcacaagctccagccattgcatctgtatcccaatcagcaagaaaaaggaagaaaggcatacccccttttcaggaggcttcctggaaatcacatacaacatacctggttacatctcatcagtgaccttagtcacacagccatacttagctgcaagacaagcgaagacattcagattctacctcttcttcttgaaatagaaaggtgagttgccaatccactgtcagcgtgacgacagttcaagaggttttcctagacacagagttgagttaatcccgtcatctgtgtcatcgtctctattttgacagcatctgtcaggtggtcaaccagagtttaggcaagaagacctatgacttctctacacagacatgattaggattatcttctaaatcaaccaaactgaccagcccaccctttcattcttctgtgcatcacagatcatttttgaaaaagagtttaggacacatccaatagtaagagtgtagttttataaatcaggactcagtcttacagtggaagattatatggtagttagtgtcatggagaaaagcttcatattagattagttgaatcgattgggatacagaaccgtctttagagcatggcatcgttacattgcagataaagcatgtaggtagagaatgatatctttgttggggagagccccaaactgctcttcaggaacctttctccgagatttgcaagccaattaggcataatgaaaccttgtttttaatgcatatcttttgccagtataataaacataataattaaatgtttatatatctttcgtattttcctgtataatacaactaatcatatttttgtcaggctgaggacatctcaagaggagggaaaggtggcaaattgagggtctgttcttcttttataccagatggcaattataacaaattacttctggacttagggatgggggaggggtggggagatgggaacatgagaattattcctgatttttgttactttttgtcctgtaaaatatgcttaccaggccgggcacggtggctcacgcctgtatcccagcactttgggaggccgaggcaggcagatcgcctgaggtcgggagttcgagaccagcctgaccaacatggagaaacactgtctctactaaaaatacaaaattagccaggcgtggtggcacatgcctgtaatcccagctactaggaagggtgaggcaggagaatcacttgaacctgggaggcggaggtggcggtgagctgagatcacgccattgcattccagcctgggcaacaagagcgaaactccgtctcaaaaaaaaaaaaaaaaatgcttaccgggacatctcaaggacatcattcctttgtcaacggtacaaagataacctgagacataaagtgaaaatgatttatggttttttgttttcttccttacattaaattttccaataacatatcgctaataacatatttcttttgttttgagacggagttttgctcttgttgcccaggctggagtgcagtggtgcaatctcgactcaccgcaacctccgcctcccaggttcaagtgatttctcctgcctcagcctcccaagtagctgggattacctgccaccacatcaggctaattttttgtatttttagtagagacggggtttcaccatgttggccaggctggttttgaactcctgactttgtgatccacctgccttggcctcccaaagtgctgggattacaggcgtgagccacggtgcctggccaacatatttctaataatatattaatttgataaacagaagttattttggaaataagccaaaacaacaaaaaatgctcatccctgcttttcaaggctattatctgtagtttgaggttttatcaaatgtagatatgaactgcgggcctcttcaggatgtcctcattgcttctgttaatgcttttaccatccagtaccactgaacaggcagcagggtgccttcttgggcacaccggaaggacccaggaaaaggaagatagtgtggcctgttcttgtctccatgccccaaaatggaccactacaccagtggggtaggaaatagcaggtgtgttatgggttgagtttggagaccttgacttgatcaaccatctgctcacccaggtcatctttcctttttttgcagaggtgaggtctcactatcttgcccaggctggtctcctgggctcaagtgatcttaccgcctttacctcccaaagtgctggtattacaggtgtgagccaccatgcctggttcttgtcaccattcttaacatcagcagcagcagaaaaaccccctgtttagccttcaatgttaatttcctccttgatctatgtgttctacacaaaccactcccttgttgtcccccatatattacatttgtggactcttctcaaactctgcagctcagccctggttcctgctgagcctacagccccaggcctgagcagccggctgggccaagttaccctcagtctcaagatgacttcctcacaaggcaaaacatttctccagctgggttggagacctaagctggggaactgggctctcacattccaagatagaggtttgcctatggacccctgaaagtaggcgtgtagaagcaggttcctctgatggcagaggccctctgtttatctctgaaagatcctgaatgctatgcttctttcatcccctctgccttgaattcgcctgctttctaggtgcggtggagaaagctgggaaaagagccacctctgctcccaggggccactgagagggtagaacactgaccgaatcccagactcactacctcaggggctgagatgggtccaaaggggcccttaacctctcacttgatcacctgactcttaccgctgtcattgatctgacatgttctcctgggcgctgtcccagctctgtcccagcttctcagcactgtgtcctggtcagccctgagggctcatttcctttatccatactgaggaccaagacctgtctttcctgtagggcagtgagggccacgggctagtgcctgagccgatgagtgcactgctggtactgtgctgagccctggacaagggtgtaggttgctctaaaaaacaacttcccaatattctacaaaataacgttcaaactgaacagagcttgactgaagattcttcttacttcatttgttttcatgctacatttttgctgtccggctccaagtctgtgacaatgggtcacgggatcagtgcgagtaacagtgaagatgtttttcttcatctttgggctatgattgtgctttgtgatcctaagtataaatacattgaggctgggcacggtgtctcacacctgtaatcccagcactttgggaggccaaggcaggtggatgcctcgagcccaggagttcgagaccagcctgggcaacatgtcaaaaccccatctctacaaaaaaaatacaaaaattagccaggtgtggtggtgtgcacctgtggtcccagctgctcaggaggctgaggtgggaggatcacctgagccctggagatcaaggctgaagtgagttatgatcgtaccactgcactccagcctgtctcaaaaaacaaaacaaaaaaaatacatacactgactaataacaccagcaatattgtttcatgggagctgcctctgctgtttgtaccaaaactgagcagattctttaggccaggcccgagtaatcattaaatcgatctgcttgtgagaaaccggtaggtctaggcatgagcacaaagtggcaggtccgtctcttcccttcttaaataaggaatcaccagaggtagactctgtgcctgtgactcttgaatgtttaactgaaatccagagcagcaattgcattttatatgacaccatgtgtgtgcaaaaactgaatcaaaatcttgtgaaacagtgctactttcacttactatatatgatgtagtctaataattttctatcctattttatttcctttttttaaatgctggttgaaattctgtaaatttatataatgacaaactactgggactctatcttggttcaaaagtccatgatcagcctgcttgtattgagttactacattgtacgatcttataattgtaaagtttaagatattttccttctgtctgtcttaatttattctgtaatctaagttgtcctgccaggaatgctggcatatttactttgtttttgaattcaataatcatagtttctcttgctaagttacattaatggtaccaaaaaaaagttactgcatggtttttgaaactgttctttcctaggaagttttaaagtaaaatgtttttaccttttattgtttacacaggttaagcatccctaattcaaaaatccaaaatccaaagaagtgctcaaaaatccaaagttttttgagtgacaacatgatgccaccagtggaaaattccacacctgatctcgtgtggcgggttgcagtcagcatgcagttaaatctttcatatatgcacaaaattattaaaactattgtccagggccaggcacagtggctcacacctgtaatcccagcattttgggaggccagggcaggcagatcacttgagctcaggagttcgagaccagcctaggcaaggtgatgaaaccctgtctcctctaaaaatacaaaaaaaaaaaaaaaacattagctgggcacggtggcacacacctgtagtcccagctatttgggaggctgaggtgggagaatcacttgaactgggtggcagaggttgcagtgagccaagatcatgtcactgcactccagcctgggcaaacagagggagaccctgtcttaaaaaaatatatatacatatatatatatagtttaggctatgtctataaggagtatatgaaatataaatgaatttcatgtttagacaggggtcccaaccccaagatatctcgttatgtatatgcaaatattacaaaatctgaaaaaatttaaaagccaaaaatcacttcagtctggtgccaaccatttttgcataattgcattttccatgttgcattttgcaaccattttgcataattctgtacttctttcccttttgggtttgttttcataactgctcagtaaaaagtgttctgtgtcatctttccattattttgggctaaatcatgttaatggccaagcctgtcagaattcatttgttttgagttaacttcctggtgtccagttctcaggagttgcaagaatagagctcttccctcatgcaatcatccaaaatcccaggcctctaaccaggattggggaacaccactgttggccaagagcagaaggcttaaagctctggtcatagtcatggcactgtacaaactgttcttgttccctacaagaacatgggaactatttggataatggatttatgaatttaattctgatggatttttataaaggagctaaaaataagcctatataatttattacatgtataatcatataattttaaatgtgtataatttataatattcatcgaaacatttctttttggaaattaaatttcactttggtcaaaatcatcttacaaaacaagatgactcatgatggttctaaataatgtaaaccggtgtctgtaactaattaatgctctggaggaaggaaattctgagttctgacacaaaagcacgtctaagtggtattggtattttcaaagcttttactacaaccaaaaatatgttcacgtgtacctgtctcctctttacactgcttactttctctatcgcttttcccaaatacgtccccagtaacttcctcatgttctgtgcaccacctccaatcttcccctaatgtgtatgaacttggtcatcaccaaagaggtggaaaggaagaagggcatgtgctaatattaatattgaggtttgggctgggtgtggtggctcatgcctgtaatcccagaattttgggaagccgaggcaggtggatcacgaggtcaagacattgagaccatcctggccacatggtgaaaccccgtctctactaaaaatacaaaaattagctgagtgtgatggtgcacaactgtagtcccagctactcgggaggctgaggcaggagaattgcttgaaccagggaggtggaggttgcagtgagccgagatcgtgccactgcactccagcctggcaacagggagagactctgtctcaaaaaaaaaaaaaaaaagaaaaaaattgaggtttgtgccagtttctttttcctttaggtctcctgatatgtgtctagttagttctatatacttcctggaaattcgactccaagatatttaataaaactaaacagggttatatgttgaatagacaaatcctaaagagcagaaaggatttagtggttagtgaaatttcattgacttaagatgagttggatcctcaaaattaatatattctaaacaaagttctatttttaagctgcagtaataatgccgaatttctcttatagttaattgaatgatttatcctggtgttgtctcctggtagtcactgaaaaagtcattacaatcctcactttctcccctttaattcaagttcagaattcatgtgttgctgtgactttttttgagtttatctgcagacagctgccattgaataaacatgtttatatagggcagaaaaaggcagcctgaagattctactttctatttcttttagcactgtttggcagttaacaccaacagcgcttcagaatgaggtactgtccagcatacaccttgcttgttcctctacaaagcttctatttttgtttttgatttgttgtgaggaagcaaagtgtagcctttacttgaatgaaagctacagttttatttttctttcttatttacaagaaattcttttgatgattaagttagccagatacgccccgtgcgctcatatttcttaacctattttgagctgagctagttgcaaggactagttcttctgtgaaacctctggcagtccataaattcaagttcgtgtccagacgtaatggtgaactcaatatgttgtatatttgatatatgtttgttgcacacatggagagaaaagttgctaccattgtgaagtagccatgaaatccgacagttctaatttctttatcttctgagtacccatggaataaaggacctcttagtgccatagcaaggcagaagtttaatttgcaattctggtggcaacatccaggtatttcaagtagaaattaagaaaactttacggaaaaactatctcagcacttcagtttaactatttttcaaagtccaaggagggttttccccagtgtaaaagcagaaatgagaatttcagatctaaagcggttcttgccttttcttttccctccatgcacatgtgctgacaacagaaagtaaaatttgaaaagaaaacccaggctagagcattggggtcactcatttcccatccagcgaagggagagctggtgcctggctgggggaggttaggaaggcaagtcttgggatctgatcactcggctgggagtgggtaaaatacctggacctcaggaggccggattgcagcgccagtgttctctacctgtgtggcctgttcctgcctggggttgggtaccaagtccaggtggaagtggtccctggagcatcctctctctgaagtgtttctttgtcaaacagaatactccctgctgctgccccagaactcatcactgttgacacatggaccaagaactagcagaggaggtgatttataatctctaaatgaattgctctaaaagagacaacaagcactctgacttaagtaaaggaagggagggtgggtggaaaggaaggaggatcataaagaacattctagattgcatactttggtaatcacagcagggccttattgcagttagaacaaaagcctggacacacttacctctcagttcaggaaaataatttagagctacttgttaaatgctggagtattattgaagtaccaagtgttaagattttcactgaaagcaaaactgaccaagcagctcagctagggaaatgctatgtgatcagttgattgtttgatgaggagtatggagcagggactttggcagaggttgctagcagacaggccttggttttagtccaagctctatcgcttaatagctgtgtgaccttggggaaaattataaaattttccagtccttagtatcataaactgtaaatggaggagaaagatgcctcacagatgttgaaggtgaagtgagacaggacacctagtacattgcctggctacatagaaaatgtttcacaaatgttaacttgaggccctctccccatgcctcggtctcttagaatggtttttccccatcgtgtgcacattgagcggtaaggcggacagctgccgccgcccatgctgccccatgttgagagcatttctgttgaccttcccttcttccctgtgaagctggttcagcagtcacctcatcactgtttttcttctccagagagtgctgggttgtagcgaccatactgttgacgcaacacatcccaaccacgctggacggaatttttactgcgataattcatattccaggatcttacagtgcacagggttacaacgattagcataatgatcttgcacaatctttctgcctagcatgtagtgcattcgtaatattctcagaggaggcgtctagaaagcgccaggctccttcctcctgcgtgagccactgcaagctgtcggcgcctcagtgctatggagaccttgggtggattattccttgttggcggggggagggtcccagctgtcctgtgcattataggatatttagcagcatccttgctagatgccatttacaacaatcaaaaatgtctccaggcattgctaagtgtccaggtggggagcggaataggcagaaccgcctccagtcgagaagggctgaactgtacttaggatttgtgattctgcagaaatgggttctgtgaatgcactaaagcatgagaacatccaaaaatcagtgtggcacagaactgaattcaaatttacctggatccaggtaaataagcacaattttgaaagtaccaaacagaattcaagaaaaacaacaacaacaacaaaaaacacattaaaaacagaaaagttggccgggcgccgtggctcacgcctgtaatcccaacactttgggaggccgaggtgggcggatcacctgaggtcagaagttcgagaccagcccgaccaacatggtgaaaccctgactctacaaaaaatacaaaaattagccgagcgtggtggtgggtgcctgtagtcccacctactcgggaggctgaggcaggagaatcgctcgaacctggagggcggaggttgcagtaagccgagatcgcaccattgcattccagcctgggcaaaaagagtgaaactccatatccaaaaaaaaaggggggaaaggtcagaaagacgttctttttcactaggtgatgaattaatctttcccatctttgtcatgttaaaaatgtgcctgtggctgtttctccactaaatgaagacactggcacacagatgattgtgtgtaaacactaggcaagacactaggcacaatcgtaggggttcagtaattattgaatgagaagaaagaaaggttgttcttgaattctgtgatgtgagtgtttaatgatgtttttgaggagaatgccatatgtagcagacagaaccctgggctgggcatcagagggaccgggggcaccacactgggctttgtgtcattatctccagaaagtaactggcctggtgcacaggagaaagttagagtacattgtccatacagttcccacatagctgtagggttttatgaacccatattttaaagggccttctaatgaagtgaggatgttaatgcttttttttaaaaaaaaaaaaaaaaaaagagagagagagattggtgattactttaaaatctgagtcctggccaggactcacgcctgtaatcccagcactttgggaggctgagacgggcagatcatttgaggtcaggagttcgagaccagcctggccaacatggtgaaatcctgtctctactaaatacaaaaatcacgctcctgtaatcccagttacttgggaggctgaggcagaagaatcacttgaacgtgggaggcggaggttgcagtgagccaagatcacaccactgcactccagcctgggcaacagaatgagactccatctcaaaacaaacaaaaaaatccaagtcctaattatcgctgcagctttctttaatgtgtgcagtaaggtggggacatacagaataacttaagatgtagaaatcgtctctccctccctgaagaatatcatggatactacatttgcctgccaggaatgttgtgttgttctggtgttctcgtttctgccgttatcattgtttctgcttaatttttacaacacaactctggccgcacccgtggatgatcatggaaaggcagctgcctggctttccagaattgttttgactctccatctgaacccagagctctgtttcctgtacaggttgctagcagtatttacccaaattgtcccttcccaactcagacccactgacccttcctttctcagctgattacgggtttaagtttgaatcaaaccatgctatagaatcactatctagcagcttctgtgcttgcacaataagagtattagtcagcgtttcctgttttcattcatattgtaagttgaatagctgtaacaaaagggaaagagattgccaagacaaataattcttatggcttgtgcaaacaatttattacaagccttattaaatatgcagctttcagaagtctacgtgatatgcctttcagcaaagctaaatcctactatgtggacttgcttcatgacttaagaacaagtctatattgaatttaacattaaataattatttggcctgtatctcttttaagctttgttaagaactgcaaatatgataagggaataaattgctcatttcaagtcactaagaaaacctaacctataggttatatatgttggcagttcccaagaagtacctaggaaatggaaccttcctataagagtggtttgtccccttctcacgagatgggtcttcatatcaaggccccctaaggcacagatacacagcactccacagtgtccaagttcgtagtaattggtggcaccttattaaagtagtttttactttcataattactgattacacatcagcataccttttccatgttctgtttccttggcagcctgatatttgaatacaaacgacataaaagtgattacatgcagcatttcaggacagttttcaaactgagagaatttggcactttcttttattttcttcccattcttcgtctatttcctttgcatttggaagccaaactcctcgaacctttacttctgcatgttgttttcgtcccctagctagagttctctttattactacttttttgtttccaattggtctctttttaaaaataaaacatggtgaaaccccatcaatacaaaaattagccgggcatgatggcgggtgcctgtgatcccagctactcgggagactgaggtgggagaatcaattgaacccaggagacggaggttgcagtgagctgtgatcgtgccattgcactccagcctgggcgacaagagtgaaactccgtttcaaaaataaatgaataagtaaattaaaatatgaaattaagcttagctagcctgtgtagatgttttagatggtcatatctttatcggatatgacatttatgcctttcagtaaaaccattgtagtattgtaagaaaaaaagggaagtatgatagggaggactaagaacatatttgtacttctatgtaatgctattttatgtgtctatttccattgaagtgtggccttgacatcactggctcccaagtcccatcctgttttttcattgacctgcttgtgccaggtactgcgttaggaagtggagctaccagatgaataaggcgtggtcccgccctccatgtgggagacggcacgtcagtgtacttaggatgctgcatgtggtgacagatgagggccctgcaagggagcacaccacagggccgggagggtgggatgggcgggaggagtagccaactttgcccgaaagcatcaggacaagcttccaggaaatggcacatccaagctgagtcttggacagcgggttaaagaggcagagaggggagagaggaatgttccacatgggaaaagaggtctggaggtgacaacaagtaacatagagtatgtgggctgtgccggaagcttgatattacagaggcacgaagtctgaggcagggagtgtgaaggaagatgaaggtaggggaaggaagtttacacaagggtggccttgacttttatattaaggcactttagggaagcaggaaccactgaagacaggagaacatggtgactacacgggcgcattgaaggggggaggagctaggtttttgaagggaatttgagcttgcaatttttcaagggcattcaatggttataaatgaaacttttcattaatatatttgtgtccaagtgtttttagatgtgcttttctgctactctctttttatttggtttggagatagatggtgactttccttcagtgccttctatgtgtcttgacatgttaatgtctcaaacacatggtccgtatcatcatggagcttgcaatctaacagggtagtttaacacataaatatgcatccagttggaaagaacttagagatcacttgatcagcccccgttatgtaaaatgtatgcaacaatctacctccaactatagggcgacattaaacagtttttcaaaataccatggcattgaaaaaaatgcgtaacatttgggttacttcagtcccactccccggtactaatcaggccagtgaaccagtcttgctggtgaaataatgacttctccagtcatgatggatgatttcccttcatcatgaccatttcttccctggctctgcctttacctatgaatctcttctttcctccctctccttcctcctcttggtctctgcctgccatacccaactccacatttctctgcttggaaaaatcctacttgattctcagagcctgactccatcaccccctctctccaaccctcccaggcaaactccgtccctcccagtgtgccgccctccagctctctctagttgaatagcagatgttctctctcccacttccctgcagggcttcagggtagtgaccctaagagtgagcttctaccagtgagaaaaacgcctggatggagcaggaattcccacaaatgcttaggaattcaatatgatttttagcaagtgggagaattatccttttggttacaaagatgtgaactatttttgtgagttctcagtatgcaccaagaaaaaccccagtgactcagtaatgtacctgtgccgtctcacttaacccttccaacaaggaacttgccaaggtgcacagctgggagggatccggggtcccgtccgtgtgctaacctgcaggacagcgccgcataatccagtactggggccttattgtccagccttccacctccaggagcccactcagtgatgacttttgacaaaagtcacccggattatccctcttttggggtccatgatgccaccaacggctaaagttaacaaatgcattaccaggaggtaccactgaggtaaggattgttactgtaagtgattttctctgattttgaccactacaagtaaaatcacaagatttgtcccaaatactatataaagaggaatgtcttttatttctcgaaattgttctgccactttgtttgttcaaataacacataataaaggataaatggcttgtagctatatttatccaaattgaacatttttgatgtaatttttttaatttgtcaaaagcatatcaatggtcataaaaattttttatgtcctctggccctattaccttacccttgggaatttattccaagaacgtaatttgaaagagattaaagcacataggcacaaatattttcagtgcagtattgtttatattggaaacaacccaaatgttcagtaacagggggaacaattttgtaaatcttgctacagcaacttaacaaaattataagctgccacttataattgtaaattttgaaagtttgtagcacagcaaggaaactgatcatgttaaatgtttctgatatcttagttaatttttctcccgccagttccgatcggtgtcctggtcataccgtcagcatataagtatgtatttcataaacatttactttgtattaactcagtagtattcccttcctagagtggtttgcttcccagattgtaatggacaatcatctcacctggggatcttgtaacaatgtgattctgattctgtaaactttgtggggagcccaagattccacatgtcttagaggctctcagatactgctgatgctgttgatcacgaatcacgcattgagcagcaaggtcctagagctctttgtgtatgaagaagatactactgacccagtgcctcgctatcttgaaaggcagctgtgacctttctagcaactgagggggtggggactagaaacgagtgttttctggtgtttctctaataaagctgctgtcttgtatccagattgaccatcagtatccttatgcccttcaactaacttgaaatttgtcagttaacagaaattactgggtggcactaaaataaattattcttaatataaagggtaagaaagggtcgggtgtggtggctcatgcctgtaatcccagcactttgggaggccaaggtgggcagatcacctgagatcaggactttgagaccagcctggccaacatggcaaaaacccgtctctactaacaataaaaaaaaaaaattagccgggtgtggtggtgggttcctgtaatcccagctacttgggaagctgaggcaggagaatcgcttgaacccgggaggcggaggttgcagtgagctgagattgtgccattgcactccagcctgggggacaagagcgaaactccatctcaaaaaaaaaaaaaaaaaaaagagtaagaaaggatcttccattgtaatcatactatcattgccttttgaaacaatttggaacctgattacaaagttgaaaatccccatctgtatgaagaaaagcttcactggctggtcaccttggctcaacgcctgtaatcccagcactttgtgaggctgaggcgggtggatcacaaggtcaggagtttgagaccagtctggccaacatggtgaaaccccatctctactaaaaatacaaaaataaaaaattagccaggtgtggtggcaaacacctgtagctactcaggaggctgagtcaggagaatcgcttgtgcccgggaggcagaggttgcagtgagccgagatcatgccgctgtactccagcctgtgcgacagggcaagacaccatctccaaaaaaaaaagcttcactgtgagttatgatatgggaagaaaagtcttggcctggccaccacaaggaatccctcaggcctggcggtgggaagcagaggagggcgcagtctctttagggcagaaagtgaagaacatttctatgacaatggggaaatcagttcacctttgtgttggtaaacaaaaggaatgtaagctgtcctttgagctcgaatcatagtggtgattgccaaaacctacctttgtttttagaagataatagcacatattccacttgcttccccacagtgaccgaagctggctttggtgctgacatcggaatggagaaattcttcaacatcaagtgccgagcttccggcttggtgcccaacgtggttgtgttagtggcaacggtgcgagctctgaagatgcatggaggcgggccaagtgtaagtgcccacaccgccttcctaataccaaagaaatttcattatgttaaaacagaattgagcatttgaaaaattcctgcccatttaatgactatagttttctagagtatttttcttaaaactttttttttcctgtagacctccctcgtggacatctaaaacgttttttgttttgtgttgttttttgttttttcccaacaccaccatagggcactttgagtttagtaagttcgagtaaacagtaacacccacagttctttctaaacaatattttggaaaggagcataatgcaaccactttttagtctcaagcttcacatctgatactcaggccaagattgtataaccatatggtaatgggaggttagaggctcttgtccctgaacgaagaacaagaggattagagtgagttctttgatgacagagatttttcattgtttgtacagatagtttttcggttcactgatgctgcaactcatcagatttcatctaaaactattttccttctctttctgtttattatgatttctcctcacaactctgttataatactggattgtttctaagagctttgcttggaaaacacaaattcgattttaacttctttaaagactttttatatttacctatcctaatatatatagaaattacagacattataaaggaaatatattcctttccacagaaaacctgtgcatagatttttgggggtttttttgttgttgtttgcttgtttgttgtttttttgtttcatttttaggaatttccaagtggagaataagacattttatactgattaatcattttgaaataaaataaaatttctctatcataatattcacatatgagacgaactgccaaatctgatttcttaattggtatactgtactgtgtatgtgacaaaagtcatatattcaatgattattgcatagtcaaaacaagtagcaggtttgccatcatgaaacgctgtaaagcaattctttctcctgggagaggtggacatgatttttataccattttacagataaggaagctgagttttgataggcttagggaatatggacaatgtcagcaggccagcagagagccgagaacttcagatctaaatctcctactatgtccaccatgcagagctggatgttaatgaagggcagaagttttctaaatccaaatccactcctaatacccgacacttaagcacttcatttttgcctaaagcttcatcatcatttcaaatgcaagaatgatataatacagattaaaagtagtaaatcataaagaattctgacttcactcaaaacaccccttgttgctacagtccttcctggattttagacattgaatctgtataacaacttctatttttaaaaactacttccgcccatgtaggatgcatttggaattctccctccctgccctgccaccctgaaaattatagaaagggcttagagattgtctgatctcattcagtctttataaagagaaaatctctgaggcacagggagacgcagtgacttgagtggtgtcacacatctatttcagggactgatcagatctacagtcctggtctcttgacatcagtcccatagttttccagactctggtctctgtcctgtaaaaattctctacatggtttacaatcctatttcattcatcttaacatatgtgctctgttattcagtggttgcactttcgtgccacattaatcctttgtgtctcttccactgctgcttaatgtcatggttctcagccagtgatcatggtaacatggaacagggttagtaggcacagatatgggtggaggataagaaaaggtggggaccagccaggcgtggtggctcatgcctgtaatcccagcactttggaggctgaggcaggtggatcacctgaggagttcaagaccagtggtggcgggcgcctgtaattcccactactcaggaggctgaggcaagagaatcgcttgaacttgggaggcagaggttgcagtgatctgagattgcaccattgcactccagcctgggtgacaagaacaaaagtccatctcaacaacaacaacaacaacaaaaaaaaaaaaaaaaaaaaaaaaaaaaaaaaccagcagggaccaggaagccctgtgaagctaggcatccctctcctgggctccagtagtaccttctgcctcacattgtttcatgaatgccttgttctgtgtctccctatgtaattctcaattccttgagtttagggactgtgtcttattaattggtatggtccaagtgtctggcatggtctatatgcagggagtgttttcaataatggcaagataaatgaactttcatcctcttaatcctctattccatagtgctcatctcggtgtccttccttcatattgaatagctctgtatttttgaaccatgattattcatttctacttctgttttcttttttcttttttgctacaaatactgcgctgggatcgacttccttttgatcattacacaaataaccatggctgcctcttatgtttattcagcttgttttttttccataatttgtacagtggaaaatcttgtggcccttgaatttgcccattttaaatttgccctcagtcattttaaactcacatcctgtcccccagagtgctcggccattcccagtgcaatccaataactaatattgtgctatgctttgggatccacagattctttcacaattagatctttaaactaaccattgtatgaatcagcattcttcacacatagaaccaataaggatgtgtgtatatatagagaaagatatttattgtaaggaattgggtcacatgattacagaagctggcaagtccaaaatctgcactgtgggctggcaagctgaagacccaggagaggcagtggtgctaatgcagtctgaaggcagcagtctgctggagaattctcctgctctcaggggaggccagtctttttgttgtactcaaaaaggcctttgactggtcagttgagacccacccacattatgtaggacaacttgcctactcagaggctgctgatttccatatcaatttcatcatagacaccctcacagaaacacgcaaaataatgtttgaacaaatactggacaccctatggccccagcaaagttgacacataagattaaccacaaggccaggcacagtgtttcaccctgtaatgccagcactttgagaggccgaggtgggaggactgcttgagcccaagagttcgagaccagcctggggaagatagcaagacctcgtctctacaaaataataaaaaattatctgggtgtggtggtacacacctgtattcctagctactggggaggctgaggcaggaggatcacttgagcccaggagtttgagaccgcagtgagctgtgattgtgccactgccctccagcctggacaacagaactttatggcaattaccgtaaaatgatttcgaatggtgatgtactctgtataaatcaagtattaaacatattattagttttatgttctaatttgaaccaatgtttgagaagtttcatactgttccattggctcaaattagaatcatccagggagattttaaacattactgatcccaggttcccctcccagaacttctgctttcattggtctgggtggagcccagggatcagtgttttctaaaagcttcccgcaggagtttaggtttagccagtgctgccagctactgttttaaaagcacaaaacatagaggtacatttctaaaaattgaatgtgattatgttgttctttctttcagatcggttgtgtaagcatttttataggattattcttcatgttttctctccttatttcaggtaacggctggtgttcctcttaagaaagaatatacagaggaggtaagaggagctgtttagatgcttatgtgaagaatctcttaaatccagtgactcgttggctttcagtgaatgagccctccttcagtggcctcttagaaaagtgctgttctgtccgggcgcagtgactcacacctgtaatttcagcactttgggaggccaaggcgaccggatcacatgaggccaggagttcaagaccagccaggcaaaacccatggccaacatggcaaaacctcatctctactaaaaatacaaaaattagctgggcatggtggctcacgcctgtagtcccagcatgagaatcgcttgaacctgggaggcagaggttgcagtgagctgcgatcgcaccactgtactccagcctggacgacagagtgagactctgtctcaaaaaaaagaaaagaaaagtgccgttctaagaatccgagaggaaatggatgggatgaaaggataaaattcattcagttaactcttaaatatcaagaaaagatggatataggctttgtctactattgtgtactcccagggtagccatcagagcaggaactcaaggtctccaggtcagaaacaaatatgaagcttacacttctgtattcttttgtcatggaaggtctatatacagttggctttatgatttacaggagtggcttactcttttctgtaaatagactttgatttgctggcagcagtacctcttagctcctacaggtggcgccagggatctgagccaggaatacctggtcagagctcctcacccacctggggccttgtgcctgtcaggcctcaacctgcagagcatgggcgcattgcatagaccctgcagcctgtcctcagcagggtgagctgccaggcttcagacccacccatatgccattggatccagaatcattttagaaattattttgaagacgaacctctttattcttgcagccatctttcttggaggaaaaagtgaaaaaagatgtagcaaatcctgccagagaggtgctggcagtttagcttggcaggtttggtgggagacaatacacaggggtctgggttttgcttttttcttttttacagaacatccagctggtggcagacggctgctgtaacctccagaagcaaattcagatcactcagctctttggggttcccgttgtggtggctctgaatgtcttcaagtaagtccagcctcctcctttaaatgtgggcattatcactaggccaccctgtgaacgatatttgtgtcttggggtatttggtctttctgtgcttcatctaaaagtatacagaaatacccagttctttctgtttgtttatttggtttggtttcattttagcaaatgtgttctcacaatgttattaaggaagtgaaatttatatatagtgagttactatctccttggcttttttttttttttttttttttaattctacccagcatttttgtctgaaacaaactgtgaatgatcaaagggatatgttatggaattttcttgataacacccttaacgacttgaaatatttgagtcactttagagaggactttttttttccatgctttaagtctgatttatttaaacacgatgtgaccacttttgatgtttaaaatgtattcagtgttagggagcgaagttctgtataaatggtgagtctttctttgaaaacatagctaaatggatacagatgcaaaaccacaaacattttcttcactaggaccgacacccgcgctgagattgacttggtgtgtgagcttgcaaagcgggctggtgcctttgatgcagtcccctgctatcactggtccgttggtggaaaaggatcggtggacttggctcgggctgtgagagaggctgcgagtaaaagaagccgattccagttcctgtatgatgttcaggtaagatctagtaaaaacaatggctcacatttcttacaccttagcatgggttgtcccattctgttgtcaccacaaccctacagataagaaaactaaagatagaagagtttaggcccggtgcagtggctcacgcctgtaatcccaacactttgggaggctagggcgggcagatcacttgaggtcaggagttcgagaccagcctggccaacatagagaaaccccatctctactaaaaatacaaaaattaggtgggcatggtggcgtgcacctatagtcccagctactcgggaggctgaggtgggagaattgcttgaacccaggaggtggaggctgcagtgagccaagatcgagatcacaccactgcactccagcctgggcgacagagtgagaccctgtctcaaacaaacaaacaaaaaggtagaagagtttaagccatatgacaaagtcacatttccaagtacagaccctagctccttgtcccaaagcctgtgcttttgaagactcccaaatcgcagtcctaagtgaggaggtactttagcgaacaggatttgacagctgacgctttcaggagttgcacaggaacaagagcaatttcgtgaggattgggaaaccatgggaggtattttccttgttcatttctcttttttttttttgagacagtctctgttgctcaggctggagtacagtggtgcaatctcggcttactgcaacctctgcctcccaggttcaagcacttctctgcctcagcctcctgactagctgggattacaggcacctgccaacacgtctggctaagtttttgtatttttagtagagacggggtttcaccatcttgggcaggctggtctcaaactcctgatctcatggttcacccacctcggcctcccaaagtgctgggattataggcatgagccaccacacctggcctctgcttgttcatttctgttatggttcttttctcttgtggttttattgaactatgtctagtgtatgtgtgtgtatatatacatacataatatatttatttattttcattgtggtaaatatatatataacaaaatttactatcttagccttttttttttttttttttttttgagacagagccttgctctgttgcccaggctggagtgcaatggcgtgatctcggctcactgcaacctccacctcccgggttcaagcaattcttctgcctcagcctcccaagtagctgggactacaggcgcaagcaagcgtgcctggctaatttcttttttattttagtagagtcggggtttcaccgtgttgcccgggctggtctcgaactcctgagctccggcagtccacccgcctcggcctcccagagtgctagggttgcaggcgtgagccaccacacctggcccatcttaaccatttttaagtgcacgtcagtagtgttaagtacattcacattgtcatgcagccaatctccagaacgcttttcatcttgcaaaactgaaactgtacccactgaacaactccccatgcccctccctacagtccctgccagctaccattctccttcatttccatgaatgtaacaactccagggacctcatgtaagtagcatcatactgtggctggcttatttcacttagcataatgtgcgtgcatgttgtagagtgtcagaatttcccttcttttttttttttgagatggagtttcgcttttgttgcccgggctggagtgcagaggcaccatctcagctcaccgcaaccttctgctctcgggttcaagcaattctcctgcctcaggctcccgagtagctgggattacaggcgtgcaccaccacgcccagctaatttttgtatttttagcagagacagggtttcaccatgttcgtcaggctggtctcaaactcctgaccttgtgatccacccacctcggcttcccaaagtgctgggattacaggtgtgagccaccgcgcccggccagaatttcctttatttttcgggctgaatacgctcccattctttggatatcccacattttgtttctttgtccatctgtggatggacacttgagctccccctcacagctattgtaagtaatgctgtatgagcatgcgtgtttatggcatatggcatatgtacaagtatcccttcaagaccgtgttttcttttttttttttttttttttttgagacggagtcttgctctgtcgcccaggctggagtgcagtggcgcaatctcggctcactgcaagctccgcctcccgggttcatgccatgttttcaattcttttggaaatgtattcccagaagtgggattgctgggtcctctaggatatttttaagcacatgtcgatggttcagtcagaagacctgagcttcccagggctcactctcctcctcagatcgtctgtctttgcacccgtctgacatctccattctgaattttgtggttccgattctggctgatggatttgtcttcaggggtagtgcatgattgtggagtgcccaggcttcaagctgattgctgcttctcctgttccttcatccctcacatattctattgttgagtcactcagatgtcacagacactcttctttcctgttcagtggcataaatcaatagcataagtgaagaagaaatccgtgaagcaagagcttagcagcgttgttgataagcctggagtcacagtggtgagagaacggggctgatgtattaatatttaatattaccacagctctcgcttttaaggagttgtttgtgagctgggtatatgggcgctttgcacatgttcacctctttggtcctaacatccctcttaggtggaaactggtgatatcttcccattttacagacaagaaaactaaagcacgaagagactaagtcaactgctcagtgtcccatagctaggaagaggcagagctgggagaaagaatatccagatggttgaggtcatcaccctgctctgttcttcagagctaagtactgtgctcaaaagtgtgtgtgtattggaggtctggggggagacatagttaaaggggacagtgactgagtgacccccctgaagagaaagggtgacagtgatgggcataggcacagattccatgccacacaggggacatcatcgctggcacgcagtcagtgtttacggaaggaaggacacagggaattaattggaggctagctcataaaaggtttttcatttttatgaggccattttgtgaatgaggaactagaatattctggactacagaggcggtagagatcaattgagggagaagattttggatgagtgaaaagaaaaatgttccagttggaagctttgagttctcagacctagaggtgttcagcgcaaaatagatgtagccctgctgtgggcaagtcagaggcattgaagccaactcagatggcaggtggccaaggagaccctgggttcctgttctttggtcctgggtaaggcttgccagggtacctacaacccttggcacatgccagagcctttctacataaaccactgtagggagagtcacccccagatcctgctgtgagtgtgcctctgatcatgccatctgatcatgccatcttgccgtctgatcatgaaccaccccactctgcatagcaaaggcagttattttcatgaatgatttcacaaagtgcggctcttttcaaggaaaacatcccaggtgaaaaagaggtcagtaatcagaagaaatgcttctgagttatgctgtctcagacatgcactaaccctaacatgaacccttttcctttccactgatatttcaatttttttttctgaattcccattcttcatgcagataatgctgctaaaatgtcagctctcttctgaaaggaggaaaatgtttaataataatgtggtctaaagtcctctattgataggcgacctcaaggccaggatccctgcctcctttgccaacacacttctcgcttttcttgtaacagaaattcgatttgagctgcataattgtttgttagataatcagcctcccagcctactgcagcatgacagttcatgaaaagagctgctgctgctgctggctctctttgtactgtctgcctgttagctgtgttcctcacaccagcaagatttagatcatctaagaccatttacagtcttgtcttgtcaccatgtaaaaatctgaattcattggtgcagtcagtaatagagctcaagccttctttgccccggatttcttgcattgattggtgctggtaaaactttagtaacttaagtaatggttttctggaagccctttttacctcccctacaaccccacaccctcacaaccaacccttgggtgctgggcagtgagaaagatatggcattgctctataggagaaagaagttataaatgctttgcatatgacactctcccacctttgcttctcaaagcaaactgggtttctgtgtgccccttggtgtctccccagactttatatccccaagaatgtattcagtacaagactaatggcatcttgtgtgctattctttctccaccccagtcttgtggaaggaaaacaccggagatgatttagggtaatgggaaatagtgctagagcccagggcatgactgcatttgaatgtgaagtagaaattgtctcggaaccccactggagagtgattcagctggagagagtggggcacctggctctcagaggcactgtgcggccagacagcagtgtgctggacttcctaatggcgagctcacaggttaagtgagaaacaggctgcacttctgacttgggagtctctgctgaactttatagaaaactgacttcagcagcaactgctgtctagagaacaatttggcatctctttttgccagagtaacttctaactcaagagtaggcaacttttaattatggtaccggatggaggcagcaatgaataatttagaataaagattgaaaaatatggaataaggtgtagtagactaattgctcagaagaagttttattgtgtgaaaatgaatgtgtttaaacttgaaatacagaggatcatttcctctctacccttgagggtgattgcagtcccttttaagaagctgttaaaagtccccctcaagatcatcttctctttgaattttcctttctaatgtgacttttgacaattatatctttatcgttcactaagagaatatctccatgtctgcagggatgcagggaaatatgatggctgaaagaaacgctaatctacatgcgcactttattagctaagaaatccctcctccatacgttcttccaggcatgcctccgcacatcccatctgctatgtgggctcaactctgcattatagatgggaaggtgatggacttgtccataagaaatggacgcttgataggagaaggaacatattacatagagctaacaggctaaagctttgggatcatgcaaattaagtttaaaccttgagtaggcctcctactgtggacacaatttggggaagctgactaatctctcgagcctcagcatcctcatttgtacaatggtgtctgacagtgacaccaacttcaccaagttgctgtgagacccaaatgaaatgccccagagtaaaatgctggaacatagaaagcaggcaatgaaggccaggagtggtggctctcgcctgtaatcccagcaccttgggaggctgaggcaggtggatcacctgaggccaggagttcgagaccagcctgggaaacatggtgaaaccccatctctactaaaaatacaaaaactagacaggtgtggtgtcacgcacctgtagtcccagctactcgggaggctgaggcaggagaatcgcttgaacctgggaggtagaggttgcagtgagctgagatcacaccactgcactccagcctgggcaacagagttagactctgtctcaaaaagaaaaaaatggaggaaagtagtcaatcaatgctggttcttcctcctgtcatgttcacttggaaagagagtgggcctcctgaattcaccttcaagaattctcctgtaactcaaggtaactttgtcaaactccaagattggtttattttgctctgggttaaaaccaggaattagaagtcaagtctcctaaagcactactgaactaaaccaagacactgacgtttttccttctccgtgagaattgggagcccttagtgatatcataaaacatcagtcatttttgcaaagaaggaggtatgacccggagaagtcagcttgacattcagtcggaatattgtttgttaaatgaggagttaaggttgaaaatcatctctgtatccttcctctagccttgcaaacattttaaggtgtagccttgacagcaagacaggatagtgtttgtttttattaaaaggtctttcctgttccttgcgtgaagccattctcttgatcccagtgggggctggatgaaggaagagcaaaacaaaccacgaagacagcctggagccgcagccagctctgctgacttctgaacttcacgctctcactgcccagatggccaggggtgtttcctcctctgctggtcttttttaaggcaggatgtttgttgttattgttgttgtttttctggttggttcttaagaaattattttctacatcttgaaaatgccagctggaacctacaccagttgttggtggggtgtgagaactatcctttacatggacttggagcatttgcaactagagcctccacattgaaataaacatttaaaaatgcatatctatggatatacagtgggggatcttccattgtggtaaaaatatgtataacatacaatttcccctttaatcgcttttacatgtatagtctgtggcattaagtacattcacattgtacatacagggtttaattaataggatcttaaaacttaaaagggtattgatgcacatctctgttgccttttacatttcacagtaattagaagggaaaaaacacactctaggttgaaaggctgtcctttcttttggttgtccttgtccctggaaaagctgtcttccccctcagggcctttgacctcccccggctctccctcccatcttcagacacgcccagggccagcctgagtcagtagccctttcttcagcgctccctcttctcctgttgtgcattagaatgtttggagtgttctgtggaaagctggtccttacattttccagtcagttatgcatctcactcataaacctgtttcttcccccatgctctttaatattctgctttcttaattatggttgagctgcctttaaacagtcttagattgttcaatgtgagtggcttcaacaagcctcccataagcctcttatcccctggccccctttccatgatccaaccccaaatctccagataccccctgctttttttatgtttttttgtttgttggttggttggttggtttttgggttttttttttttttttgaggcagagtctcgctctgtcacccaggctggagtgcattggcacgatctcggctcactgcaacctccacctcccggtttcaagcaattcttctgcctcagcctcctgagtagctgggattacaggtgtgggccactatgcccagcaaatttttgtatttttagtaaaggcagagtttcaccatgttggctgggctggtctcgaactcctgacctcaagtgatctgtcctcctcagcctcccaaagtgccgggattacaggcatgagccactgcaccaagccccggatacctcctgcttgaccagaccttctgcaaacacaccttagatccctctcaaatctagatgcttctccaacactggcttctaggttctttatgaaacctctgctggccggcagtatataacccaccacccagcctgccaggcacgtcattcagctgtgttagacagtttcgagggatctgcacctgtcatgagcactggcccaaccttctcaaagcatcccactcatccctgtgattctggcaaagcttgccccagctttctttcctcgatggttgaaatagcacccaatgagaaaaaaacagtggcctgtatttattatacttacacatgtcacaagaatccctgtagtgtcattgaaagctttcttctagcatgcaaaatgattgtcactatgatgtaagtttctagaaatgccttatttcatctaaaattatgagagaaggtaaaatgatgaactatcaaagtcacactacatgttggccggctgccttctaccactcactccatccctccccaggctttctgacttaaatttagatcacatgagaccattgcagtggagagagtgtccactttctcaatctaaaagcaagctcgtgaagaccattaaatatgatcacaggaacaaacattaaaggtaccacacgtaatggaccacttaagacagaaaactacgatcttagggtttaggggaaaaaaacactcaaacagcacaggcttccagtctccccagtctctgagaggttgggatttttttttttaataaagtacaagggctccttgaacatgaacacggaacgagcgttgcacctgtattcattcatttcgctcttgtaacacattgatgttcctaagtcagatttgtagaagaggaacgagcagatgcatcatgagaacactgtgcttggccaggcgcggcggctcatgcctgtaatcctagcacttagggaggccaaggtaggaggatcgctagaatcgaggagttcaagactaacctgggtgacatggcagatcctgtctctactaaaaatattttaaaaattagccaggcatagtggcacatgcactgtagtctcagctactcaggaggctgaggtgggaggattgcttgagcttgggaggcagaggttgcagtgagccaagatcaccccactgcattccagcctaagcaacagagccaagctcaaaaaaaaaaggccaggcacgatggctccctcctataatctcaaccctttgggagactgaggcgggcagatcacttgaagtcaggagttggagaccagcctggccaacatggcaaaaccccatctgtactaaaaatacaaaaatgagccgggcatcgtggtgcgtgcctgtaattccagctactctggaggctaaggcccaagaatcacttgaacctgggaagtggaggttgcggtgagccaagaacatgccactacacaccatcatgcccggcctgttttttttgtgtgtgtttgttttgggttttttttgagcctgggcaacagaacaagactctgtctcaaagaaaacaaaacagaacactgtacatgagtgttcctgggcccagcagagtgctcgaaccagtcagcactttgccctcttttgggtgagatgagatctttaaaatcacttattcccatatattccgttttttggcattgctacactattctatttgagagtaataaaagattacccatgtggatttcttactatttcatgtggagaaatgcagcttttctagcggcgagcctttcttccatttcccagagtccggttaccctcaccgcaccccaggtttgccgtagaaggatgagattccctacatgtaggcgtcttcagagtgaacctgttgctcagggcccgcgagcccacagggctccatgcccactgagcaggctcgtggacgtcggcacgtagctcagatgtgctgatttccagccaaggacatgctttgtgtcaacgatacaggggcctgttgttctcagtaacaagggcagagccgctcccgggactccagttggtattggtaatgcaagcccttgcacctagtgtggtgtggtcagtataaattaatatcgacagcttcatgttgtactttaatttgaagtacaggaaaggctgcttgccaaactgtatttgtagatcatttaaaatttatgcttcatttaaaatgcaaaatacgaatggaaataattactgtgtatccggaaatgtctattcaacttacaagtttattaattgatccttctctttacatgttttacgggacttggaatacactttgctaatatcacagcataggaagatttaacccatatgaattcaactctgtagccttggtgaaagaaaagaaccatgtatttgtcattcactgtggcccccgatgtatgccaacgacttcatttggtgcagggctgaagaaatggcagtgtgttccaatacttcacaacagtggggcctcattaagagatgctagggtattgagagtggagtgttacatagtgtttttcataggtcttctaaaagatttttcagagttgctgacttaagaatttggcctctgagtaagatgagacgcccctactacgttataaagccttcatggatctttatttctaacagttcatttttaaacttttgttccatttcattttattttgtccattttttgtcatcaaaaaattattttaaaatgtaacagctcttctagaatgtacagatcaattttattccactaaaaaacaggacttcaataatttaattgaagaattctagtgagcatttccagagcctttccaagaaagctatactgtttaactttgagtgactcagcttctaggaccctggtccaccacacctacaaaatgaatttaataaagcatgaaggtcaccaaatcctctactatttcttcgtggagtcattcagctagtgtttatgttgtgcctgctctgtgcgagagactgtgccaccaatataaccactggtcacagttattttctagagccatactgcctgatatcccatgtggctaagattgacagttcagtttctggattgttccagtcccatttccagtgcttttaatagccacatgaggccagtgaacacacgatacatcttccattgtgatagaaagtggcagtggacagctttgttctagagtatttccgtttctgaaatacatgtttaagaagtttggaaaggaattagtgtagagtatgagaagggttacatttttggtgaatatgaagatttaacataatgttagttcaaaaatgaccaaagacacaagtgtagacaccaggcttttgaagtagctaatatgttaagcagctgtgcattatatagacagaatattcactatgtcccactcagccctgtgtttgacaccatttcaccttggcttctgcctttctttcccttctttgcctattgagatttttcctgtcctttctatcctttttttttttttttttttttttttttgaggcagagtcttgctgtgtcaccaggctggagtccagtggcacgatctcagctcactgcagtctccacctcccgggttcaagtgattctcctgcctcaccctcccaagtagctttgactacaggaatgcgccaccactcccagctaatttttgtattatttaaatagagatggggtttcaccatgttggccaggatggtctcgatctcttaacctcatgatccgcccaccttggcctcccaaagtgctgggattacaggtgtgagccaccgcaccaggcctcctgtcctttctttaatgcactattccagctttttttttaatatcttgccagcttttgctgattttcatgcctccctctgcaacctgtgatctcttgactttaatagtaatgtttatacagagtcttgactgcacactctcttctgtcatcgttgtttgttgtgtctcattgtccccaatccatcagaagttcttggtacacaaagtccctgaagctgtatgaacaatgccctgacgtcttgaaaggacttgccataggtggttatttgatcacttagcagatgcctttgggatcctactttgtgcaggccactctccaaggcacaatgtggcaagtaaatatattagtcaatatttacagaaccaagagaaagccagcaatgattaatgcataaacagtcataaattggccattttatttgtttataaaagctatcatttactacagagaagtacaagtgaatatcaagctcagatcaagacctttggactgagcttggctttttttttttttttctttaaagattacacttctcccccaaatcaagcagattaaccataggaagttccttgcctgctaacagaatataaatagattgcatgcaaggggaaggaccttatcagggcagattttagtatttacactaaacccaaaagattatttccttaattgtacttgtgagtgaaaaacaaaaattgtagcaggagtcccaagagcactctggccatgggcttttgagctgtgagttgaagcactttattcagcatgtggctgcagggttgtagctcaggttgtagacagtgcattctcttcaggtcccaggaaacagtgtcatacctgtggaagccaccagaatgcaccttcatcttctccagtggtggcgaggttgaggccaagcatcagaagtgctgagtgctgggaaactgtggggctggatagatggcagtgcctgctgggaagcacacagccctgggttgaggcagggaagcagggccgcccagttgggattcattcgtactactggcccctcacagtaccgtcatgtgtgggtggtcgcgcttgtcctacaggaagtaaaccacaactactcatctcacacagtcagcccggcacctccttggaattcccaaaacactttccaataaacattggaaaggaagaaagtttagttggtaacaaaaaaatgtatgttgccttacgcccaaaagcattgaaagcagggactcaagcaggtactcatgcagccctgttgatagcagcattgttcccagtagctgaaaggtgggaacccccttgtctgtcagcggggatcagctaaatatggcacacacatactatggaacattattcagccttgggaaggacacctcctatcacacggatgaaccttgagaacattatgctaaatgaaatacaccagacacggaaggacagatactgcttgattccacttgtaggggcctgtagagccgtcacattcatagacaggaagtagaatggtggttgtcaggggccaaggggaggggcatggaaagttgctgcttaatgggtacagtttcagttttgctaaatacagagagttctggaggttggttgcccgacaccataaatggacttaacgctactgaactgtacacttagaaatggttaaaatggtaaattaggccaggcatggtagcttgcggctgtaatcccagcactttggaagtctgaggcaggcagatcacttgagcccaggagttcaagaccagcctggacaacatagcaagacccccatctctacaacaattttagaaattagctggtggcttacacctgtagtcatagctacacagtatgctgaggtaagaggatcacttgagcccaggaagttgaggctgcagtgagccgtgatcacatcaccgaactccagaatgagaccctgggtcacaaaaaaagaaaagaagatggtaaattatatgttatgtgtacgttaccaaaattaaagttcttaaaaatatatattttaggccagacacagtggctcacacctgaaatcccagcactttgggaggccgaggcaggcagatcacctgaggtcaggagttcaagaccagcctggccaacatagtgaaaccccatctctactaaaaatacaaaaattagccaggcgtggtggcgggagcctgtaatcccagctgttcgggaggctgaggcagaaagaattgcttgacccagaaggcagaggttaccgtgagccaagatcgcgccactacactaccagcctgggtaacagagtgagactctgtctcaaataaataaataaataatatatatatacatattatatagatagatagatagatttcttacaaaacattttcgtgtttaaaaataacaaatcaggccaggcacagtggctcacgcctgtaatcccagcactttgggaggccgaggcaagcggatcacctgaggtcaggagtttgagaccagcctgaccaacatggtgaaaccctgtctctactaaaaatacaaaattagccgggcgtggtggcacatgcctgtaatcccagctacttgggaggctgaggcaggagaatcacttgaacccaggaggcagaggttgcagtcagccaagatctcgccattccactccaccctgggtgacagagtgagtctctgtataaaaaaaatttttttaaataacaactcagccatccactcgcatcaatttattcactagtcattcgattgctattactttgctcccatgtgagttttttaaattattaacagaaaaatcacactctttatttttgaattatgatcttgagttcagtaaagaatgcattctgttgattaaatgtgttatgagtaacagtatcttgttttgctgtacttccaagcaaaatgtaattctttcagtcctccctaccgttctcactccataataatatgacttaaggtttgtatagcatgacgtttacaacgtgcttgcgttttacactgactcaacgtgtgcagtacagtgatgtatagtgaagtattcacatcctcatcttagaaatgaggaaataaattcagggaggttacatgatttaaccacacataaggaggggctgcattctctctgagcccttctacctcacacagccaccaagctcctttgtgcagagcccatggagggttggagtggccacactggggtaggtgcaggccagagactggatgcaacaggaacattgcctgcttcccaaaaccactgttctactgcccggagaacacacccttctgggagctgacttctaacaaagcaaggtccttggacttgccctgcggcttctttcctgcaagaagtatcttccagcatcctaccaacttttatttcttaaaaaaggttgttccttgccaggcattggttgatcagcagaggagctcgcattagtttcagtgcagtgttgggagcaagcacttgagtgcccagcaacataggctgctcatgatctaagattcatggaaaaagtcttctgcgctgttgcctgcagcacatcaacacctgaattttcttatcatcttgtgtggctattgaaccacagggaacccaagcttagtcaataggaaatatagaaatattcattggttcaactgtatagggagggccttgtatatattccaggggctgtatcctatcttgcctctaggtaaataagagatggtcccgaggctcaaagagtttatcaaccattctttattcttcagctaatatgaacattgaatcttttacattagaagttgcccatgcagggcacgcctgtaatcccagcaacctgggaggccaatgcaggaaaatcacttgaggccgggagtttgagaccagcctgggcaacatggtgagacctcatctctaccaaaaataaattttaaaaaaagttacccttaaatttctttctctaacccagcctcaactttgtactcaggcagtaactctttgtacaacattcctggcaccatattcagcttatacagaaccctccaggcaaggacaggtcactgctaagtgagagagctctggttattatagttcttccttaaacactgcactcaaaacgacttccttctaacgtttgtcccttggttcacattctgccctcctttcgattttttgtatggcatggccctccaagagatttcagtgtcagtgtggtgctgccaagtctgtgtgactgttcacacactcgggctccattcacacaccccaagattgcatgagcttttgctgcagccactcacagtcaggccccagtgaatccctgtcctctgaagctgcaggtaggagcgccccaagggcatctagatgtcaaagaagaggatgctcacatgtgcctaaggttcatccatgaaggcttcgtggaggaggtggcttttgggatagatcttagaaagctcagagagttttaacaaagattggtccttgaagattactaatcttttgactttataaatacttgcatatatcttcttccagtctgtctcttattttttgaccttatttataatgtcttcttaaaacaagttttaaattttgctgtagtgaaatctatatatcatttcctttatgggttattctattgttacctcatttaagaaatccttctctacttcagaataatagagttcccactgttttcttccaatatgtagagttataattttcaagtttatgcctttgttccatattgggtttatttggaggcctggtatgtggtaggaatataattttatttctctccagccaaaagtcagatggtagtcagcctttctctgttgatttgtgtcacctctgttatatactatcctgcacatgctgagtgtctttgtgggttctttcttcttttccgttgattaatttgtctatacttgtgccagtacccatggaatttattagcatagttttgtggtatgattgatagctagtagaaaagtcctctttctttgttcttttggttttgttttatttttaaagttatctgactatttatgccattaccctgtgttagttcactctcgagttgctataaaggcatccctgagactggttaatggataaagaaaagtagtttattttggctcatggttctgaaggctgtgcaagcatggcaccaacatctgctgggcttctggtgagggcctcaggaagcttccactcagggcagaaggtgaaggcggggggagccagtgcatcacatggcaagagcgggagcaagagatggggtgggaggtgccaacaagcagacctcctgagaactcagagtgagaactcactcattatcgtgaggacagtaccaagccattcatgagggatccgcccccgtgatccaaacacctcccacctggccccacctccaacattgaggattacatttcaccatgagatttggaggggaccaccatccaaaccacatcaaccctttattgtaagtttcagaactaattggccaagtaaccaaaaatgagcttgggatttttattggacttgcattgaactgagtaagtttcagagaagtgacgtctgtacagtgttaagtctcctcatccatgagcaaactattttcctccattgactcagactctttttatgtccctcagtgaaaggttataaggcttgcaccttcatttctttttatttgttagaatattcaatatttatgttccagaccacagaacacctctacagtaataaaaactgtagtaatgaaaaacacgttttaaagcagttttgggttctatcagggttgggaggggaagagtgctagcttttatttattttctcttgggtaactcttgtatcaatagtatttcatacaaatgtgacactagctgttgccaagcaaagtccttgaggcacatcacgggagacttgtgccccttggttgacatctgttccatcagcatttggttcagcagttgttcaccaaacagtaaatccactaattgcatcatgcatatgctttctttttttttttttttgagacagagtcttgctctgtcacccaggcttgaagtgcagtggcgcgatcttggctcactgcaacctctgcctcccagggtcaagcgattctcctgcctcagcctcctgagtagctgggattacagaagtgcgctgccacacccagctgatttttgtacttttagcagagacggggtttcaccatgttggccacgctgatcttgaacacctgacctcaagtgatccacccacctcagcctcccaaagtgctgggattacaggtgtgagccactgcacctggccacatatgcatctttacccacaggaggattgtagataattttgccaaatgtgtttcttaaatttagaattactttatctgtggaatattattttcctaatgaatcattcttgtttctgaagatcccttgccgtatgctatcaatagtctgtgtcctggttttcaatctaacattatggaaatcttctcctccaacacacttatttgcctgtatctagtcttctcacatttcttccatgccacatgacttctcataatttgcttaagtgacagtaggttcaacctctgattttccaatatagtgtttgatcacatcagcatttatgttaaaatctcaatccattactgctcatgaaaaaatacttgtttttaatactatgaacccgtattcagacccacttaaaaaccagcactcacaatttcgttgggagactcctgtcctgacatatatgattatttgaaaattatagtaaacaggccaggcgtgatggctcatgcctgtaatcccagtactttgggaggccgaggtggacagtttgcttgagcccaggagttcaagaccaacctgggcaacgtggtgaaacccagtctctacaaaaaatgcagaaaaaaaattagcttggagtcatggtgcacccctgtagtcgcagctactcaggaggctgagatgggaggatcacttgagcctgggaggttgaggctgcagtgggctgagattgtgccactgcacgacagagtgatactgtcttaaaaaaaaaaaagaaattatagtaaactatatttttttaatgctacaatggataaaaatggttacaactagataagaagcctctaaattgcctgaacacctaagacttatttgctagttgacatctgatctatttctgacactgaaaatttcagtgctttagggtgctaaaaggaaaaaagagggtttgctaggaatcctgcagttgctgagggggtactctgataagggaattttaagcaattacagaacatctcactaaagtttttaaaaaatctttaaccagattaaacttatacaattttgttataatttgtgtttctccaggttccaattgtggacaagataaggaccattgctcaggctgtctatggagccaaagatattgaactctctcctgaggcacaagccaaaatagatcgttacactcaacaggtaaaagttctacttttaggggaaaagaaaaaattcaccttaggctctcagaatactcagcttgacttgaggatttgtacatatcgcaccagctaacctttgcttaatctattgtatggttaacaaagatgaaggtaatatcctcgggtagagtgtagactatatttagaactttatggtgaggcatatatcctctgatccatgcatcatttacttctgtgactataaatgtgtctgatatgggtggtatccctgtttttaggtgatgtgtgatctttcatccctcccactcagccctgaatgttgaagctatcctttggagtagagctgcggagtcagatttagatgaattgcaatgcttcctcttccttacaggcctcttacttactaccttaaaaatgctagcgtggtgccagggtaggcagataggagtgcagcctataaagatgggaatgtttgctgttcttcttatgcaagcggttcactggctttttactgagcttgtccgctgagattgaaggctccatcatcttctacctctagccactgacaaaggcaagtaggcaaacagctgggaaggtggctgtgatctgacagcatgcatcaccatctagtccagtgacagtcatgatcaatcaactccactacaggaggctcagccaccttcaccaaaaggaccgtatgcctcgagtgtccctcctactttggtgtagtcggatagatagcagtcagaacactttaagagcctgctggctaaagaacttcatgatgggtagcgttgaccttttctttaaaaaaaatctccaactccttattcttttttgtaaacccatttgaaattttgttaaatgctgccgttgccagccagggtatttgttctcctaggtttggtaaaatagtcagcaactcaggaagttctaaattcttagaattttccctgtatgttcttggcttatcctttacaaaaaggattcccaagcactgctctgtgcacaggcattgtggtgaaattttcattcatgtgcaatgaaccaagtaaaataaggtcattctcataaggttggtttgtttttttttccgtgagtttttaataatgatatttaagactatcatttattctaatattaagtcttttctcctttcagtgttaaaatggtatttcttttatgaagtaatctggtgagagtatatggcatattggttggtttttttctttttaatatgcctactgacaaaatttttacattagcaaacctgtattagttcatagaaattacttcaatatttaaccatgtctgaaatttaaaattctggcaccatttctgaaagacagttgtgattgtcactcagcaaaattcttatcggtatagaagagtggagatttcaaaaagaaaatggccccaagtccaagtcctccctgagttgataagactctaagatcttccaaatagttttaggctaagtcttatgaaaatttaactaaagatttcattccctttatctctatcaaggaaatattccttaaaagtgatgtcaaccgggcacggtgctcacacctgtaatcccagcactttgtggggtcaaggcagaggatcagttgaagccaggagtttgagaccactctgggcaacatagcaaaacctccatctctatttttattttttttttaaagttagtgtcaagtatgtggttgcaatgaattagcaaagcctctaaaggaacactgtgtgccatttaatcagaaccaggctttgaggacactgtgctttttgtgagacaccacatgtgacttcctgctctttcacctttggaactctgggtcagacatagactttggtccttaaaaacaagaagcttaaatagtgacctcatcttagttcttataatgtaattgcagatcaaatagccatgattcataaaccaacacaaaggaaccctttgcttcctgactgactccagaatgagtgaacaacatgagtaagagcctcgtcgcagagcctttctccagactaccttgctgggtcccggatattaatagtcttggaaagtggtttctacagctgctgctttgcctgaaaatagccatgctttccccaaacatgcacataacactgccttctcttaaagagagcctccaaaataaacaatagtcacccttgacctgctaaacagtcatcacatggagatgagtttttatcctcaccttcttgcttcttcagtgaacaagtagtaacaagcagctcctgcgtgtgcctcgatctgagccggcataccattgctgccgagactgtataaagtgcaaattgaaaagcacaggagactaacatctgtatcagtgaacacattttctttcctttctcacagggttttggaaatttgcccatctgcatggcaaagacccacctttctctatctcaccaacctgacaaaaaaggtgtgccaagggacttcatcttacctatcagtgacgtccgggccagcataggcgctgggttcatttaccctttggtcggaacggtgagtgagtcacattttccaaaaaccctccccattctgcattgctgtggtgcctcaaatcgttatgctccgcccgctctttaaaaatcatggattagggaaaattgggagtaattaatagtacagtattcgctatttttctaaacactgtgtctcacctacttttgccattgtggtttggatttttctttttttagatcatgtgttcagggtccttagagtcataatactaatttccttcctaaggtgagtaagaacataacttgggagaattcagtctgttatttaaatggtagaatggcttaagacagtggttgtcaacctttatcacacatagcacccaaaatgatgtcatcacggtggggttgactgctcacaccagacaggatctgcccagtcaccccaagggctggggaaagcagtcctcaccctctctcacttccccagcacgtcaggtgggaagctctggcttaggaaattactgaatcataggagttctcatttttgatgttgttgtgatgggatcatgttgctattggatgattattctgttattttgtgttatctatgggggtaaaggagatgggcagataaataaaagcttatcaaagtgcttaaaatccatgaagatgggcttcatttggtacagctacacagtgatagccttccgttggtaccgtcagtggcctaaatttgacttcttgtctttgggagtgctcctaaatttggtttagaacaaaaaagaattcttacaacctagcagatcccatggcaagcaaagaaaaaaatattctaacccatcattatcgtcatcattagtgcaaagtgatctgagcttaaacagcatacattatcataattttttataataaaccatgttgctttattgtgcaaacaagcaatagatagataaaaagtgcagattcttgccttgatatttacatacttcatctaatattggacacaatgttttttcaatcagcattttttgaattcttcctgcatgtgaggcacagagattttaggatgagcaggtgtgagacgcatgggtttgaatagcacagaggtatctggagagcactgtgttggtattctgaatgccctcagagcccagggggataacagctcattatgcctggggtagaacttacccaggatgtggaagaagaggggattcttcaaaaagagctcagcctctgaactggcaaaacagtgagttttgactcaaaggcaccaaagtactaatacatgacatcctctcctggggtgatccgatgtggctggagttggatgagggggggtggctggggatgggaatgggaatgggattgggatagcaggacagggtcacatggccaaggatcttgaagaccatctcatggaacttgaatctgatctctacacactggggagccacggtagggtgggttttttgtttgtttgtttcttggttttttgtttttttggttttaaataaggaggagaagaatgtggtctgatgtgtattttagaaaaatagctctggcagcaatatggagaatgtttagtgaaaagagaaccaggcccagagaggtgggttaattcagctcgggccagaggcaatcaaggtccgcactttggccacagaagtagatacagagagtgggggtgaattgcagacatactctaaaagtatcctcctaccgtgggggccgggggaagggaccgttctagcttggtgactctggctagtgatgccatcggtcatggaaaggacacgggagaaggcagattggcagagccagaaatgagcctggcttgaacagagagagctcagagggttaataggatctaaggaatagtctgtgtctccactggaaatacagacacagtgcttcaaagaaagaggcaggaaggtcaccctggtgggtttaaggatatgggtgaaggcagtcgttaaacaagagacacagggatagctggaaatcagtgagaagacagtgaaggaagacacccctgaaacacccacgttaatgcagccgactcctagcaggggtgccttccaggaggcgggaaggaaggagcagcggcatggcagagaacgtccagaaaaatcccacagacaccgctcgtagcagtgttggcacagggagaagggcctggatgaaatgggttctgaatgacattttcaggtctacagttcagatcagtggttgccaggagttgggggaggggaagcgtttgactgcagaggggcaggagggaactttttgggataatgcaaataccctatgttttgacgtggtagtgattccatggctatatacattcttccagactcatagacctattcacgtgtgttgcccaggctggactcaaactcctgggctcaagcaatcctcccacctcagcttcccaagtagctgtgactacaggctcatgccactgtgccaggcctgtgtataatttaattatacctcagttaacaaaaatgggtgctgaagagcttgctttatattcgttagaatggcctcagtcagccgggtgcggtggctcacgcctgtaatcccagcactttgggaggccgaggcgggcggatcacaaggtcaggagttcgagacctgcctggccaaaatggtgaaaccccatcactactaaaaatacaaaaatttgccgggcggggtggtgggcacctataatcccagctgctcaggaggctgaggcaggagaatcgcttgaacccgggaggcagaagttgcagtaagccaagattgcgccattgcacttcagcctgggtgacagagcaagacttcatctctaaatacatacatacatacatacatacatacatgcatacatgcatacatgcatacatagaatggcctcagtgatggccactttactcctgagctttagctggtgaaagccttggcttagggataagagggcggctggacagtgcaggcccagagagactggaccatcaggggaggtgaggggtgacggaggtgcccaaacagagcatgaaatggtagagtagctgagaaggttagcctcagtcacgatctgtcctgtcctaccctctgaggactctaaaccccgcagtagttcacccaacaaattcattcactcggccaatgctgcataaggcactcagctcggggctacagggagccccaactttaagaagctttctctgcttcaggtagtttacaggtggtagacgcagatagaagtgaattagtaaagagaatagtttggtgtaaaaattgtgcatttaactgaaaccttaattcactactgagcatttaatagccattaaataaaaaccagggcccgcacagtggctcacacttacaatccgagcacttttggaagccaaggtagaaggattgcttcaggccaggagtttgagacgcctgggcaacatagccagactttgtctctacttaaacaaaaattagccaggagtcatggcacgcacctggagtcccagctactcaggaggctgaaatgggaggattacttgagcccaggagtttgaggctacagtgagctatgatcatatcattgcactccagcctgggagatagagtgagatctctgtctctaaaaaaatgaaataaaataataaaaaacacaatataatttaaaatctttggagtcactaaacaaatatacaatgtgaatctcctctcactccagctaacgccaccatatccaacactaggtaaagaccaaagccgttctggaaaatcagaatctgttgccatggctcatgcctggacaccaggctgtccgctcctgacgtcactctttcacttacgacttgttagaaaatgaatgtgtggaatggccctggatagctgctgcagctccctggtttcctgaagtgagccctctgtgtcattatctggtcttctcagccctcagccgagttcctcctgtggccacacacggggtcgcagtgagcgtcagtgcacagtgatgaaatctcctggaacagtcgggtgtggggcatgaggaagggagtggtgcctgactacagaagttcctggaggtcaggaaactctcactggaggcggtggccctagagggctgctttctatgacagagcaggaagctgcatgtgtagtgggacacacgcaccagaggggccaggatctcctaataaggactggtatttatttttacttgaccccattctgggccttgccacagtctgctgaaatgccttgaacattcatcacccgtgtgggagacaggatagtaatttcctgctgagatgactgaggggacggggaatggggacaccagggggactggctcctgcaggtgggaaaattctagcaaaatgaatcactcttctgcttagtcacccaatgtgcacttattagggtgctgctgaaatacatattcatctatccactccagaaagatagtccaaactgagacctcaggatcagaaagcctcccattctcctgcagggttcattcatttactcagtgaattattaaatgcctacagcacgcagggccatcagccccacagctatgagaaagattcagtccttccctcacaggccttatgatagactccagtaaataaaaccatacaggcacagaatgcggcgggctttataacaaaggcagaaagcccctcttgttgtgtcctcaagggaggcagagaagctcccctctggctctagttggagaatcccaacccaagcaagtccatccttaaacaataaacatctccagcattgctggctttggaagaccccatggtgagatgctggagcttttttccgctccagatttcgcttctaaatatttacttttactttccatgttcacttataggccagggtttttttttcctaccattgaattatttcgtcatgttctatttaattattgctttaattggcattggtgaccacaaataataataaatactattaactggtgtaacagcttcactagtctatttcactgccccatgctgttgtaactgaagcccccagcacaagcattcccagctcgtggtcatctaagacctttgaggtcattcttacatgcattgctagtgttttccatattccttgatggtagccaatttttccttcttaaaataactttcttcattcctagtaagcttcatatgtattttatgtattcttccctcttttttatgacatgatacatattattgaaagctaggaaataatgcaagattcttgaacgacataataccacttagtacatctttttgtaagagatagtttttctaatacaaatctttgatatgggaagaaacaagcaagttgttttttaaggttttccaaccctatattctactacaaattaccctgttatggtatgcttccaaaattctttcaaggattatggtttatagagttcaataaacctaatagtttataaaacttctcaaaaaataatctcatgccaaaaataatttagtagtaggtggtctttgtcttgtggtcacatggttttgatattgtctttaagtttctataatttacaagggctgtttaatcagttggcataaatttcatgacaaaaatactaatatgtaagcaaagtatatgaaacaatattattgagaagtaaattacattccatgtagaaaaagactagaaagacaacaccaaaaccttaaattagacagtgttattatgagtagctttttttcttctctttttccatatagatcaaattactacattgggcgtatatcacttttataacatgaaaatacagtaaatagggcgatgataaactgcaagtgcttggggagaatgcttaactcaggccagttgcaagagagtgagaacacacacgcagcctgtgggagcgggctccatgccatcacctggccggtcctggctgtgttgctgtgttttcgcacctcaaaagttgggacagcaaagaaaggccataagagctagaacgtttccataagaagtgtattcagtatgatttgtctagctctgactaatgtgtgcaaaccccacattccactaagcaaatgcaagattgtttttccctgttcatttgttcctgggcccttcttgcttactgtgttgggagttggagaggggataattgacttctttcttctcacagtgttttctcttttttttttttttttttttttttgagacagagtattgctctgtcgcccaggctggagtgcagtagcatgatctcggctcactgcaacctccgccttccaggttcaagtgatactcctgcctcagcctcccaagtagctgggactacaggtatatgccaccacatctggctcattttttgtatttttcaaagagactggggtctcaccatgttggccaggctggtctcaaactcctgacctcaagtaagccactgcgcccggccatctctcacagtgttttttaaaacaacaatgcattttcataacagttggcctggagaggtgtccgaccaagttggaattcatagtagaatccattggaagttaatttttgatgtatttgactgttttccattgacttcgcattgaggcagtgagagagacttgaagaacttagaatacgcacccttttgtcactggcaaacatgggacatagaggcgtgtcttgacagcaatttgtggcaacactctgggctggaatctaggggttagacagcctggccggttttgtaaattagatagccaggccaccctcagagtcagtttgagggttgagtgggaagcctgaataaaaagagaagttaaacttttaagaaaagggtcaagctttaaaactggaattgggttttcaaatttaatgaggaaaaagaaaccccaaaactggaattgtaattgtggagaaatacaactgataatatttggaatatcatctacaaggaatgaaactatccagaagcatttagatggtagtcagtgccatgtagggcacctctgggggcagggtggctcctggcactgtggagaaagacgactggtgcttccttctcccaatcggaggaaagggatacactgtggaggtcccagcagcttagggcctgccccccatgtggttatctctgtgccgtttccttccctctgtcttcctgtaactccttcactttggcccctctgccctttctgggcagagggtgacaggaggcaccgcatgggtacattctttttttttttttttcttttttttgagacagagtctcactctgtcacctgggctggagtgcagtggcgcaatctcgactcactgcaacctccatctccgggtttcaagcgattctcctgcctcagcctcccgagtagctgggattacaggtggccgccactacgccccgctagttttttgtatttttaatagagatggcatttcactatgttgttcaggctggtctcaaactcctgacctcgtgattcacctgcctcagcctcccaaagtgctgggattacaggagtgagccactgcgcccggccaactacatgcttttttcctcctgtcgggattggcctgggctgtacctatctcatggtggaaacctgcccagggaccaggccctagaagaccagcagtttatttaactgggttggcctttgtccccactccctgtgacccggccctgccacatctttacccaggtgcaccactgacatcatcgcttggctggactctggaaagcaggaaactgctggagcgtgtttggggcatcagtgatgtcacccgctacaaatgctgggtggggttactggactgagggccatgaaaaaagaaagctgcggccccggcccgtggactcactgccattctgctctttctcacgtttcagttcagctcggtttgttttccgtccccctccctctactgtaaaagtatgtactcagtgtttcgtttcctgctggatctgattcaggtcagtgatgaagttatttgtgaactcagtggggaggtgtttcctcccctttgtaccggccctacttagggatgcacggttggttatacgcttgcttcactcggttaggcatggaggagaattcattcagccctcataggtttaaatcaaatgcatgacccttcacattttccagagatttacggccagttacaatgagacaattaaacattcacccccccgccaagctgcacttggagatgtgtaagcagtaatgtagtcatgcgctccccatgatgtgagagcgtgcagaacgccactccccccagcaggtccgccaggacctccgcagggagcatcttgcctgcaaaatcacacatccctttttccccctctctccactttccctactacttttccactcccacacccacaaataaacaaagaaaccttgagcttattttacaaaagtctttgaaatggccctcgtctctccaatgctcctgggtcctggtttggccccatctgtgcaatctctctgatgagtgtgaaataagccaggtttggctcatgctctgccggtgagcttgccctccccatgagcctgtcctctccatctggcctcactttgtttgtgtccctgtgtcctttgtctcccatcctgggatcctggtggtttcctcctcccctcccagcatgagtccttttccccagggttcttccctatctctacatcagaatttcctgctttctcccaaatatgcatttccctggcccaggcatccactgcttcctctcatcgtgaggtccctgccgcaggctgctgatggtattgtggccgtgccttcctccacaacccagggaaagctacgtgtgtgtctgtcccatagggaaggagtcatccctgtctcctcagtgtggtgtgttcaggaggaaggaaagtaaccagcgtcgttctcaatttccagaaactgtttatcatattgacaagaagaagaaagctttgtgactcatgagaatgatgttttcctctctggtacataaggttatctaggtccaatccatttgtgtagaggatcttctctcccctagtgtgatatgcacttatttttagcacaagtataaaactactttaaatgaaatcagcctcagccagggaaatatgctgagtaataatgttgccaggtactataccactgagttgagtttgtaattcactgctattaatccctgtgtattagttctgattttttactctttgcatacatagaaaaatggtgtttctcttcagagtcaaggagggaaaaaaagaaaagataaaagatgcttataacacttttgtgtccacccctaaaatcagcatattgatctattattttttctaggtattgatgagatgttgactcatatactttcatacaactggtaatatatatatatatataatatgtgtgtgtgtatatatatatatatatatatatatatatatatatatatatatagactcatttttcttccactttcatctacagcctacttgttttcttccccccatttttcgtatggattcatagcataaattgacaacaaagatacatctcaatttagagcttccaaaaggcacccataaaagtatctggtgctcatggaattgctctttcttctatgtctcttagttacacttttctcttattacacttttctatcccagccatggctaagaggcgtataatcagaagcagctaagcaatatatgcaagggaaataaaatgaatgcaaaccaagataccggttttgtaaattagatagccaggccaccctcagagtcagtttgagggtatagtgggaagcctgaataaaaagagaagttaaacttttaagaaaagggtcaagctttaaaactggaattgggttttcaaatctaatgagtaaaaagaaaccccaaaactggaattgtaattgtggagaaatataacggataatatctggaactcgcggcagtttacaggcttaactatgtatgtgttccttaaattatccacccgcagatatcagattacaataagtcctcacttaatgtcattgataggttcttggaaactaccactttaagcaaaaagacatgatgcatatgaaaccagttttcccatagtctaattgataggaaaaagagttaagttatgcagccacacagtacctcgtttggcttaaagtcactgtttccaagaacctatccacaatgttaagtaaggacttaccgtatatgaaaatatttgcagtaaattgcttttgagagaattggttatcacactcttctctgggtatcattgaaaattcagaatgtttaattacatcaggctatactcactggtataaaatcagggagcaagtataaagtaggtgtagggaaataatttatgttggattaaatgatccaatgaagggattttattaagcccctagaagtcccagaatgaaaatgtataactgcatgactaacccctaagaatttgctggggtttctgcattaagtacgcttcccaggccatttgtaatgaaggtaccgtgatctgttaaggaagagacctacagctgggaacaaaaagagccaattccatcctagacatcagtctcctgtttgactcattccaaccccaagaatatgttgtagagtgtaggacccatgaaagttacttactgtgcttccctgtaccttccgtcatccagttcccagacatatctgtgtttcttctctgaatgcctagttacttgggatcccatgctgtattggtctgttctcacactgctgtaaagaactacctgagactggatagtttataaagaaaagaggtttaattgactcagttttacaggctatacgggaagcatggctggggaggcctcaggaaacttacaatcatggtggaaggcaaaggggaagcaagcacatcttcacatggcggcaggaaagagagagagtgaaggggcagtgccacacacttttaaacaaccagatctcatgagaactcactatcacgagaacaacaagggggaaattcacccccatgatccagtcacctcccaccaggcccctcctccaacactgaagatcataattcatcatgagatttggctggggatacagcgccaaaccatagcacatgcctttcccaggactggtgatggaggaacggtgcccttgtcacacctaccagaatatactcacccacctccagacactccatttctctttcaagcacacctcttcacttgtgccgccagctaaggtttactgcagttacttcctttgtgtgtcctcttaccttaccaagtcgcctcacccaccatctactgttaattaaattaccacctcccccacttcccacctccagagtagagactgtgtcttcagttctcttggccttcccacaatgggaagtccagtgtagaacataccctaggagccaactaaatgtgctagtggcctgccaaccctgcagagggctagggaatcttcaaggagtctgctgccagtgaaactcaccagtactagaatcccaggctccaaagaagtctagaaaagtacatcttttaaggaggtaataagaggctcaagtgcccacaaatcctatctgctcttggcctagttcttttgggatcaatgtgctagtctctcttgtcgaaccagttactgaccagcaagactaaaaaaccaggcccaaacacattctattcatgtgcttagatatggacctacggatcaaatatcccactgtaaagcaaaacagcaaactgtttttcccttgtactttcacactcaacaatagcacgcttctgtggctggctgtgtgggggcttttccttacacaccaaatatttctcacaaacaccaaccaggtgtcctcttattcaattcaatcctgacactgtctacctggagatggtgtcggatcccacagattgacggctcagtcccatgagaccagccccacttcaggcactaattgcaaatccaggccatgcatacttctctgactgcctggctaaaaaccgcattcacagccgggcacggtggctcatgcctgtaatgccaacactttgggagaccaaggtaggtggatcacttgaggtcggaggttcgagaccagcctggccaacatggtgaaaccccatctctattaaaaatacaaagattaggccgggcacagtggctgacgccagtaatcccggcactttgggaggccgaggcaggcagatcacgaggtcaggagattgagaccatcctggctaacacagtgaaaccctgtctctactaaaaatacaaaaaaattagccaggtgtggtggcagacgcctgtagtcccagctactcaggaggctgaggcaggagaatggcgtgaacccgggaggcggagcttgcagtgagcggagatcgcgccactgcactccagcctgggcaagacagcgagactccgtctcaaaaaaaaaaaaaaaaaaaaattagctgggtgtggtggcgggctcctgtaagccaagctactagggaggctgaggcaggagaatcgcttgaacccaggaggcggaagttgcagtgagttgagatcctgccactgcactccagcctgggagacagagtgagactccatctcaaaaaaaaaaaaaaaaaatgggttcgcatgagccccctccttgggttcaattaagttcctaggatggctcacagaactgagagaaacacttatttacagaggtgttatgatatatattgattttcgtccatggttcctggttcctgaatcccataaaccttcttacagccttttgttataatgttgggggtgtcacgcctcaggggcaggcctctgaccttccctgccctccttgcactgtaatgtttcccccatttctgattgtgagtcttaagaccctcccatgagagggtcccaccctacaccttgtgggaaggaatgtggatgtcatgaagtgtccataaaaacccaagaggacagggttcaaggggattccagatagccagacatgtggagcttcctggaaggcagggcacccaggtcgggcatggaagttctgcacctcttcccccatacctcgccctacacacctcttcatatgtgtcctttgcaatatctttttgttgttgttgtttgtttgagacagagtctcgctctgctgcccaggctggaatacaatggcatgatcttggctccctgctacctccgcctcctgggttcaagcgactctcccacctcagcctcctgagtagctgggattacaggcatccaccatcatgcctggctagtttttgtatttttgtagagacggggtttcaccatgttggccaggctggtcttgaactcctgaccttaggtgacccgcccgccttggcctcccaaagtgctgggattacaggcgtgagccaccgtgcctggcctgtagtatcctttataataaactggaaatgttaagcatgtgtttcctttagttctgttagctgctccagcaaattaatcaaacccaaagaggggagtcctaggaactccaatttgaaaccagttggtcagaagttccagaggcccagacttgcgactggtatggtggggggcactcggccctgtgggatctgacactatctctgggtagacagggtcggaactgaactggaagccaccccacctggtgtctgctgcttggtgtatggggaaaccccatacacatttggtcacagaagtcttctatgttgatgactgttgtggtgcgacagcagaggaaaacacggtttgaggagagcttttcccaacacgcttatgtgtgccagtttattatagaagacacagatgaacaccagatgaagagatgcatagggcatggtctgtggagttggggttcacctccctcctggcacaaggatgccttcaccaacccagaaactcatcaagtcttgttcaaggatttttgtagagcttaatctccactccccgccctccacccttcctggaggttgatgggtggggctgaaagttccagccctccaatcttctacttacttggtctttccatcctgaggctagctggaggcccaccccgtcactccattaccttaagctcaggtgttattgaaggagctccttatgaatagagcaaaatcacccctatcagaaatttcaagagttttaggaaacctgtgactggaaccaaggacaaagatgaaatatattttgtatgatagcacacccaccagattggatcgtggggccatatggcctttagtgtggaagctgcttgaccacattttccgcccatgcactgccattctcatttcaggctgcgtcatcatcatcatcaccatcacctgttcttagcaaaggtcgcacaccttccaaatgctttgtatagattagctcatcactccccatactcaccctgggagcatagtcagggataagaggtagagttctagcgctctgtggctactatggtttatgggatctttgcgcaggaataactggactttaaacatcttggcttttcttttcagtaggtcagtcggcatgtactcacagggccgtgcatgctgagcattgagacacatcacaagggagtgaaaacctgctgccatacccccccagaggcagcaggatgtttggataaataaggcataaacacctggagaattaaagcaagtacaattagtgcagcctttgccaagagaaaggtgtaagtgctaaatgcagtagatgttcaaatacggcagagaccacagtgggcagggtaggccaagaatgctgcctaaggagtggggcttggggtgaaactggggcatttgagacactgcaggcccatcaccctggctgcgccctcctgagggaggcagggactgaggcgggaggcctggagaggtctgtgcgtgagcctgggggctcattgataaggagcttccagtgggggcaataacattggaagtggagaggatggcatgtgtgccgggagacgcagtggagtggaagtcgccggaactgacaagggatgggatgtgagcaaggagtccaggtgagtcctggggacctgaaaggatggacccagagagataaacgacttcaaaccggcacggcagtgaagtgactgacccgcgagtgccctgcaccgaggctgacatttgacttcctgccaagttggccatcagacagttagaaatcaattttggagttcaggagagaggccagagctgaaaattggggagttgtttacattgggagtgatatacagtctctacatttccatccagttcaaaacattcttgcgtgtctgctatgcactgtgcactgaggttaccaagactggaaagacccaatccctgtcctggaagcttagtgttggcaggaggcagacaagctgatacatgcaaacaaagggctcacaggtgccaggatgccaagggatacagaagaaggatggttgcttctctacccaggagtgccctgaggtgtcttaaaaagaggagcatttatgactcaggcagggtggcacattccagacggcagtgggcaggagcctgactccagagcgccttagaggctgccgctgggagttgagctggaccctgaaggcagtagggtaagccataaattagggttaaggaaccaagggaataaggggatcagaccattgcatagctccagcagcaccattactagcagcctgtgtgaatgatggtcccctcttacatgcccaccatgcaagggctctaggccattcttcactctttaatgcagaaaagcaaaacttccagctgttttcccctacccaaaatgtgtgagcctgagcccagccccaggatggatcttgtcctaggtaaccaagaaggccttaagtgtcagaagaggtagctccaggctgaataaagggacaaatgaagcattactgcactgagatcgcccgtcgtggggtgggtctatacccatctagtcattaagcctcaataatttggtttctaaatggactattatttgctacagatcaaaagttgttggaaactatattacacagataaatagaattgtcctgcaaataaaggaagtaatctcttctctgtttgagataccatgcagtatttgtccaacttgtacaaatagttctgatccatgagaatcctccactttcaacttacttgctgctatatcccaactattataaggccatggagaccagtagcctggtttccattatctttgctctgtttttttttatggcatggttgacactacctccagtagcaaagagttaacttgtcatcagagctataaaatcacaatgataagtgaaaagttctcttttgtactttagcatccaagagaagtgtaattcccaactacaatgctcaaaataatagagagtttttactttgggcctgaaaatacttataggtcaggtctcctagttgggtccatgctgttgttggtgttccctcccaagtaaatacatactgaatttagcaaattattcatttgtgatcctctgtgccatctaaaaatatatatagtttaaaacgctggccaggcgcagtggctcatgcctataatctcagcactttgggaggctgaggcaggtggatcacctgaggtcgggaattgaagaccaaactggccaacatggtgaaaccccctctctactaaaaatacaaaaattagctgggcatggtgttggactcctataatcccagctactagggaggctgaggcaggagaatctcttgaacccgggaggtggaggttgcagtgagccgagattgtggcactgtactccagcctgggtgacagagtgagactccatctcaaaaaaaaaaaaaaaaatgcttatcattgcacagatagctgtacagttttttattatttatgataacggtaactgactttttgttaaagctggtttggaatctggaggttattttaattttgataactttatgattttaacttttaattttaactttatgatgtttgtcataaaagagtggaatgtgctcctattttgagatggaaacatttcggcagggagagagaagagagacaccaaaccacctaacagccaggttccaaggggagattcattcagcgtctttgaagcattgttagttttcatttgaggcataaattggaaacttatatctttctttggagtaggaagtatttcagacagaaaaaaaatgattgctacaacaacatcacgaaaaagaacagaaggtttcatgaagagtaataaagttaagtttatgaattagagcttcagatgggaaatcttatttggacagtaaatggttaatggtacagggacaccatgatgggggatctttgcagcattgaaaaaacacgcgtccataaatccttctctagcacttctttgtgatcacagagtcaagctgaggacaatgatggagtgctccagttcatccgaagtgcacgagtcccctttgcagcagactctgacattcccggcccctctccggagtgttatcaacatgcagtcagtgctctctacgtcattactttaaaaacaaaaactcggccagcagcagttcagtacatcttcaaagatcttgacttgtaattttttcccctgcatcttctctattgagcacatgaactgacatctttctacccccaaataatcagttctttccccctaaataaaatgggtaatccaaaaaagacccatcaaaaggaagctaaagatagtaatgcctaggtagtttcgggaccagaatgattgtctctaaatatgtacatgtacagtgattacgtgtttaaaatgtttaatgacttggagaaatagtgtgttgagtggagaaaaatgagatttagtagagcataacgtcaacagtgtaaaaatacatagaaaagcaagcaggaataaaggaatgtttaaataaattacaaagataaaaattaaaaccgtaattcagccgagcctggtgggtcatgcctgtaatcccagcactttgagaggctgaggcaggcagatcacttgaggtcaggattttgagaccagcctggccaacgtggtgaaacctcatttctactaaaaatacaaaaattagccgggcatggtgttgggtgcctgtaatcccagctactcagaaggctgaggcagaagaatcgcttaaacccaggagatggagtttgcagtgagcctagttcgcgccactggactagactaggtgacagagggagactccgtctcaaggaaaaaaaaaaaacttaactagaacatttattgagcacttactaggtgccagctagtgctctgagtgctttgtgtgtattaactcattaatgcccccagcacctcttgaggtagattaaaatctccatctcggttttacatgcaaggaaaccagagcaggaagagcttcaggaacttgccctcctagtaaagatagaaagtagcaaacccaggattcaaccccagaaatattatatactatgtttgtgctgaatcttttttttttttttttgtttttggagatggagttttgctcttgttgcccaggctggagtgcagtggcgcgatctcggctcaccgcaacctccgcctcccaggttcaagtgattctcctgcctcagcctcccaagtagctgggattgcaggtgctcactaccacgccggctaattttgtatttttagtagagacagagtttctccatgttggtcaggctgttctcaagctcccgacctcgggtgatctgcctgcctcggcctcccaaagtgttgggattacaggcgagagccaccgcacctggcctttgtgctgattctatagtcttattttcacatcctatcagttactgtaagtaactcttgattccaagaactgtataataggaaagggtagcttccaattatctactcttgcttgataatgcattaattccacatagcctttaaaagtttagtaaattttaggataaattttcgaactgttatttcctattggctgttagaaaattgtgttgctcaaaggggaacatgtctattgtgccttgtggagattttcctacagcttttctggctgacccgtcacttgcactctggaactctcctaaaccagatacggcccaccacgtggcatggtgtggatcctggactttctgtcatccgttaggttcatattcttgaagcaagtctagaactattttctgagagattccctggctgttgttctgtgtttgggtgggttagtcacctttttaggtgagagacttgatttgggtacacagtttcacaaaagtattgtcaaccctgctggccaagtgactgacgtgctgggcatgggagcacactccatcggcatggcagagtggattcactccatgccattgccagagaataggactttgaaccacagccacccggctttttctgaaaggcctgcttgggcaatgatgcctggagaattatctgaagaatgcagtctgtccattcctctggagatggtctagtttttatccccagaccaagctgaacctcttagagctgtgcatttatattgtgtggaattgccttcagcgacgtgttctataacgtcgtgttcttgtcaccttttgagggacactggtgctgtggggaagatcctcaccaatacgcaacagcagggccctgttctctcacctgccatcccctctggaaagctcacagagagggtttcctgggttgctccttttccaagcaggacttctactgtagacttacagctccagttacaagcctgtgtgcttgtctgtttccccacaaggtgttctgacctgggagggaagggacggaatcctattcatctctgaatcctaaatgccaggcctagcacttggcacacagtgggttccagttgtggaatgaatttttttcagtcctgacaataaatgttggggttctttagtttgtttgttgttattgtctgttttatttgtattttggggttttttgctttttcccccagggaatgaaaatgccttctccatatgaaccagacatatcctggggctggggctgagtgtcctttgttgtttgctctaattataactaatgaacagttcagctctggtaattgtaggcttgctggacccagtgcctgccttctaactgaatcttgactctgctccattatgtattttccatgatcctgatttctgtcaatctaatttttaaatttcattctaaggcaaacctgctcatgttcttcgctgaaatcaacctcccctttctggaatggacatatggaaaattggaggcaaaatataataatggtggtgactcagactgctttaaggcctgagagaccggccaggtactgtggctcacgtctgtaatcccaacattttgggaggctgaggtgggtggattgcttgagcccaggagtttgagaccagcctgggcaacataatgaaaactcatctctacaaaaagttactgggctcagtggtgtgcacctgtagtcccagctactcaggaggctggggtgggaccatcgcttgggcccaggaggtaaaggctgaagtgagctgtgattgcgccactgcactccagcctgggcaacagagtgagaccctgtcttaaaaaaacaaaaagacccatgagacctagactccccctgtcaaaaatactcacacacacacatatacgataagatagtatttctaccttttctttctcaaaacattccacagaacagtcttaccttcgaggagagccgtatgcatgaccttttgtttgtttgtttgagacggagtctggctctgtggcccaggctggagtgcagtggtgccatctcggctcactgcaacctccgcctcccaggctcaagtgattttcctgcctcagcctcccaagtagctgggattacaggcgcgtgccaccatgcccagctaatttttgtatttttagaagagacagtttcaccatattggccagactggtctcaaactcctgaccgcacattatctgcctgccaccacctcccaaagtgctaggatttcaggcataagccaccatgcccagctggaggccttatttttactgctattcagagaacctgtggcttatccatggagggcttaagctttgccttttctcttgctcatttccatacctagcaagagcttaagctggtttattgcactgacattctaatgaaatataaatagcttctcaacagagagataagaaagaggagtatctagtacagcaagaccctctgggtgggtcagggccagctggggccgtgccggggctctgagtggaggaggtggcgtgggagcactgatgctcgggctctgtcacatccgtttttggcatttgtcctggcaaaggctgcatttctgatctttcagaaagctgtgggtacactgtacagaaatgtgttttgcttgctttgaaggatgacctactggctgacagccagccagaattaattccatatacatttgcagattttcagtatgagagacggcaattagcctacagaaacccatttaacccccgaggtggagctgtatggtgaagactgttatttatgggagtctgtgtaatttgcctctgtgacaagggacagccatggctcaggagggcccacgccaccctccttttcaaggactcctgcccctgcctgagtggcttggcctggcctggccatgtgagtcttgtggacacgtgcacatcagtcagggacccctgtggtatggaccaaagggttgttttttactgttttaacttatttaatagcatctcatcagtattacaggcatgtgccgccacgccaggctaattttttttgtatttttaatagagacggggtttcaccatattggccaggctggtcttgaactcctgacctcaggtgatcaccccgtgtcagcttccaaagtgctgggagtacaggcgtgagccaccgcacctggcccacagagcttctaaaggaaatgtgttggttttttaatcaaagttgaggcagtgcctcagtgaggggcaggctggagcagtggtaagcgcgctgaaggagtcgggctctctgggcccaaagtcctgccctggccacagagtggctcccttccccctgaggtgggatgatgttctccagggccttttagctccaggctgctacagttctaaactggtggtggtggtggtggtggtggtggttgtggtggttgttttagatgcagtctcactcttttccccaggctgggatgcagtggcatgatctcggctcactgcaaccttcgcctcctgggttcaagcgattttcctgcctgcgccaccacgcacagctaatttttgtattagtagagttggggttttgccatgttggccaggctgctctcgaactcctgacctcaggtgatccgctcacctcagcctcccaaagtgctgggattacagatacgagccaccgcacctggccatgattgttgtttttataaaatcagaatataaaatttgaaaatgttcttttttggtgagaaatgagaactaccaaaggagtaaaatgctctaaaagccatcaggtccttcccacagtattgaggctctgctcttaccattttgttaaataagttttgttcctaacactctttgtgatatgaagtattcttgctaatcaagctgcccggagactggcgtttcccagagcagtttcgaaagtggaaatgatgctgcatttcctacccacagtctggagggtggctgtgctctctgcacggtgggtctgtgctgctcagttacgggatggtaagggaaggctctaactcggtgtcttacaccatgcactagggagtcgcccgctttatttacgagcgagttgatgctttcagtgggttttggctttgcctggttccagactcaagcccttcctctaatgtagggcgggtacaagagagacttgagcaaggatattgggatttaagggaagggcagtgcaggccaaggtcagcaagaggacatctctaagatgaacagcactgcatttgtgggaagcaaccctgccataaacaactcagttaacgtttacatagtaaataattgcattgccttgggctggaatagggacgccagaaggtataggaccatgtggaattcagaaaagggagccctgaagaatgagattttattgttcttaccaggagagtccaggtgctagagttctctccttgtaagtgactaaccttctcccttttggtacacaatcctcagatgaacggagatgattcattaggccattctagcttaatggatgcatcactgtgcaaccacgcaaatgcctcatttctgattcactcatttaatatttattgaggagtgctgggtactaggccattagaagaacaaacaacaacaacataggcctggaccttgcacttgcagagttcacaggctagagaggcacacaagttaaatatagagacagctgaaagagctgacgtctgggacagagggagccccctgctccaggagccagggagcagatgccatggggggctggcagggatagggaagtcaggccaggaatggggttacctaagccggatcatgaaggacgagaacagactcaccaggggtcgagggacaaggaggcagcaagtccgcagcatgaaggcaggagagaacattgctgtaagcctttaccatggccactgcatggggaggaaacaggagatttggaatgagctgtgacactgggcaggaaagcaagacccaggtcttgtgaggccttgagcgtcaagcttaggagtcaggacctggggattttaagtacagcaatatcataattacattcatgtttcagagagatcactcaggcagcagtctggaaggtggagtggaaaacggagaaattagtcatgaagacctatttagaaagtagtaggcaagaaatacccagggcctaacctgaggtgtaggcaggggatgggaatgagagcaattaccgaactagaatgaactaaactcaatgaacaggagcggggaagagggaatgcagaaatggctctcagatttctgacttgttcgcttaatgactggggttgtcatttgtttagataagcaataaagaacctagaaacaattttaggcggaagatagttgtgttgggagcccctaagaccatgatttattacagcacaaggatacaaagcaaaattagcaaaaggaaacagcacgtggggtcaagtccaggggagctcaggcgcaagcttccagagtactctccccatagagtcacacaagatacacttagttcctccagcattgaactatgacgacacctgaaatattgtctgcagaagaggctcattagagactcagtccccaaggtttttattgggtaatggtcacgtaccaaatttcagtctctcagaacaaaagcaaatgttcagcatagaccattttgtttgtgaaatttaggcacagtgagcccctcttgtcagttagaggatagttgaaaccctcccacaatccaagttctcagactcaggcctgctacattatttctttcctacacagtagtggatttggttactaacatgttggatctgaagcatttgttgtaatttacagtgaagatgtccactgcacagttccgtattgagtctgaggttcactggagacatctgtgctatcaatgaaagtttctggagtcattagcccctcaaagggtcattaaaaccaggtcttctagagagaaagtctaaccctgtattcctttaaaccaccatagagaccatctagttcttcacattataaaaatgagaaaactgagtccccagcgatgtggcttggttgcacatttttctatttcaagtctgttactccttccatcataccagactgcctcacaaaatgacaaagtcaggcattgttcataaaagaacaaaatggcatttaggttataaatcaggcccttgtaagtttggttaatacaacttatttcccaaagatcctggtcctcagaccctcaaaaggagagctgatcacatcaaggcctctacctggaaggaatttctaagcagcctctaagtcaactgttcatgttcagtccaccttgatttacaaagaacagtgaatcattaagacctttctctccaaggccgggtgcggtggctcacgcctgtaatcccagcactttggaaggccgaggcgagcggatcacgaggtcaggagatcgagaccattctagctaatacgatgaaaccccgtctctactaaaaatacaaaaaaaattagccaggcttggtggcgtgcacctgtagtcccagctactcgggaggctgaggtaggagaatggcgtgaatccggggggcagagcttgcagtgagccaagatcgcgccactgcactccagcctggagaacagagactccatctcaaaaaaaaagaccttttgctcctctttgctcttgtgtctgtttaacagatttttatgttaacaggcactctgtttgccactaggaataaaaagataaatgggacaaagtctttgccctcaagttacttatattctagagccaagaaagagatagatgaagaacacatcttatatattaggactgtgttgggggcaggagtaggcagagtaaccctttggatatgggaaatgaaaataaatcaaactcaaaacaagtttattatttgcttgaagctctggtaaaagataaagtgaaacctgcaaactgtaaaatgaagttgctgctacacatttctccagttttggatttcattcttggatggcctttaacttggatagaaggatacaagacagccatatatatatatatatacagctgttgctctttaagatatccacttcaccctgttgtggggtgggaggaggggggagggatagcattaggagatatacctaatgtaaatgtcgagttaatgggtgcagcacaccaacatggcacatgtatacatatgtaacaaacctgcaccttgtgcgcatgtaccctagaacttaaagtacaataaaaaaaaaaattaaagaaaagagatccacttcgctcagcacatgtgatttggctttggtctttggtgttaatttggatgcctaaagaactgactttccttgatgctcactccagcctttttaggactagattggatacatttacatgtttgctggctgttttttctacagtcacacatcctacccataataatattgcaatattctaagttgtcttggaggatatcatcaagtaggtgtcaagtaaaacttaatggtagactgtaaattttaaaacaagttacaggtcatttgtgtagtctctctctctatatatattaaaagaaacaaaacttttccctcttgaatctttattcctatctcagcttcatttattgcctcgtttgtcatctaaatggtctttgttctttcagctttcaaacatgattaattgacattgtgcagcatagcacagggaaaaggctgaatattttgtatgatgagtaatctagttaaacgcccatctttcttttcaactttaccaacaaatgtgtcttatgcagatgtaagggcggtttgcttatttccctgttcaaaattttatgctattagcctagcatagcatgtttcttttccattgagctagccaaaaataatattgacaaattcatgaagccttccatctgatactgttgcaaacttatgcaaatgtattttagactgttaagggaatgtaagaattaaataattaaacatccaaatgtcaagaatgggataggaagaagtaactggcctcatgttggaagttaatgaaatatttgaaaatatacctttaaaatcaaagacatgaatttgtgttttgggtttttttttttcagatttgaataaagcagagtataatattatagttgctgcaggaagttatgagcatttctggaagtgcttattttcagcacatgctacttagaattttaaaggacattcagtgtatctttgtcatgaatctttctactgggaccaggccactcctggatgaactcacagattgagagcttctcaaaatgtaaaatcaaattgtcttttaaaatatgctattttaaagttctggagaatcaatgaactttaaatgaaaatcggccaatacttggcaaaaagtcaatttgaagagttgtctctttataatctctgatttcacttatagagcttgcttccaaaaaaagtactacgtatgtcataaatctgaaatgttttgcttttatgccatttttaagtcctgataaatattcttgaagtgttaaattattattattattattatttgagatggagtcactctgtcgcccaggctggagtacagtggtgtgatcttggctcattgcaacctccgcccccccggattcgagtgattctcctgcctcagcctcccgagtatctgggattacaggtgcctgccactgcatccggctaatgttttgtatttttagtagagacagggttttaccatcttggccaggctgttcttgaactcctgaccttgtgatccgcctgcctcggcctcccaaagtgctggaattataggcatgagccgccgtgcccagccagtgttaaattatttttaacttgttagaaataattgtcccacaacttactgaaggttggtttaatattcactattgttcccaaaaaactcttaaaatattaaaccaactcatagctcataacttttcaaggtagcaagtgtttgctaatcttaaaatgtgttactattctttttttgttttttttttgtttttttgtttttttgttttgagatggagtctccctctgtcacccaggctggagtgcagtggtgtgatcttggatcactgcaacctccacctcctgggttcaagtgattctcctgcctcagcctccccaagtagctgggattacaggcgtgccactacgcccagctaatttgcttgtatttttagtagagatgaggtttcaccatgttggccagactggtctcgaacccttgacctcaggtgatccacccgccttggactcccaaagtgctgggattacaggtgtgagccaccatgcccggccactattcttaagtgaccttctgcacatctctgtagttttatgcctggtgatggcgtttaatttaggagtatctggcatgccactccagtctgacagctaggggcatgttagcaaagggggcatttttcaggtgagtgggtgagcatagccgtgctgaccatctttcctatccagagggaaggcctagcagggactcacgccatcttgacttgcctgccccaggctccctctcactgctcccctggcctcttcctcttctccagacaatggggccttatgctcgctgtgtttgtcagaactctcttgtggttgtggctgcaagtaagagaaactcaactcgagcttattcagaaagaggggatggattgacccagataacagaaaagtgctaggctagatctggccttagccacagctggatccagccttctggcatttgtgctccgttcctcagccctgccccactgggagtgatgccttctgttcacagtgtgatctgcttcatactcaaaactccctatccagaggaagaggaatcttttctctcccaccatctgcacagcagtattcaggaatcccctgccaggctctgttggcctcatgtgccctgtcctaatccaccactgtgcccagccagggtgtggccatacatgcccatcctgtgcatagggcaggagcagacccacctgcaccacatgcggtggccgccatgaccacaagaccaggataggagtgctgatcaggccagaccccaagggctgttgctcagaccatacctggcctgtagagtagaagaactaaatgtctcacacaggcaaagactactcttcaattcctttaattgcaggtgtatgttggagtccatgaaatacaaagttattgagaagcataactaaatttatagtagctcctcattatatattttcatgttgataggattctgcccccatgggaattaattttcttcatcaaaagtgatctccatactcacaaacactgaatagctttgggcttttaaaaacaatgttttggctttaaaagaaccacaggaggctgggcgcggtggcttacgcctgtaatcccagcactttgggaggccgaggcgggcggatcatgaggtcagaagattgagaccatcctagctaacatggtgaaaccctgtctctactaaaaatacaaaaaaatcagcctggcgtggtggcaggcacctgtagtcccagctattcaggaggctgaggcaggggaatggtgtgaacccaggaggcagagcttgcaagtgagctgagatcatgccactgcactccagcctgggcgacagagcaagactccatctcaaaaaaaaaaaaaaaaaaaaaaagaaccatggcaaaagtgtcctttagccgggtgcggtggctcacacctgtaatcccagcactttgggaggccgaggcgggtggatcacgaggtcaggagattgagaccatcctggctgatacagtgaaaccccgtctctactaaacatacaaaaaattagccaggcgtggtggcaggcgcctgttgtcccagctactcaggaggctgaggcaggagaatggcgtgaacccgggaggcggagcttgcagtgagccaagattgcgccattgcattccagcctgggcaatagagcaaaactccgtctcaaaaaaaaaaaaaaaagtgtcctttagtctactgttggttcttccaaagagccatcctttcgctgatgctttaggaactcccaacctgggtcctgtcaaggataagctctcatcttattcccacaaaattcctagagttactcatcattttcctttcatattcagctcattaaagcagtttgtaggtctctgtagtccatattagtaagtgttaaaaatgtatcaatttgattttttttttttttttgagacagagtcttgctctgtagcccaggctggagtgcagtgttgcaatcatggctcactgcaacctctgcctcctgggtttaagggattctcctgcctcagcctcctgagtagctgggattataggcgtgcaccaccacgcctggctaatttttgcatttttagtagaaacggggtttcaccacgttggtcaggctggtcttgaactcctgacctcatgagccaccgctcccggccatcgatttgattattataaaatcaggttatattggtttgaccagttaaaaacatcacaggttatttaatctttttatttatttatttatttattgagacagagtctggctctgtcacccaggctggtgtacagtggtgcaatctcagctcactgcagcttcgacctcctacgtccaagcaattatcgtgcctcagcctcctgtgtagctgggattccaggtgtgcgccaccacacccagctaatttttgtatttttagtagagaccaggcttcaccacgttggccaggctggtctcgaactcctggcctcaagtgatccacccgccttggcctcccaaagtgctgggattacaggtgtgagccactgtggccagctaatcacttttttaaatcacaatttgtgttacgttcatgagtaatgggtgccagaaataatgttgtgtgttaaacataaatgtagatgggtaaccatgtatacaaatgcatatctcctcaacccagagagtgaaatttccccaccccagtgaccctgcctcgctgtatggttcattcttctccaggaattgaaacatggtggcagcctgccagcttggcgttaccattaattcttattctcttcccctgccgatgtcatggggacaccagccaaatgaactctgatgtgtctcacgtaatgcatgtggacttctggtgcatgtaaacagagggtggttattcttgattgcacatttgtgatttttagtgaggctctaagggagaagcaagaggacttgaataacagatttattctcgggcactggtacatgaaagagatgagtaatgccaaacaaataacacaattctgattcacgccattggtaatggaggagacttctgggtaaacaaaccaaagtaacagctagaatgcagatctgatcacagcagtgtgttttgattcagtctaaagatgacaaagaaaagtttctgctggtcctatctgtagcaacaagggcctgcccgcctgaccacactgcagtggaacagccacattgtgattttgcgggcctgaagcctttcgtctggtgaccctttaagaggaacttgagccaagatcttatcagtgatggagatggagacacctcaggattttccagtatcgtttttcactttttgttcttggacatagttaataacgctgccaggtctttcaaatgctgaggcatttcctcatagctccaagtagctgctgcgggtcagattctgcttgaaccgagggttcaattacaacatccgtatgctttccagcccactctctgacctttgttctttttttcagtactttttcaggctcttaatgtttccatccactaatctcaggagactctgtaaatattctgagtatacatagcccaattacttttgaaaagctaatttaatagaaacttcttgatatgaattgaataaattttttaacttaaaaatcatttacttacaacttaagacagttaaacttgagagtatttgaaagctagtaaacttcagagctttcttcagtaggcacgaactttaccatttttctgacactcagcacggtcagcaatgacacattcattggaggactcatcaatatccctaaaaatagtagcagtactcgtgcacagcctgatttcttttgaacttggctcaatttcttggaagcattgatcatgggatcccgctttgattccttttctgtagactagtgccagtttgcccagtttcattacatttttggaaagagctaaaactatggtatcgttttattgcagtcctcacatcaatcataatttggagcagtcttggtgaaagatgaggaattcagactgggatcctgggcaaggcaggtccagggggcaagagggatggaatgcagtgagtacttattttatatcataagtacagccacctcagcctcatgactttttagccacggcttcattccaaagtgaccacagtcataaggcccaaaactatcttctctctctttctctctctctctctctctctctctctctccctccctctctctgtcatagggacctccctaatcctccaggttgtacagccaggaagggtaaggtattgtcaaaaacaagtgaggtacccccttgatagctcagtgggccagagggcctctggatgctggctgatcatggcaaaaactaaatacagaatccatacagtggattctctgtgctttttctcttcacccctccttacccttgaccaaatttctgactgtgttattttcttattgcagtcctccctgctagatatacaactttgactttcatcagaagaaagtgctcccattgcattattagctaaaccatgttgcagtggcaacgctccttcttccagcttgcctcggtgtttctgtagttagcatcaggtgtccttggttctgtttaccagcctgtccagggatcacttccctggtgggatctctctggtgaccctcatctcagagctcagcggtgcctttggggctacttgccagacaactccatgtgacagagggccaggtccaagtgctcgatcaccccagccaccatttcagagttctcggattatagatccctcaacgagtcccagtgagacaccgaacatgccatagaagctatgtttttctatttcagcacacagtaaaacactacctcttagatgtcgatgagtacatgctgcttttatgttgacgcagaggacctgtgttgactcttcatcggcaaggtgtcttttttttaagtttcaattgacacataccacctctggcccaagtggaccacacagttatgcatgccctttggtgcaagatacatcacgtctccaagaactcgggtgtttttctgatcatggagaattagattccacatatagcttgtatttaggatctgcagattaggttttataaattatgtttggcaaatgataatccacaaagtagattctaagttaaaatactataaagtactataatttatgtttaaatgtctttcaacctgagagttactctcccttagaagtccccaaaaatgctgaaaccacaccaggttgatatctgacctttcacttttggaaaatgtgtatattgttgaacctctaatctagattcggacaccatcaccaaccagcttctctctttcagttgccatctgcactttactgtttagtttttgttgtctttagggaaagttgtaaaatacccacattcttctcaagttcttcaagtcttttggtttttagtaaacccttttgtgacattgtctttgagaacagaggtcaacaaacatttccttaatggactagatagtagatatatcaggacttgcagaccacatggtctctgtcctaactactcaactctgccgttatagcacaaaaccagccgtactcaatatataaatgaatgaccctgtggctgtgttccactaaaacttcataaaaataagcagctggccagatttgctgtgtgggtcttagtttgccaacccctgatctagaagaaaagagttttgtgtaatgtttgggtaataaaataaacataccaaaccatctcaggaatccctaaccttttcctcattgggaactattttcccagtatccccaagtactggtgggaatgagataaaaagggccaggcatgccattccctaaagcagatagccaaccctctttctttccctgtggaaatcccctctgcctacagggaggagaagcaactggtttggaagctgccagccagtccgtttatttagaaaattctaagcccagttccagatcactttgcgtcaactctaaaatacagccacaaatgaaataaatgttgtttataatcctaccaagtctagtaggtgtgtatgtgcttgaggttaaacttttgtgtaagctccagacttactttaggtttatagaaaattacatcgcaattgatacaatggttgtgttgggtgatggagatagaaagagggagaagaagtgaaagtgaaattttggtcaaaattggataccaccctaataagccgggagataaggggtgctgcagaactgttttctgtgatacagtgcatctacattgataatttgtgttttatgtacttttaaaatgaggctttattggcttgatttctgtgagaaaaatcactaatgggctgatcgtactgctctacttcaacatgcaagagaattgctcagacgcttgtcagatgcctgaaccacatacttatttgagaatgtgccatcataggaagctttcattcaccaaggtcaccgagagggcagcccagggaagcacgttgaacttcgcatggttctggccactcgtgtcagtagcaaagcaaggaaataaggagctgacttgcccaaaaattacaagttcagagaaaacggacttgttttgtttggaaaaggcagataacggagcagtaactaaagaatcctctttttttattattattgttgttgctcaatttataaacctaaacagaaaatgtgtgttgccttatttcctcttcttttctacagataactttcttttaaaacattctaaatattaagcaacattgtaagtacagattttttttttttttttttttttgagttggagtctcactccgatcatccagactggagtgcaatggcgcgatcttggctcactgcaacctctgcctcctgggttcaagcagttctcctgcctcggcctcctgagtagctgggattccaggcacccaccaccacatttggttaatttttgtatttttagtagagatggggtttccccatgttggccaggctagtctcgaactcctgactcacctcagcctcccaaagtgctgagagtacaggcgtgagccaccacgcccggctagtacagaattttttatggccccttttaaagactgcaaacctttttataccaaaaaaaaattatttttcctgtatttattttacacattagtaaatgaatgaaattttggctctaggtttagaaagcaatttcattttaagctcattttactgtgtcattggactttttattaattttattcttgaactacttagctgaaaatcgaattctgtcattatatgtaatcatataatgcttctcataatgttacactttaattagatgcagttgaataataacctaaaaaatcttcatagtctataaaattcacacttatatttataagacaatattatctcacccattgatacataatgttatgttaaaagtacacaatatggccaggtgtggtggctcacacctggaatcccagtactttgggaggctgaggcggcagatcacttgagcccaggagttcgacatcagcatgagcaacatgttgaaaccccgtctctaccaaaaatacaaaaattagccaggcatggtggcgcacatctgtaatcccagcaacttgggaggctgaggcaggaggatcacttgaacccaggggacagaggttgcagtgaacagaggttgcagtgagcggagattgtgcctcctctgcactccagcctggatgacagagtgatactctgtctcaaaaaataaaaagagtacacaatattatctcacccattgatacataatgttatgttaaaagcacactgcattctagagaaggtagagtaacagggtcttactttaccctcccacttgaaacaagtaaaaaactggacaaagtatatgaaaaatacatcactcagggcattggacaccaggcagcaaaaaacagtggcccctgagaaattggaaacaaagtgagtcctataattgtccttatctagaaaaagtttcctggctactgtgtagagagaaggaacccaggagaaagagctcaactgtctccctgagttgaagacagagctggggatacatcaagggaaaccaaggcagctagtttgcagaggtggaggaccggagaggagagaactgcatagagagagctttgcggatgtacagagtcctccttgagcatgcaagtgcgtactgatcaaagtgtggttgtgagaaaactacccatcaccagagaaaggatcacccgaaagaatgagggaacagtgcctgcctcccacacagtagccaagaagaggtgcctgttgccaacagctagagtgaaaacctctgaatgcaggggcactggttagaatactaagaagggtcttgccagacatccaatccaaaattagcaggcatgcaaagatctaggaaaataccacctaaaatgagaaaagtcaatcaaaactaacccattatacagatgatagaattcatagacacggacattaaagtagttgttgtgactgtagtttgcatgtttaagaaactagaagaaggatttaacatgttaaatagagacaaagaagatataacaaagatataaatcaaactgaagagatgaaaactgcagtgcctgaaatgataaaaaaaaaaaactcttaattaatagcagattagacattgcaaaagaaaagcctagttaacttaaagacatgcagtagaaactatctgaaatgaaacagaaaaaggctgaaaagaagcaagagagcaacattgagctttgggatcattttaagtagccaaaaatatgtaaaactagagtcccacaggagtggaaaaaaggaactgaaaaatatttgaagaaataatgggcaaaacgttttcaaatttgatagaaactataaactcatacattcaaaaaaatgagaacattttaaaaagagaggataaatgacacattatgtagagaggaacaaagataaattggctgatgatttcttgttggaaacaacacaaactagaaggtggtaggtcaatatttttaaagcagtgaaagaaaattcacagcctagagttttttacctggttaaaatatctttccaaaacaaagctgaaataaagactattttagacacgtaaaagctgaaaaaattcatcactagctaacctgaagtacaaaaagtgttacagaaattcctgctggcagaaagaaaatgataccagttggaaacctgaatctacccaaaggaatgaagaacaccaaaaatagtaaccgcatggatagaaagacttgttcttactgtttatcttaaaagctattactgtatacagtaattactgcataaagcaaaaataataaaaatgtagtatagcgttaaaaacatttagaagctaaatatatggcaacaataacacaaagtctaagaggagagaaatagaagcatgcttttgtaaaattcttaggctatatgtgaagtagtataactatatgtggtgtggtagtataattatatgtgaaggtagactgtgcaaagtgaaatgtgtatgtagtcatgtgctgtataataacgttttggtcaaaaacaaaccgtgtatacaacagcagttccatcagattataatactgtattttttactgtaccctttctattgtatgtttgcatgtataaatacttaccattctgttacagccacctactgtattcagaacaataacatgctatgcaggcttgtagccctggtgcagtaggctgtaccatacagccaaggtgtgtaggaggctataccatctaggtttgcaagtacactgtatgatgttcacacagtgacaaaatcacccagtgatgtgtttctcagaatgtacccgtctttaagcaacacaggactgtgctgtaaatgcaaggtaaccatttcagtaattcaacaacgttatagttaaagagttgtaaccttgttatagttaacaaagttaatatatagttatctacaaagtagataaaatgaaatcattaaaaataatccagaggaagcagaaaagggaaaaaggaacaaagaacagataggacaataagaaaaagaatagcaaaatagtagatttaaactcaactatatcgataatcacactagatataaatgtcctaaatacactaattaaaatgcaaagaatgtcagattggctaaaaatgcaagagccgactattactgtcaacaagaaaccctttttaaatctaaagacataagtaggttaaaggtaaaaggatggaaaagcgctaatactaatcaaaagaaaattgaattggtatatcaatatcaaagtagaactagagcaaagagtagtaccaaggatataaaagaggcttgtttcattatgacaaaggggccgtttcacgaacaggacatagcagttctaagtgtttaagcatataataacagagcatcaacataaatgaagaaaaaaaaagataaaattatagggaaaaatagaaaatccacaaatatagtcagaattttttaaacccctctcagaacaagtagagtaaaaatcaataaggatttagaagacttaaacaatgctacaattcagcttgactccacccaacaacagcagattacgcattcttttcaaacgtacacagaacatttgccaaaatagaccatattctgagtcacaaaatgtcttaataaatttgtaagggctcaaatcatacaaaatatgttctctaaccacagtgggattaaattagaaatcaacactgaaagacatctggaaacactccaaatatttggaaataagctacagagtgggagaaaatatttgcaagttatctatttgatataaggatttgtatatggaatactaaaactcaaaactcaatgagaaaataacgcttttaaaagatgactgaaagatttgaacacatatttcacccaagaaaatacatgaaaatatgcttaccatcacaggcattagggaaatggaaatttaaaccacagtgaataccgctgcatagctattagaatgtctacaattaaaaagattgaccagctaagcacagtagctcatgcctgtaatcccaacactttgacaggcagaggcaggaggatggcttgagcccagcctggacaacatagggaggagactctgtgtctacaataaaagaaaaagaaaattagccagttgtggtggcctagctgctcacttgggaggatgaggtgggaggattgcttgagcccaggttgaggctgtagtaagctgtgattgcaccactgcactccagcctgcaagacagagcaagaccctgtcccaaagaaaaaaaagattgggctgggcacggtggctcacagctgtaattgcatcactttgggaggctgaggcaggtggatcacttgaggtcaggagttcaagaccagcctgggcaacatggggaaaccccaactctactaaaaatacaaaaaattaattgggcatggtggcacacgcctgtaatcccagctactcgggaggctgaggcccgagaattgcttgaacccaggaaacagaggttgcagtgagccaagattgtaccactgcactccagcctgggtgacagagtgatactctgtctaaaaaaaaaaaaaaaaaagactgaccataccaaatgttggcaaggatgtggaacaactggaaccctcatacactgctggtaggaatatataacagtaccacccccttggaaatcaatttggggtcgtttcttaaaaagttaaagtgcacctgccatatagtcaagacattctctttctaaatatttacccaagagaaatgcagtatatgtccatgtaaagatccgtgcatgaatgttcgtagcagcttttttgtaataatatacagtaagctttacactttgacatgtgcagtttattgtatgtaatttgcctcaataaaagttttaaataatacaattttatccaaaataaagttgtgaaaagtagaaaaatgaggaaaaagtttcaaaggttagaggggtcagtccaggagacctaacatctaactaatgggaattccaataagacagaagaaaccagaagggaagaaattatcagagaaataatcctcagccttccacccaaaattttctctcctagaactgaaggactcccaaatcaaaagggtcagcaaaataaatgtatagactcacaccaacacacttcatcataatagtaaaaagaacagtagagtcaaaaagaggatactaaaagctttcagagggggaaaaaacaaaacatgcaaataatctggaacccgaatggcatcagacttttcaacggtaatactgggctgggtgcagtggctcacgcctgtaatcccagcactttgggaggccaaggcaggtgaatcacctgaggtcaggaattcaagaccagcctggtcaacctgatgaaaccccatctctattaatagtacaaaaattagcttatttcttaaaagccagcaagggggatggttttttccttgggctggtggcacgcatctgtaatcctagctactcgggaagctgaggcatgagaattgcttgaacttgggaggtagaggttgcagtgagccaagatcgtgccactatactctagcctgggcggcagagtgaaactgtgtcttaaaagaaaaaaataaataaaagttatcaaaaaacaaaaacaaaaccataatactggaggctagattacaatagagcaatatcttcaaaattcaaggaaaatggccaggcgcggtggctcacgcttgtaatcccagcactttggaaggccgaggcgggcggagcacgaggtcaggagatccagaccacggtgaaaccctgtctctactaaaaatacaaaaaattagccgggcgtggtggcaggcgcctgtagccccagctactccggagaggctgaggcaggagaatggcatgaacccaggaggtggagcttgcagtgagccaagatcgcgccactgcactccagcctgggcgacagagcaagactctgtctcaaaaaaaaaaaaaaaaaaaaaatcaaggaaaataatatacccagctaaaccatcatgaagtgtgataagaataatgacgaagccagacattttagaaaaatctacccctagcgccctttttctcaagaagccactagaggagtatttcactcaaatgagcaagcagaggaaggaggattgcttgagcccagcctgggcaatgtacagagaccccatgtctacaaagaaataaaagaagaaaattagccaggtgtggtggcctgtagtcctagctactcactcaggaggatgaggtaggagaattgcaagtaaatgagcaagtaaaccacagaagaatattaattttctcttttttctgctgcataacaaatgagcacacatttagtggcttaaaacagctcacatgtattatcttccatttctctgggtcagcttagctgggttctctgcttcagactgcgaaaattgtctcatctgaggcctgggttcctcatcaaagctcatttggcagaattccattccttgaagttgtgggactgagggcccagctttttgctggctgtcagctggaggccacacccaggtcccagaggccatgtgggtttttgccatgagaccttctccttcgtccattcacagcatggcagcttatttcttgaaagccagcaggggggatgggttttctctggaatctgttagatgaagtgacctcccttcactgtcactcgtgccatattctgctggtgagaagcaagtcacaggcctcacctgcactcagggagggactcactgggagtcgccgccacagtgtggctccaggaatggaaactaccacactgcagaggtgcagggaatccccaggattatggtcaagaaagagcccactaagtgttttgttcagtaggcctgcaggatgaagggtgccaggaggatggctccatgaaagactgagcctatacgtgaacgtactgaaagctgacttacagttcagccagtgtggtggtatgtgattgacagcgccctagcaagatgagcaacaaagatacaagactccagcagaaacaagctgcagaagaacaggagtgtaatcaataaatcagatggccttgctgtgaacggttacatagctctgataaatcctgatctaaccaaaagtcatgacagctcgatatttgggagctggagggggtggggagtaggggtagtaggatatgaaggagctaagtccccattgttgatattagaaatccagtgggtaacatctgaacggcaagaccaggacagcagcgaaaggcaaaaagacaccactgagtgttgacagtggctgcctttcaggagtgggaatgccactgggggcagggcagtggggggcagggaacaggtttttctgtttgttttttgtttgtttgtttgttttgttttgagatggagtttcactcttgttgcccaggctggagtgcgatggcatgatctcggctcacagctggagtgcgatggcgtgatctcggctcaccgcaacctccgccccccggattcaagcaattctcctgcttcagcctctcaagtagctaggattacaggcatgcaccaccacgcccagctaattttgtatttttagtagagacggagtttcaccatgttggtcacgctggtctcaaactcccgacctcatgtgatctgcccacctcggcctcccaaagtgctgggattacaggtgtgagccacttcgcctggccatgggaacagtcatgttgcatagtaagccctaaagagcagtgtgatctcttaagccagcacgtgatttactttggtaaaaattaaattaaaaaaaaagaaattaggccaggcgtggtggctcacacctgtaatcccaggactttggagagccgaggtaggcggttcacctaaggtcaggagttcaagaccagcctggccaacgtggtgaaaccccgtctctacttaaaatacaaaaaaaatagctgggcgtggtagtgcacatccataaatcccagccactcgggaggctgaggcaggagaattgcttgaacctgggaggtggagatttcagtgagccgagattgcgccattgcactccagcctggatgacggagtgagactctggcccaaaaaagaaaaaaataatcctattggtctcatagtgtttctctgtatttttaatatactgtgtatgtgcttatgagaaaccgaaagagaagtgatttgtgaacgatttgaggacttttggtccacgtttttttctcccacttatacttgtggcataatccagaggaagaagggcagctgcggagtcccagcagtgttgcgggtatcagggcagccagtgagaggatggaggagaaacccaggagagggcagaggaggagggacagctgtgcccacctggtcctttcattgttgtctgcctctgcccttgcagttagaaaaagagtgttctgtgtatagaagcctttgcaagtagcatagttaggagtctttcggtccaggaattgaaggtgctaaagcaggaggaaaacatacatagaagaaaggaaatgtccacataagtaagtgtattagtctgctagggctgccgtaacaaaagaccatagactgggtggcttcaacaacagaagtttattttattttctcacagttctggaggcgggaagtccaagatcagggtgctggcagggctggtttctgctgaggcctctcttcttggcttgcagacagctgtcttccctgtatgtcgtcttctctgtacacaaacatccctgtgacctcttcctcttcttttaaggacactcagtcctattggattagggccccatgcttatgacctttttgggttgttttttgtgtttgttttgagatggggtcttgctctgtcacccaggatggagtgcagtggcacgatcatggctccctacagcctcgacttcctgtctccaaatgtagtcgtattgggggattaggatgtcaatataggggttttgaggggatgcagttcagtccattatatacagtaagccacttctagacccagtctgaagtcctgagcattcagctggtatctggagtggatcacctaagaaacattacagaacaatataggcctctggtatttaaaatagtttaattacgtcacagggtagtcctgaattctttcctacttcagccagtcttggccagccgagtttcagggtagtgatgagcactgatgaggtgactcccccttctccaaactcttcctttgccactgtcccaagaaaaccataaaggggaagtttaaatgatggatgtaattttcctgacttgggctgggcgcagtggctcacacctgtaattccagcactttgggaggctgcggtgcgcagatcacctgaggtcaggagttccagaccaggctggccaacatggtgaaacgctgcctctactaaaaatgcaaaaaaaaaaaaaaaaaaaaaaaaatagccaggcatggtggcacacgccagtaatcccagctacttgggaggctgaggcaggagaattacttgaacctgggaggcagaggttgcagtgagctgagatcttgccactgcaccccagcctgggtgacagagactgtctcaaaaataataatgatttccctgtcttatgtttttctactacacagcttattatctctgggcaggagctttcccagggtcggaggggcaagggtctagttgtgagggagagaggtgaaagcaaaagggaaatgctaaatgacatggcacagcaagcaaggtctaggcagctgcgcctttgataacaagctgcttgaagagaaagaccagatcggctgagtgaaagcactgtccatcctccccaccccttccttcctgcttcctcctcttcccatctcctccagcttctccttaaagggactaccgaatgatgatttccttgccagtaggaccttgacataaaacccagcccacaacatcacagttgattttcaagggatgagcttctcagaaaccagaatttaattacttaattttgagtttccaaacaataaaatatattattaaattgatttgttttccacacgtagtggagattttcatggtgtgctacctgtcggtcaaacggctgatgaatgagtatgtcgcaaaaactctaggtgggaatatgacacatgaggaatggaatttgtgcttcagctcttcccagcatcttcttgggctgcacaagagttggtagtctttcatctcctaaggactgaagggccatttagaatcacacctgttttgagtttatagtcacgcttctgaaactttctctcttacagccttatctgacctcaatcaagctacccctgttcatttaaatactttaggtcttggctattggtttagcttaacatttgattgccataaataagaactacagaaagcgtgacttgtaaaattgtagacccagaaaaattagggaacaatctcataatactaatgaaaccttttttcccataaaataaatacataattagatatagaagattttttttttggtttaagctatcttttcctatttctatcttaaataatttacaactctcctttaatccaggcaattatcaattctataataaaataacaacaatgggtactgtgtattaaactctaaactagggtccttcatctcatttgaattttgaaatgactccataatatattgttatactcatgctgtagttatagataaagaacgagggctgacctttgacaatcacaatcaaaaaaaacaaaacaaaagaagtgaaggctgagcgaagtaactcacccagcaagatgcaattcgtatagggtagagtcccctgtctcccgataatgctttgccccacacctgaaagtcttgatctggttcccattacccctcagactttgggtccccagtagaacctttgcacttgcagttctccttcctaatgggctcagggaaactcacatgactgcctggaggctgtttctgcacctgtagatgggaatgggcaagtctctcccgactcacttgtctcatagtgttgttgaaaggctcaggtgtgatcattacagtgaaataaggaaaggcagggaagaatctccatcgttctccaaatacgaagaatgaaatgcaatttttttttttttctttttgagacgaagtctcactcttgtcacccaggctggagtgcagtggtgccatctcggctcactgcaacctctgcctcccaggttcaagcgattctcctgcctcaacctcccgagtagctgagattacaggcacctgccaccatgcccagctaatttgtgtatttttagtagagatggagtttcaccatgttggccaggatggtctcgatttcttgacctcgtgatctgcccacctcggcctctcaaagtgctgggattacaggcgtgagccacagcgcccggccacaaataagtttatacccttgtagtcatggcctttcttttatctttctggtaatgaataaaaatgaagcatataagtgacagagaaaccagctacttgatcaatagtggcattgtttcacaattgtctgtattggattttgccaacccactagagagttaccaaagcacatttctgacataactatgattgatttttttttaatttttgactaaatatgttactttgactaaattggttacttcattgcataatggtgaccatttacacttttcagataggtacaaaaaatctgtgtattctagctggccatgaaagagtagcaagcctgttatttttaagaaaaaagctcgagtagttactgtatttgtatcattttggaaatctctcatttttctaatcagcaaaatggggataatgtaaataacaataaccctgacctcacagggttcttgggattaaatgagatatggtgcatacaacgtgcttagcatggcgcctggagtatggtcagaacttaacaaacacaagttataaatgaggtcccgaaatacaagaaattcacttcctcagaaaccttccttgagcctggctacatctatagctacattttctacatgttaaatgcctccctcagaagtgtcactgttggagttgccagggcaccaatttattactttgaaaatagataaataaaagaatcaagacaaaagaaaaaggtgctaccaaagaagacattctgtcttacactggatcacacgagatgtggatatttggcccggaactgctcacatgggtcagcaagcctgagaatgaccgtggagagaaatggctggggctgcaggactcagccaagcctggcacgcgtgtcttccgggcaccggagcaggacgttgtctgaaaacatgaagaatgaaatggaagtaatgtaatacctggggtcggggctgggggaagctttctaagtacaggcagggtctttctatgttgcccagggtggtcttgaactcctggccccaagcgatcctcccacctcggcttcccaaagtgtggggattgcgagtgtgggccactgtgcctggcctaattactgattttaaatattaatctttctaaaagtcaaactccagaactgtgcatgtagaactattcaatttctgtatataactatagaaatatatattagacgggccgggcgtggtggctcatgcctgtaatcccagcactttgggaggccgaggcgggcagatcacgaggtcaggagatcgagaccatcctggctaacacacggtgaaaccccgtctctactaaaaatacaaaaaattagccaggcgtggtggcgggtgcctgtagtcccagctactcgggaggctgaggcaggagaatcgcttgaacccgggaggtggagcttgcagtgagccgagatcgcgccactgcactccagcctgggtgacagagtgagactccatctcaaagaaaaaaaaaaaaaaatatatatatatatatatatgtatatatttatatatgtatatacacacacacacacattagataagcacattgtttatataggaatcaaaaattacctgtgagtaatttttatttatgtaatttaataattacataaaaattatttgcagaggttacctctggaagcagtattagaagtggaggacttttttcttctatgttgaaaatattttaagtaaatttttaaaaacgaatagaaatttaatcaggaacaggctttctaccattaaaaaactttatagtcttctttacaaaagaagagaaataattgtacttgttcagtcattcaaggccactgaaataattggcatagcttgagctctgtagtactgtcacaatatgcaaacacagtgtggtaatttttatagtaattgaacatgacttacgtcttagaaagtcataagttaggaatttattctgttcgttcttttgaagtgaaaagtaaagaaagcaaaacattttttggccgggcgcgttgtctcacgcctgtaatcccagcactttgggaagccgaggcgggtggatcacctgaggtcaggagtttgagaccagcctggccaacatggcaaaaccccatctctactaaaaattcaaaaattacctggccatggtggtgggtgcctgtaatcccagctactcgggaggctgaagcaggagaatcacttgaggccaggaggcagaggttgcagtgagcagagattgtgctactacacttcagcctgggcgacagagcgagactctgtctcaaaaaaaaaaacaatgactttgacctgaatgtcccaagggtctgctttgtgtagtctgcccctctacaagcagggaccaggtcttggtcacctggtgtccttgtagtaagctcttagcagggactgggtcctggtcacctgggtgtcctggtagtaagctcttagcagggactgggtcctggtcacctgggtgtccttgtagtaagctcttagcaaaggttgctgagtcgaatgaacttcaccgtttcggtcctttggtacagtaacaggcactcaagagagtccacgctgtagggttgatcagccaccatgagagagaagtatactctaagagcacacaccatcaaccccagagcatccctgccgaccaggaatgtagttacagcggtgcaggttcccagctaccccaaagaaatcccaggagagtccatctctactaagtcaagcaaatagaaattgcaactgtagcagcacaatctattttcattatatagtgtgtgtctctctctcccctcatctctctctctctctcctttcccctcggtcacttgacattgatactgggccatttatcctcgtgcatcatcttagagttacatttgtataattatcaacatggccatttgatataaacaattccgtccctcacatccaaagaaaagggaagagacagaaagaaaaggcctaatttctgagcaatttttgttgtttgtttcccattttgtaattgtcctccatctttactcatctgtttttttaaatattaattatttttttgagacagggtctggctctgttgctcaggctggagtacagtggtgcacatggcttactgtagcctcgacctcctgggctcaagagatcctcccacctcagccccctaagtaactgggaccacaattgtgcaccaccacacctggctaatttttgtttgttttttgtagagatggggctttgccatattgcccaggctggtcttgaactcctgggctcaatccatcctcctacctgagcctctcaaagtgtcaggattacaggcgtgaaccaccatgcctgaccaaaaatactttctgagggtctaatattgccaggcaccgtgttaacaattcagaaaatactcctgcttaataaataaagacttgaatttttttagttacttcattgaaaagaaaatctttttatttaaattgtatcgtcagccaggcgcaattgctcacccctataatcccagcactttgggaggccgaggcagacgaatcatttgagtcaggagttcaagactagtctggccaccgtggtgaaaccttgtctctaccaaaaatacaaaaattagccaggcatggcggcgggcacctgtaatcccagctatttgggaggctgagacaggagaattgcttgaacccacgaggcggaggctgcagtgagctgagatcacgctgctgcagtccagcctgggcgacagagccagaggccatctcaaaaataaataaataaataaataaataaataaataaataaataaataataaaattgtgatgtagttaactggtataatcttttcagttatttttaaatttttgaaacaacacgctgtatatcagccatccatcagagaaggaaagaaatatgtagaaggactgtcttctgcttcagatcatgaactgtaggaacaaaatagatatgtgtaaaaatgctgctccttttctgaaccaaaataaaattagatttttgttgttgtggttgttgttggaaaaggtagtagatttcaggcaaaatcagaaaataaattatttcagaaacacaacaaaactaagtacaacgatattttggttaagaaaattatggttagaaattatgattctatcactttatgaaacagaatctttaataatttttcagcttataccaaggatattcttttatttcttaatgactagttttaaatatatgactattctctctgtacagatttttaattaatgctcataaaggctattgatagaactcattctttctccaaaatggagttaacccgaaatgggtagagattcagaagcttcattgtagttaaaattagggtcatgaagggcaaaagcccaggtatttcagcctttgtagaagaatccattaatgcagcattacaagtaagtgtaatttagtggctccttagttattttaagcaagaggcctccttaaagggcacacagataaagtcaacatagatctccactgaccccaggcgtgcggccagaggtcaactcccaacggctgtctgggctcctttttccctgcagtgctgtatgtctgggggggtgacaatcctttgataacagttttttttattgggagaaaatttgtgggaatgcataaggtcttgctaacataattccacattatgcttgctcaacaggagaagttttagtttaaatgtagacttattggagatggctgtatatctgcaggtcagggagtctcgcgtctgcagattctttgtggtttctcgtctgtcgtcgcttatcccaaataagtagctgcacttcttggaagagatgattgcgtcacttgaaggggtcatgggagtctactgattgaactcatttttctcccatctgaaagaaagaaaagttgaaacaagaggaaagacatttcacactttctggcatttaatatttcggctagtttttgtttgtttgtttcttttttgagacagattctctctctgttgcccaggctggagtgcattggtgcactctcggctcactgcaacctctgcctcccgagttcaaacgattctccttcctcggcctcccaagtagctaaaacgacgggtgctcattaccacacccagctaatttttttttttttttttttgtatttgtagaagagacagagtttcgccatgttggccaggctgacttcaagtgatccgcccgcctcggcctcccaaaatgctgggattacaggcatgagccactgcgcccggcctggccaggtttagatcctggttttgtgaaagaatcagaatgactagaagattcatgttccgatccactgcagctaacaaatacagctccaggaaccgcacaaatcctgcatcgcctttcatcagcagatagttaaaggcggagaattgggttttcttgtttgtaaagatagtgcgtgtaaacaagcatgcagtaaattatgttatctgcagtagagtcttccattggtagctttggtcagacgagctgaaatacactgccttcagggttcttcttggtttgtcaccgtgagtagagatttgaatttacactgcctcatctgtactgaattctgcccttgctgtgaatcatgtcacagtctcagaagcagcagcagccatagagtccagtgacatccttaccagtaagatacctttgacctagagagttcatttcaggggtggggcagcatcagtgtggctaaatgtgaatattcatttctttttcttaaactataaaatgcttgttcttttccaaatccatagctaggcacagattatagaggcatcttaaaaagccttctatagctgggtgcagtggctcacgcctgtaatcccagcactttgggaggctgaggcgggtggatcacttgaggtcaggagtttgagaccagcctagccaacatggtcaaaccctgtctctaccaaaaatacaaaaaattagccgggcatggtggcaggtgcctataatcccagctactcgggaggccgaagcaggagaatcgcttgaacccgggaggtggagattgcagtgagccgagatcgtgccactgcactccagcctgggtgagagtgagactctgtctcaaaaacaaaaacctcctataaatgccataagatgccggcaaatgccatctcaaaatgcagttaggcaggaaaattacctggtatgagttgtaacctaggcaactggaaaaaaatatgtgtccaccagttacccttgtgtttgatgtttcaagtagtagaacagtataagtgtggttttctttctggggtctcccccattgtatgcactcactgtagtaaccagaggaaaatgttaccttcctgctgggaaccttaacttccgaggctgtgatacccatcttcatacctaaagttttaacatatagcaagtccccacctacaagcaggtcttatgtcaaaagtgtagttgcagtttattgcctggaacccggaatggattttcccataggcgtgttatgaacggcagctgtattccaggcagctgtggaagcctttttagcccatttatatacctgaagtgcagtcatgtgcaattagcaagacaagaaccagccatcatccatcacaatgttttatgtgttcccccagcctccccactcccactctcagttggcccagctaggcagggaagggggtgttaatgaggcctgcaggtgcacagatttactccccacctgctgcatctgcaggggttaaaccggcttttccctccccttcgctctcaccattccttctctccctctccccacccccagtctccctttccctgtgctgaaggggctgggcagtgaagtgaggaagggtggctggagctgttgggggctgaggccacattgtgcagttcacatcagaaccccctggggacttgctccagttgcagattcaaatgcagcaggtctggggtgggctctgaaattccgaatatctaacaggctcccaggtaatgcccatgcacaggcccacaggccccatttgagtaacaggagtctctaaacaccatgcagggaggagaggctggtgaagagggaaacctcgagtcacgactgaaaggcagtggagggtgagagctgagttctattctctaggccttagggaggtcccttttacactgagaactttttgccacatgggaagaagcaggcaaaccctggatgccatcaggtgctggcacatcgcagcctcatctcatgcaaggtgttcttggccagggcctgtggaggttctacatgatatggcattaaccctcgggagagcaggcacagtagaacctgaatgtctcctccaagcgactgggtgcagcatcgctccatgtgactgggtgcagcatcgccccatgcgactgggtgcagcattgccccatgcgactgggtgcagcatcgttccatgcgactgggtgcagcatcgttccatgcgactgggtgcagcatcgccccatgcgactgggtgcagcatcgttccatgcgactgggtgcagcatcgttccatgcgactgggtgcagcatcgccccatgcgactgggtgcagcatcgttccatgcgactgggtgcagcatcgttccatgcgactgggtacagcatcgttctatgtgactgggtgcagcatcgccccatgtgactgggtgcagcatcgttccatgcgactgggtgcagcatcgttccatgcgactgggtgcagcattgccccatgtgactgggtgcagcatcgttccatgcgactgggtgcagcattgctccatgtgactgggtgcatattgctccatgggcatggtttgtatgaaacactcactattaaagcacagtaggaaatgctgaaatggaaaaggaatgggtcatccgggagccccaggatctagaccctggagcagtgtttcagggcctgaggatccgtcaagggggccagcatcagaagccccagcacacagggggcttctgatgcaggaggagagtgtgcggtttgaagatctttcatcccaacacagcaaggcggtgaagaaccagttttcatcctgtctccaccactaactagccatgtgtccttgagctcataccctcatgcctaagtgtcctctgtcctcatccgtaaagtaaggctaaaatgagtacctacctcattagggtgctgggaagctcaatgagattatttctgtaaaacccttagactgtccattaagtgtcacaaaagcagtcgtaggggtggctgtggcggtatggtagtggtgaaatgagtaatttgagattataggcctaaagtcaaatttctggttttgcaactttttactagtgtgacctgggcaagtgacttagcctctccaaacctcagtttcttcccttgtaaaatggaaataataaaagttcctacctgctatattattgagaggataaaatgaggaaagcacgtagcacagtgcccatcacaaagcaagctctcagtagatatcagttactgttattgagggagaccggggtgacgactggcatctgaacaggagttttccagctgtgctccaggagctataggttttacaaaaatgtgtcttgggggtgagaaggaggccattattcaccctgcccacacctgctgcccccttcaacctgatgggcttgtctttgttggcgttcagcatgaagattttattgagaagaaaaggtttggagtttggaagatcactgttttgtagttcgggtgtgttatggggccacagggaaggtaaatggtctcaattttcaggaagttgacatttgccttttctacttcatttccttaaacaaaaattgaaatatcagatgacaaatttaaagagatatatcccatataaaacctaaagttctatgaggctgtattgaacgatagagttaatttgcatcatcagatgttgtggccgctttgtagcatttgctaatctgtaacgcttggttttctcccccagatgagcaccatgccaggactgcccacccggccctgcttttatgacatagatcttgataccgaaacagaacaagttaaaggcttgttctaagtggacaaggctctcacaggacccgatgcaggtaggctgatgtgcttcaactttttctctctttgtttttttccagttcatatcctttttttgtcattttttttttctgataccacagaagtgatctgataaatcctttccttcctttgttactcaaattcctaccaaatgattttccgtgactggagttcactcctgggtgtggctgtgagttacatgctcagatgctcagtacacaacccttagtgtcctgcgctcgagtccagtgaaagccaagttatgtcatccctgaatatagatgtgtttagagcatctctgaccataacagaactctgtaaactcattgttcttttccaggattaaaaccagcgtctgttataattttaaaagagtaacttcctaccttcctgccacgtatctcttggtacagagctagaatcatgtgaaagaggaatcttggtgtatccgtttcctggggctgccatgacaaagtatcgcaaactgggtggcttaaaacagtggaaagtttgaaacagttctggaggctagaagtccaaagtcaaggtgtcagccaggccatacgccacctcgagactctgggtggaatccttgctggcctcttcctagcatccagtggtggctgtcactccctggcgttcccaccttgcagctgcgtcactcccgtctcagcctctgtggtcccaccacgttctccctgtgtctgtgtcttcacatgatgttcacctcttataaggaccccagtcctattggattagggcccaccctaagaacctccttttaacttgattactctgcaaagaccctccttccaaataagatcactctcagccaagcactttgggaggccgaggtgggtggatcacgaagtcaggagttcaagaccagcctggccaagatggtgaaaccccgtctctactaaaaatacgaaaattagctgggcgtgttggtgggcacctgtaatcccagctactcgggaggctgaggcagagaattgcttgaacccgggaggcggaggttgcagtgagctgagattgcgccactgcactccagcctgggcgacagagcaagactctccttctaaaaaaaaaaaaatcactctcacaggtgctcagggttaggacttaagcatatcttttaggggacacagttcaacccagaacactcaactgtgtggcacaacaggtgtgttcggctctcttgtccctggacagacacatagccatgggacagaccatttaactagagggccccatgggttccaggaagggcagggcagcagaaagtaggccacttgatgacttcgggtttgcacagtctcaggttgggctttgactctgagctgtcttaggcagcccagacctggggactctcggtcttattcatgtccacgccacagcactgcagccatacctgctggcttctatcctgactccccatcgtgaagaaaaatgaccacattcctaaacctcttccctgggagacaactcctaatcagaagcttgaaaggctcagggctgcttctcctaccccagggatcaaacatgtcctcaccatattctaaagacacattctttccccgcaagcaccccgcctccttctccccactgactcctgttcctgagcccagaacctctccctcttgccagcatattctcggcctttgcagatgagcttttgtggcctaaagaccttcttcttcaaccatctctgagttacggctccaagccaggcacccaggattctcatttcatttgtttcactaccaggagtccacttgaggacttgttgttgttgttgttgtttgagacagagtctcgcgctatcacctaggctggagttcagtggcgtgatctctgctcactgcaacctccgcctcccgggttcaagcaattctcttgcctcaccctcccaagtagctgggattacaggtgtgtgccaccacgccccgctgatttttgtattttatttatgtatttatttatttgcgacagagtcttactctgttgccaaggctggagtgcagcggcactgtgtgggctcactacaacctctgtctcctgggttcaagcaattctcctgcctcagcctcccaagcagttgggattacaggcgtccaccaccatgcccagctagtttttttatttttagtagagacagggtttcaccatgttggccaggctggtctcgaactcctgacctcaggtgatccacccgcctcagcctcccaaagtgctgagattacaggcgggagccaccacgcccagcctaatttttgtattttaatagagatggggttttaccgtgttggccaggctggtctcaaactcctgacctcaagtgagccacctcgtctggccaagtttttttgttgaggctttgttgctaaaacactaaagacctaggctatggtgagaaagataagggaaccataaatgaaattacattaaaacaaagtgtgaaattgtttgttttgagttgtggatgttgtttgggggtgtttgtatgtgttttttgctgaggagcgggagctgtgttaagtttgagccataactgcatctttgatctttgttatttcagaaaaaataaaactctagaaaatgaagtaagggagactagtttaacaaagaaacccataaactcaagtgttgataaaatgttgtttcatcttttggtgtgagcttgtgtgttgccaatgtcttccattccccagtaaggctgtggggaaataattgctatttccccaattgctagttggcctagcaattctctttttatgtcaggaacccattatgttacatttctgccatttgtcatttttctccagaataagtgtgtttgattctcccatctctcttggacagtatttttccagcttttggtgagttttcacatgctctccaagtaggtcatataagtccaattataccttaatcactgtagttaggactcaggtcctactcagggatacatccttagcattattaatgcatacccttaaatcctttattacctactccctaacaagaattcctccagatcttatatacggggcctgcagggcaggacacaggcctatggtaattacttccaatgtatcgggcattgtgctaagcactttgcatgggtggtcacagcacctctggagccaagtgttgtcccataagggccacaaggcttcaagaggacggagcctaccccttggtcactgaggggtggccctggtctgcaaggctacagaactgccttgccaccctgtggcactgcctctcatttcatagctggcacatgtcattttgccacccccatcacatgtcatgctggcatcaacccagggaggtgggtagtatttttgttgaagagctgcaagaactctgcccagagaagtcgacaacctgctcaagttgtgcagctaataactacaaaagccaagactcaactcagatctgttgactctcagtattaccccaacctttatgccccaaaccaaaggatgcccttttcatttcagtcacgggtaaaatgaactttggcccattccgaaagatgataccagctatttgaacagacaggtacttgaggataatgaggtaattttttctaataagtaaagataattgtttgggtattaaaagctatgattttgtcataattctttttagtccaagtataatagagccagctctttcctaattctctaatggaatggcatttctaccccttacccaccccccaatccaaggcctctttcttctttgtgaattgctaaatacagttctgggctagtgggcagtggttcaaaacccatcgtttgaccctgcttgaacaatcaaaaacagatccagtgtcctaagataaaaccactatacaaagcaaacattccctctcagtggctcctcggtaatgacccagcaagtattgtctgtttcccgtgcctctcactatagccatcagggaccacttctactaataatcagaggtctgcggctattcaaaatgcataaaataaaaatgttaaagcttaggtgacagcttggacaaacgtgggcatctgaaaggaaatgtctggcttgctgacgttgctccttcagggatcacaccgtagatggtgtgcatacccaggtgcggagcagcacactcattattcccccaggaaagtgttgaaggcgcgttccactcaggaagaagattgtgcttggttgatgacaactttctgtccttcccttcctcacctttctagcctgtctcacctcctaggaaaccgtgtgaaaccaaaggtgaacattatatgccaaaaaacatcagaattggagctctccttgctccctcttcccaagacttctctgtagtgccttcactgtggttagaataagggcatgactcattcttttggatgtcactaaatagaactaattaaaatagattttttgtcccagtgaaattgatccggctgttgagtcttttgtttaaagattattggaatgaaggatttgatacttttccccccattcttttttctcacttggaaactttatcatatttctgagctttggcaagattcattcaaatgaacacacaataaagtctggcaaatttcctgaagaattcaaggactcccttacttctttattgtactgtgcaaagttacgttgagtacggaatcagattcactccagtcctgctacaaatgtttgttatttacaaaagaattgctttttcttgaattacatacacagaaataagttcaggaaagaaattagtttctttcctaaactggctttagggcatctacagacaaatggttaaagaaaatgtggtatgtatagagagtggaatactacttagccattaaaaaagaatgaaataatgtcatttacagcagcatggatggaagtggaagttattatgtgaaataagctgggcacggaaagactaatgctgcatgttctcactctcatgtggaagctaaaaagcttaccctcatagacagaataaatggtagataccagaggctgggaaggatgggtggctgggaggaggttatgaagaaaggttggttatgggtacaaacatacagttagacgaagaaataagctctaatgtttgatagcaaactaggatgactatactcagcaacaatattttgtatacttcaaagtaacaggaagagagtggggtgtacttgaaatgataccaacatacagtagtaatgataaatactcaagataatggacaccccaggtaccctgacttgatcactacacattccaggcacataataaacactcatatataccccataagaatataaaatattaggccaggtgtggtggctcatgcttctaatctcagcagtttgggagtccgagtgggtggatcacttgagcccaggaattcgagaccagcctgggaaacatggcaaaaccctgtccctactaaaaatagaaaaattagccaggcgtcatggcacgcacctgtaatctcagctactcaggaggctgaggcaggcaaatctcttgaacccaggaggtggaggctgcagtgagctgagatcatgccactgcactctagcctgggtgacagagcaagactcggtctcaaaaatatatataatgtatcaatacaagggaaaaatgggcagaaattttcaatgatatttaataaccataaattaatcttgagttgggttgctgcctgccagcccttctgtgaacatgatttgttcagtcccaagtcacaaaccacagggttacaaagtaccctgggagggtgcctgagctctgtggttttagtcttgaaactttatcttttcacaaagcaattcaaaaattgctcatcaccattgtgttccgagaaaaggggcgccaaggcatcaccctgagccatccgaggagtgctgtgtgccttcttcctttctgcttccaagtaggatggaagctccagctttatacttaaataatcctcatcaacatctaaaagatagtgataattaaatctctcctatctaactaaaatggaatgttttaaagcttaggtaacaattctgaaattcttaattccccccaaaacaaactttttctgagcacattttgatttcttattcccatgccagaatagactgttttgtatatggtatcttccaagatattttcccactgagttaacttctgaaattgcttcttccaacgcataagcaataaacaacagattcgtttttacattctcaccttagctattgcatctctgattgttttcatctataatgagactttctatactttggccagtccttctgtttttcttaaaatgtgggaccacaggccaggcacggtagctcgcatctgtaatcccagcaatttgggaggccgaggcaggcggatcacctgaggtcaggagttcaagaccagcctggccaacatggtgaaaccccatctctactaaaaatacaaaaattagtcgggcatggtggcgggtacctgtaatcccagctacttgggaagctgaaccctgagaattgcttggacccaggaggcgaaggttgcagtgagctgatatcgcatcgctgcactccagtgtgggcaacagagcaagactccatctcaaaaaaaaaaaaaaaaagtgggaccacatactctaagcacctttagacaaaaccacaggatacaaatgtaatgtggctaatcagctggtcttccaccacccacctctggagcatggaaggccttgtccagccttgccttgccaagccaagggtcatctctagtccactgagcccaccctctaccctagcacccctcctgtcccaagagtcattgaccctcaggtcaagggataccagagccactacagtgaggctggccgtgtctctgaaatattttctttttttttttttgcccttctctcttcctcggcgctgcctatggaggtggcagccatctcctcctcggcatcttggccgccctcagaccccttgtgaagcccaagatcgtcaaaaagagaaccaagaagttcatccggcaccagtcagaccattatgtcaaaattaagcgtaactggtggaaacccagaggcattgacaacagggttcgtagaagattcagggtccagatcttgatgcccaacactggttatgggagcaacaaaaaaacaaagcacatgctgcccagtggcttccggaagttcctggtccacaacgtcaaggagctggaagtgctgctgatgtgcaacaatcgtacttgtgccgagatcgctcacaatgtttcctccaagaaccgcaaagccatcgtggaaagagctgcccaactggccatcacagtcaccaaccccagtgccaggctgtgcagcgaagaaaatgagtagacagctcgtgtgcacattttctgtttaaataaatgtaaaaacagccatctggcatcttcctttaaaaaaaaagaaaagaaagaaatattttctttcttttctttttttttttttttttgagacgcagtctcgctctgtcacccaggctgaagtgcagtggcacgatctcggctcactgcaagctccgcctcccgggttcacgccattctcctgcctcaacctccagagtagctgggactacaggcacctgccaccacgcccagctaatttttttgtatttttttaatagacacggggtttcaccgtgttagacaggatggtcttgatctcctgacctcgtgatccacccgtgagccaccgcgcctggcctgaaatattttatttttgttcatctttgttgtgcttataatactcctgttttctgtttattcccctgacttgaaccagatgttaggggagtatttgaagctcctcgttccctctcttcatcaatatcttctgtctagaaactaaccaagcaccttatctggctccagacctctcagtgatctgtgggaggccaactcgcaggatttcagcagagtttgcactttctaggcctaaaagataagtccttccatgtgtaagttcagattaaaggcaacatattgcatttacattttagagaggtgaacacattattttctgggacttaagtgttgttttgtttcttttttttttttttaatgtagtttatttctctttctaagagattacaggattcaagaatggcaatgaatcttaatagcctttgggagaaagcagcaaagctttaatactaagttccaggaccatgaacttccatgttgtcctaaatgcatttttcaaacattgctttctgtgcctactctataaaacctaaaaatccaaggtgacagtattccttatctaaaatcctaaacaaggctgggcgtggtggttcatacctgtaatcccagcactttgggaggacaaggcaggcggatcacttgagcccaggagttcaagaccagcctggccaacgtggtgaaacctcgtctttactaaaaatacaaaaattagccgggcatggtggtgcacacttgtaatcccagctactccggaggctgtggcgggaggattgcttgaacccgggagacggaggttgcagtgagccgagatctcgccactacactccagcctgggcgacaaagtgagactctgtctcaaaaaattaaaaaaaaatttttttaaatcctaaatattctcattccacaggatcctgcaaactgtagatcccaaacttggaagttctgggaattctgccagtatccccaagtaaatctcttgggaagtttagaatgctgcatggcgtagctgtgcctgctcttatagagtggtgcagactctgcttctccacgtctgctaagtaaaatattccaaacacagatcagccttatctagcgaaccatcactctgctcttgaattttcttttggcctcaaactctagagctataacatgttaacggtttaacaccagaggagaaagctattcttaaactactcaaacatggtttttttttctatttttcagactcctgaaacagactactctttgcctttttgctgcagttggagaagaaactgaatttgaaaaatgtctgttatgcaatgctggagacatggtgaaataggccaaagatttcttcttcgttcaagatgaattctgttcacagtggagtatggtgttcggcaaaaggacctccaccaagactgaaagaaactaatttatttctgtttctgtggagtttccattatttctactgcttacactttagaatgtttattttatggggactaagggattaggagtgtgaactaaaaggtaacattttccactctcaagttttctactttgtctttgaactgaaaataaacatggatctagaaaaccaaccagcaagttttcagtgccagataaaactctgcgctctagaggtaactcctcatgggaggcagctaggagtgttacctgacaccagtttcctagaaaactgtgacaagcaaagcaataacacacgtcgagaaatatctgatcaagcgggaaatcttctgactgtcggggatctctagtaagatctcttggaatgaagtgcactgtgtatccaaaactattttccagcgccagtgaagttgctcttacctaaaacaaatgggtttatgctagtttccaccaaggaatgagtctcgatggccattaaactttctaaggcccacagggctaggaaaagtcgctcttaaaggtcaggtgtttggaaaatgtttttccttttgcccaacccttaattagtagtagagaatgttctgtggcctattcccctctctgggagttcctgacccttctttgttttccagtttttcctacaataatataaaattacgtaaaagttaaaacaaaaccaaggattcaggaagaaacaagcagtgattgtcctctaggcagcgtaaggaaaatagtcaccataaatatcttagatgccccccaggcacatcctgcaggatcttttctgcatcctcttgtcctacaccctccagtgaccctgctcagccattgctcagcccataatgcacctttatgcacaatttgtcccaaaacactgtttagtaactcaaaagcctcccactcaaaagctgtctgtcccaagaataatttcacttggcaattctgaagtgtccttccccatccctgccctttatttgggagtacacctctccaaatatacagttaactgatgttttactgtttatttggagaggtgtactcccaaataaagggcataccctctccctttacagtaaatttgtaaacccttataatcttccaatagatttatacattgaaaaccctatatattccactcagaaagctgtctttttttttttttttttttttttttttttaagataggggctcactctgttgcctaggtggagtgcagtggtacaatcatggcccactacagccttgacctcccaggctcaggtgaagcccccacctcagcctcctgagaagctgggactataggcacgcaccaccccacccagctaatttttgtattttggtagggacagggtttcaccatgttacccaggctggtctcaaagtccgggactcaagcgatccgcccgcctcagcctcccatagtgctgcgattagaggcgtgagccaccgtgcctggccgtgaattgatttttaagcagttgtcttctgctactcatgtttttattcttttcctctgcattgaaaggttaagtttctatttttgaaaacattttttaaataaatattttaggagtctccattcaaaaagctttagcctagggactcctttccttacctacttttaccagacaactcctcaactcaaaatgtaagtaaacatcctgcacaccagtgtgggagagttttccactgctcactttggaaggactatcatccaggtgctgctggaaaccgcaaactgtttcccatcatgtaggctcattcgaagtcctctgggtgtcataactcgggctctgatggagttgtttttgctcattcactaccctactgatggtagagtgtatttgactccagctgagtgatatgcagtctccactaagaagaaacgttaattaatgggctcatcaactcctgatgacttgaggcattcatagagaaaaagaagtattattatggggagtactgggaggagccagttatcaaccatcttttctgaggccacagcatgagaaaagaaaaatcacataacctttggcatggtgggtttcagttagaaatcttcccaagaagagtggatattgatttctttctgcctttaattgaaatgtaaaaaacgaataggccagagatggtgagtggctccaattacccactgtggcacagaaatgtgtgatcatgccccctctctgcttgaggactggcagtagtgacacctgccaaggtgaagtcccagaccagaagaatcctctgtgaaagctgcctgaagaacacactataggaattaactggagaagagatgcataggaacttcggaaaacatcagcaaggcaatgagccaacccattcattcgtattttttttttttgtctttttttttttttttttccgagaccgagtcttgctctgtcgcccaggctggaatgcagtggtatgatctcggctcactgcaacctccacctcccaggttcaaatgattctcctgcctcagcctccgaagtagctgggattataggcatgcaccaccacacccagctaatgtttgcatttttagtagagactaggtttcgccatgttggccaggctggtctcaaactcctggcctcaagccatccacctgccttggcctcccaaagtgctgggattacaggcgtgagccaccactcccagcctcattaatattctttttattcctctattgtcaaggttattttgtttaactagagtgtgtatgtttaatacacttaaagctataaggagtatttttcacaatagatatttaaagagaatcctagttccctcccatctgagagtagccacggtttcgtttgtttaactacaatgtgcccagcctgtttttaatcataatttacacatgcccacaaataagattgtggcatgtgtaaattatgataatttaccgtatatattcccagaaaatccacatactacatatttgtagattgctttttcataaatgtgttcgcacaagggaataaaaattcagtaacaagtgcattctttttttttttttttttttttgaggagtctcgctctgtcgccaggctggagtgcaatggtgggatctcggctcactgtaacctccacctcccgagttcaagcaattctctgcctcagcctcctgagtagctgggattacaggtgcctgccaccatgcccggctaatttttatatttttagtagagacgggttttcaccatcttggccaggctggtcttgaactcctgatctcgtgatccacccacctcagcctcccaaagtgctgggattacaggcatgagccaccacacctggccaacaagtgcattcttacagcatttgttacaaacctataatccatatcctctgaaaaagtcaagcattatgacaaaaccactggtcaatcaacagatcttcatgtagcaccgtaaactctaatgcagccagagacagacccaaaactctaacagcgacttcagaacagcagaatggactagaattcaggggtctgaatttgagggaaaaaatgtaacatctttatggctataatgtagcatttccttccctatgagtgtcagcaacaaaacacagcactatcgacagtgctgtgtcttttttgtttgttttgagataggggtctcattctgttgcccagactggagcgcagtggcacaatcacagctcactgcagcctccacctcccaggctcaagcaatcctcccacctcagcttccccagtagctgggaccacaggcacaccaccacacacagctaattttttattttttgtagatacaaagtcttgccacgttgtccaggctggtttcgaactcctgggctcaagtgatcatcccacttcagcctcccaaagtgttgggattacaagcatgagccaccgtgtgtggcttttttttcttccctagccactagacctccagggaaacagtagctatgtctttgtcgtagatattttaatattacatgacagtttctacaaatacagtagcatttatgcttctcactgcatcaaaattatagtagttattagatctcccactgtctttgtatccatgtaaataaagaggcacctacattgctataaccaaatgtggtaccttttctatactttaataattgcatttcaggctgggcacggtggctcatgcctgtaatcaaggcgggtggatcacttgaggttaggggttcgagaccagcctggccaacatggtgaaatccaatctttactaaaaatacaaaaattagccgggcgtggtggcacacacctgtagttccaactactcgggaggttgaggcaggagaatcgcttgagccagggaggcggaggtggcagtgagccaagatcatgccattgcactccagctgtgcaacaagagcaaaactccatctcaaagaaaaaaacaagcattttactatcattggtttgttttataatcataagtgttttcatttaagcatttaaaaaatattattctaagaagggggtccatgggcttcaccactttgtccatgggcatccaaggcacataaaaggttagaatcccctggactagatgagatgctaacagcctaggtcctggttctgtggcagcattacctggtctccgatgttgctacctctacatctgcgcctcagtctatccctacaggtcccctgatccagggtgcctagtgtgcctataatagagtcttggtatgtatgtaatggtaacacaggcagcggctgtcaccaaagtttctccagcctgattcagaggatacacaagaagctctggacgctggagtgcctaagccttggttagcaactccacccccgagccagcccctgagctcccaccccaccctgatctaaggccaggcttctgcacatggttttagatgctgcccagcaatggagttctcacctgacctggttcctccccgtagctcacacagggccacagcttgcatattggtggtcagatgccattgctcacggtagatgggacagagctgaatagccagtgtccattcctgaaaggctagagtccaactacttggcaactgtgggtggaatgctgcctacgagagcaccatgtcctaaacatgcatgtacataaccatggagtcagtggattgtccagggaactgcaattgataagtgctgggccttcctaaaggtcttggtaaaacagttggtttctaggacaaaaggcatatcatgaaccacaaaggatggggaaaatacttcacgaattggagtaggaccatatagttaagccttcaatatgagtaagaaagaatgaatttcttttattattattatctttttttttttgagatggagtctctgtcacccaggctggagtgcagtggcgcgatcttgggtcactgcaacctctgcctcccaggttcaagtgattctcctgcctcagcctcccgagtagctgggattacaggcatgtgccaccacacccggctaattttcatatttttagtagagacggggttttaccatgttggtcaggctggtctcgaactcctgacttccggtgatctgccttcctcggcctcccagagtgctgggattacaggcatgagccactgcacctggccaaagaatgaaattcttaactgcaccaccctcctgtgatctcagccttgtcaatgtaggtcatcaccttaggtattttttattgttcttttttggggggtgttgggggaccaggtctcactttgtcactcaggctggagtgcagtggcataatcttgactcactgcaacctccgccatccagactcaagtgatcctcccacttcagccccctgagtagctgggactacaggcaggcaccatcacacctggctagttttttatattttttgtagagacagggttttgccatgctgccgaggctggtctcgaaatcctcagcccaagcaatcctccacctctgcctcccaaagtgctgggattacaggcatgagccaccacacccagccaccctaggtattttaatccttattcttttgtgctacttaagctctgggatagcaacctccccaggtccaaagtgtggccacctaacttaggtgctttcctgtgtccgaggctgtaggtgccctgtttcaactacaatggacagttttcatgaggcagcacccgtaactggccacatccagcgtattcaagttaagcaaaaccacaggaggcaggtgcccatagaaatcctctctgggcaattaatagcaggtccccaggcatttagggtagcttttactcataggttttagaattgcaactttaaaaaaaaaaaaaaagtcccaggagctggacatggtggcacgtgcctgtagtcccagctactctggagctgaagcaggaggatcgcttgtggccaggagttcaaggctgcagtgaactgtgattgtgccattgcactccagcctgggtaacagagcaagaccctgtgtcttaaaacaaatcaaaaacaaacaaaccaacaaaaaactggccctgggatcatcttcattagaatcacccgagagagttgtttacaaaatgcagcttcctgtctccatttagatctaatcaattggactctctggcgataatcctgggaatctgtgttttaacaaattcacaaggtcattctgcatactgaagtttaggagttaacctaaactccacttttgtatcaccatttgcctagcacaatgctaaacacatgggaggtgctagagaaatcctcctggaaaggatgaagagatgttgagagctgtcaactttccggcccagtgtgccccacccactgcgtatttatgcaccgcatcccaacccccccccccattaacgccccttcaattccttgtattcctttggagacaagtcgtttaaattttttctcatggcatttcgcccctacctttctcagctaaggctttgctaggctcccaagctccccaactttaattcttacgccagctcagcaaccacagtcctcttaggaaggtgcaattggcagcagaggagggaagtgtcatctgagctcagaagctcccattccaggatcttgtctaacaatcctttaagagttgagtgcctcccaggccaggcatcacactaggctcagtggatgaagaaagatgaacaagtttgggaaggggtgcttctaaaatggtctcagaacccactgagaggatcagtgggtgggggtcggagggggtggcggtgagactgggctggcaggagctcctgcaagcagcctgaggccagccctgggggatggcttttcacctgcctgccagaggccttgtatccacgctttgattcttttttttttttttttttttttttttgagatggagtctcactctgtcaccagactggagtgcagtggtgcaatcttggctcactgcaacctccgcctcccgggttcaagcgattcccctgcctcagcctccagagtagctaggattacaggtgcaccaccagcatgcccagctaatttttgtatttttagtagtgacgggttttcaccatgttggccaggatggtctcgatctcttgaccttgtgatccgcccgcctcctcctcccaaagtgctgggattacaggcgtgagtcaccgcattcagccgattcattttataaaatcacaagcagtggttaggcttctcttctccttagcgccctaggtttgcattttagtctcctgaaatgctttaaaaatacaaactttccgatacattattaactatatttcatcccaggattaaaaggagactccagacaggtttgtgcctgtgcccctctgttttggtgtggcgggcctccgaggagggcagtgtaattgcagagactgagtttgaggttagagtgtttatgtaagaaatcagctcaacttaaatatttcttgtggtgcggtcagggctgcaaacattcgcccagcacagcagcatgaatgtcatctgtttattcaaccctgtgtgggcatcgatgtttatgtgaaaggaccctgatcgtttaaagccagttaatattttcaatcatacatcgtgttgcttacgcatcttacaatcgggattgtgaagagacaagttttccaaaaaatcagactggttgcatttgtatatgtgcttatgagcagacacatttaatgaatgttcatttggcaaagtcttacaattaaggatttttttcttccagagataattacatgagccctgataattttcctctaagtcagcctctgattacctccccgcttgatagagacaacatgtaccagacaaacagcggagacagactccctgaaagaactgcaagcgctctctggggttcagaacaagccaactatatgagaagtgatactttccaacttcatgtcttcatggagttggacaccaaaggattttggggaccaggggaaagtaaatggtgaatagcttccctactcctcccaagacattttagattgtggcttcattacttagtttgaaatttaaattcccggaatatcggacacccccaaactcaaatgtgagtacagaaatgcattccaaagccaaatgtaaattctttttaaattattcattcacctagctccccattagaacagataattgaagtagctataaatatgcataaacagaagtgacagaaacagaaacatccacatcaaattacagatggacagaaaaatccacttaagcgctaaataattagggaggagagaagccaaggaaggcgggaggcgatagctccggagtgatgggcgagttgggactattctgcaaacagccagagagatgggagccaatttggaggggagggaggggacctggctgagaggaaggggcttggcgagggctgaggggcaaagcttgtatagggaaagataaatccgtggtgggttctggtttctgacaagtctgaactcagagaggcaaaagtgacagatggaaccctggtcaacatgaaaaaaagaaagcacgctacagatgagatggtgggagtcttctgggaaccaacaatcagagcacagggaagtgacatcacatctgcagcttcccaccccagggctgggccccttcgcttctctgcggatgagcagggggtcaaaatgttcttagaagcaactctcctgtagtggatggcaatttgggaataagaatatgctaactggaggtgggcagatcacccgaggtcaggagtttgagactagcctggccaacatggtgaaaccctgtctctactaaaaatataaaaattagctgggcatggtggcacacacctgtaatcccagctactcaggaggctgagacatatttatagaatctcttgaacctgggaggcagaggttgcagtgagctgagatcacaccaccgcactccagcctgggggacaaagggagactctgtctcaaaaaaaaaaaaaaaaaaaaaagaatatgctaattggcaaatggtttgaggttcccctatttaaaaaaaaataggggttcaaagcagctatttagaacccagaaggttttaagggttaaggaatatgatgttctcccaggcccccccagtccttatttgccaccgcagtgtgttccctttcaattgctcaaaggtaaccgacaaaaagaaactctatggaaaccctaatgaagtcagcaaagcaacctgagaatgaaagtccaatactggctgcaatattgatcattcctaagttaacgtacctaagttactcatgaaaagttcagctcttagcataatttttttttcttttgagacagtctctattgcctaagctggaatgcagtggtgcgatcatggctcactgcagcttcgaccttcctgggctcaggtgatccttcccactgagcctcctgagtagctgggactacaggcatgcactaccatgcccagttacaatttttaaaattgtttgtagagatgggatttcactatgttgcccagggtggtcccaaactcctgaactaaagcgatcctcccaaccttggcctcccaaagtgctgggattgcaggcatgagccaccgtcccagcctcttagcagagtttgaaatgggagcagagatttgagcacgtgtcccccgtatgtacagacatctggtggcggctggcagcttctgttccaagcccaggtcagctgcctggtgaggactgagagtggagactagattcttcaaaaagccatctaaatgaaggctcacagcaatcagataacagtagcaacaggaagtaagccagtcaagatgggcatccagttatttaacatctgattctaacagtgaacattgactgaaagattaacatttgccagggactatcccaatcatcttgcacagattcttttatttaatcctacaacaaccttagaaagtaggtacgtagttgctttttaaaattttccttccccattttgtaattaaggaaacagagactcaacaaggtaagggaacatgccccagatgccaccatccacaagtgacggctgggactcagcctggtccgcctgactgcagagccatgcgcaatgcactgagcacttctgcctgaatccagtgggggctgtccaggttgggatgaagctgtatgcagaggaatgaaagctttgagaggctctgagggttcttggactagagccaaccaagctgtatggtgggaattcgaaagctcaaagagtgaagaagccacttctgtagcaggtgatttgggaagagtaagtaaagaaacatagagtctgcatacccctgagtggggatgacagtactaacccagacagactgcctggaacctccagattgtgtccaacatgtgtaagaagacagggactttaacatggagcttgtgtcctctcatacatgagcaccagccttgtcacacgggggcttacctccatgtcaccatggggcaagtgtcctgggaggccagcctcccctcagcctcacagtgaccaatggacccacaccaggcactggcatgcagtgagcctaccccacacaccccacctagaaaccacagccccaatgctggtcctagaactgaggcgtgggatcaaagcagaaaaatcagtcaactttaaaattgctaatattgccatccagacattttttttaggagaatcttgtttaaaaatctggcagaggccaggcgcagtggctcatgtctgtaatcccagcactttgggaggccaagacaggtggatcacttgaggccaggagttcaagaccagcctggccaacagggtaaaaccctgtgtctactaaaaatacaaaaattagccaagtgtggtgacgcattcctgtaatcctaactactggggaggctaaggcatgagaatcacttgagccctggaggcggaagttggttgcagtgagccgagattacatcactgcactccagcctgggcagcagagcaagaccctgtctcaaaaaaataaatgaataaataaaaattaaaatgtggtggtattatgaaatcatctctgagttattacatctgagagatgaatagatgtcttatggggtgtgtgattcaaattatgacacttttaagcacttgccctatgtatgatactgagcctggttctaggagtaaggactcctcgctgcaggcagataagcacacaacttccatggaatgcagaatggtgattcctcctgtctttgtttccacagtttatagagcaccacgatgtggcagaccctgcacccagccctgagaatgcaaagatgatgggcgaggtgtctgctctcaggaggttcactattgagtaggcaaaagagcgtcataggacccaagacagaggtggaggcagggaggtagcagaagggaggagcctggagcagagtcagaaaaagcttctcaaaggaagtgatgctgcagaaatgtgcaagaaccagactggagggtgagggaggtggtggatggagagaccgtgaccatgtggattagggaaagattcacacagctgggttcaatcgacactgggacgctaggtaaatcaccaccttccttcttcgtgatggagtgtagtatagaataatggatcagagttcaggttgaatcctggctctaaccttcactagctgtgtgacattgggcaaaatacttaacctctctgggccttatttgccttatctgtacaatggggataacaacagcaccagcctcacagcgttgttatgaaggaagaactttgtgaataaagtgctcagtactgggtttcagatatggtactcattgagtgttagtatcatcattatcatgattactaatagtagtgttatttatattcctgcttagcagcctttaggagctgctcaataattctttcatgggatgaatgagttcaccaattcattatcaacatggacattaccgttgcccaagatggcagcaggaaacagcacaaagagaacccatgagccaggtgccattaaggaaagtgaaactttgtcctgaggttggtagaaaatggcaatgaaggatgggtatggtcacttcacatttgctgaaacaggcccagggttcaatagtaatgcagaattaacaatctataaagtgaaaggaataaggttttttccttaaagacttgttccacctgcttgaatgcagttgagacttgcaagcccaaggggctgaatccaacaagctccaaagtcttcaaggtggggagaagggagttgggtggtgaaaccgagcccagaaagctgtaaaaacttcctgcctggtctgggggtctccaccaaaagctcccaggagctatgagtacaggcgtgagccaaggcctcggtgggcaggacacccccatgcgcacaatgattgtgaggaaaaacccatggcggctcccacagaggccccaccctgcggactcgaagcccaacatgagggccaggcctgggctccgtggaacactgatgagcatggcgccctgcctgagggcaccctgactctagaacaatctcttcctctttctccacccaaggtgcccttagaaaagagttggagagaaaactcattccctggggtactttattaagaaattgaatccagtgtaactctattattcatttgcttaggatgcttctgttttaacgggaccccgtagcagtcactctagggcagaggggaggtcatcaggccggccaggagagcaatgtcaaagtcacagccattcccccacggcccacaccaccagcctccctcctcagagagacactcccacccaggcactgaccctgccgtggtgcaagcagaaaaaggtgtattgaacttagcaaaaagaacagccaggcgcggtggctcacgcctgtaatcccagcactttgggaggccgaggcaggcggatcacgaggtcaggagatcgagaccatcctggctaacacagtgaaacctcgtctctactaaaagtacaaaaaattagccgggtgtggtggcgggcgcctgtagtcccagctactcgggaggctgaggcaggagaatggcgtgaacccgggaggcggagcttgcagtgagccaagatgacgccactgcactccagcttgggcgacagagcgagactccatctcaaaaacaacaacaacaacaacaacaacaacaacaacaaagctctgacgaggtgttccagaggaaacgaggaatgtgaggcacctttcgccttcctggtttggccaagacttctcttagtcgccttcagagtgaaactcagggttttcataacagctttgctctctcaaaccctagaccacctgcaactctgaactatgtctcctctgatccactggtggccaaggagtaaattccgacagaagctggtgtttctgctgctccaaacccccaaccccaaattggcatctggaagtgccccttcccgcggctctctctgcccagcaccgtgccctccctcagccgggcccctggcctcccaagcataaaggtcccatgccagacccagcacctccgtatagacactgctcatggcagaggtggccagctcttccagcctgtgtttcaaacatcaccccaagaatgcagagactctgatccttggaatgcaagcacaaattcactctcattaggctgaatttgtattatggttttcacaattcaagtgtttcttgcgtttgtgttataaaattaaaaatatattgtcaagaatatcattatcagctgagcacagtgggccacgcctgtagttctagctactcaggagactgagctgggaggatcacttgagcccaggaattcgaggctgcagtgagctatgatgacgacgtctgtgaataaccactgcactccagcctgagcaacatagtgagatcctgttgcttaaaaaaaagtaagtaaaataatacaataaaataagaatatcattgtcattctcaaccacaaatggaatcatttatttggatttcaattgtatcaatgaagtttacttcatacaattgcagtctagctccttttttaaaagctctttatttccatagcaaaaaaaaatgtgtaaaaagttaaatatagaattaccatatgacccagcaattctactcctaggtatataccccaaagaattgaaaacagggactcaaacagacacttgaacactcgcgttcatagcaacattactcacagtagccaaaagctagaaacaactcaggtgtccctcaacagatgaatggataaaccaaacgggggacagatagacaatgggtaaaattctgacatgtattacaatgtagatgggccttgaaaacatgctcagtgaaataagccagatacaaatggacaaatagaatatgattccacttacataaaacgtctataatttaggcaaatgaatagagataaaaaggagattgaaagttatcagagggggctaatggggagttattgcttaaagggtacagagtttctgtttagggagatgaaaaggttttgggattacatggtggtgatggctatgcaatgtcatgaatgtatttaaatactttgggttgggccgggacggaggctcacgcctgtaatcccagtgctttgggaggccaaggtgggtggatcgcttgaggtcgggagttcaagaccagccgggccaacatggtgaaaccacgtatctattaaaaatacaaaaattaaccaggtgtggtggcaggtgcctgtaatcccagctactagggaggctgaggcagaattgcttgaacctgggaggcagaggttgcagtgcgctgaatcgtgccactgcactcctacctgggcaacggaacaaaactccatctcaaaaaaaagaaaaatactttgagtcgtacatttaaaaatggttaaaacaagctgagcatggtggcatgtgcctgtacttccagctacacaggaggctgaggcaggagggtgtcttgagcccaggagtttgatgctacagtgtgctatgattatgccactgcactctagcctgggtgacagagtgagaccctgtctctaaaaataaataaacaaataaataaataatgttttaaactggttaaaacagtgcattttatgttacatatatttttgctcaaaaattgaaaaaataaggatttttgttagtatttcaatttttggctactagaatgattaacatttttattggctatgtttaaaggcattataatatcatttattttcaacatactgccccaaatttgaacatctttcaaacgtagctgggcaatggcagactggctagaattgccctttttggggagagcagattcagaaggagtgagggtagagcctcaacagcctggccttctagccaactctctgcttcctgcccatacaacctcagtcacttatcctcacgatgccttggtttccatgtcatataataataattgtggccgggtgcagtggctcatgcctgtaatcccagcactttgggcagcaaagatgggaggatcacttgagcccaggagttcaaaaccagcctgggcaacaaagcaagacactatttctgcaaaaaaataaaaaaattagctggacgtggtagcacacacctgcggtcccagttactcaggaggctgaaatgggaggatcatgtgagcccaggaatttgaggctacagtgagctatgaccacgccactgcactccaacctgaatgaaagggggagaccctgtcttcttaataataatagtaatagtaataataatatagttttatagggttaccatgaacatattaataaaatgtgttacaaatgtaatgtgtttaatacagtgcctggcaggtattaagtgcttatagttaagctattcttaatattattattacagaatttagtttttttagtgagtgattgggattttttttttttttttagatggagtctccctctgtcacccaggctggagtgaagtggcatgatctcggctcattgcaacctccacttcccaggttcaagggattctcctgcctcagcctcccaagtagctgggattacaggtacgtgccaccacgcccagctaatttttgtatttttagtagagacagggtttcaccatattggccaggctggtctcgaactcctgacctcaagtgatccacctgtctcggcctcccaaagtgctgggattacaggtatgaaccaccgctcctggcctgatttaacagagaaaaaatgattaagaagcactgataattccaaaggaaagaactatagggaatggcttaaaggcctacaaggaaactctgtactgggaagtgagaaagagcatgaggctctcctgaatataccccagtggcatgttgaaggtgtcaggtctgagatgaaatcattctgcgagagaagagtgtgctgagcatagaaacagtctctccacatgaacagacctctcagcctgtgcagcttctgcttcccaggagctcagcccgtggcagaagttttcctgatgcaaagatttcactttcactattaggctgtcactatgccctgacagcttcccaggtgtgagttacagctactggtttgaggttattttttttttttctctacgtatcgtataggactcggcccattcctgtgaagagagcacatttcttgcttcccttagtcactacattggtgtcaatgtcagacactctgtattagggaccaaggttcctgaagaatcctggaaaaatggggtgggggtggagaaggcagtggctgggagtgagaatacatgctctaaggccaagagtccaagaggacacggacgtcctctccagccaggccctggtcagaccaaggacacatccaggggtggagagtggaagaccaagagctccccatgagccaaaaatgaataaattgtttctaagtaaaagtgataaaaaatgatgtgatgatacactgatcattgaaggcgaagaggagaacttaggagatttttaagtcataactatatgctaggacaccctggaaattaattttccaattcaaaatattttaattctggtataaacgttcatgaattattatttactgggtacagagtttcagttggaaaggatggaaaaagttctggagatggatggtggtgacggtcacacaacagtgtaaatgagcttaatgccactgaactgtgcacttaaaaatggttaaaatggtaagttttatgttgcatatattttgccatattacagttttgggtctcgttctcttggcctgggctcaaatgacccttccgcctcagcctcctgagtagctgggaccgcaggtgtgcaccaccttgcccagctaatttttaaaattttttgtagagatggggtcttattatgttgcccaagctggtctcgaactcctgggtttaaatgatcctcgcaccttggcctcccaaagtgctgggattacagatgggagccaccgcaccttgccaaaaaaaaaaaatgtttttaagtacattcgttagcacacctacaaaacttttgactcatctgacacaaatttgtcacttcattcttaaccatattatctctgctgcttaagtgagccctggttctgacgacctgaattctactcaaactagttatgcgaccttgaataagtcatctcacctttcgctaatctttgtatttttagtagaaacagggtttcaccatgtaggccaggctggtgtcgaactcctgacctcaagtgatccacccacctcagcctcccaaagtgatgggattacaggcatgagccaccacgcctggcctacaaaatgaaacttttgaaaaaaaaaaaaaaaaagtctgttaccatcttttgcagttctgatattctaggtttaataacaactgccatttatgagagcttacaggctctctgctgcacatcttataagcattacctcattcactactcttgaggaggccatgagggtggtgtgattaccctcatctgagagagagactgagccttacagagatccagggacttgtccttgaccagtgagcaagtgggtggagtgggctatggactctggactggaggagccccgagcccgtgctctcagccgctgctcagccctgcagcaggaagaacatctgaagcaaactacaaagaacttttctccctgaaaaagcgattagcccataatagaagacctaagtccagcaaaaagagccgccgtttctgctgcactttgtttcctactgggtgacggatggcgctgtcatctcttcagggagggaggcttacagacaggccagctcgtcagcctgctggctccttcaaagtcaggtcttcacagtaggttcctttatttctgtctcaacaagttgaaatcccctcaaattagacacacacttttcttatgtaattaaagtacagtgagaagacaggcatcattttagattgtgctgactcctatttctcatcattaatacaatcaagagttgactctcctgcgcttccagaccttgaagcagacatcagctaactctcaggatgcaatgaaggttcactgaccttcaaatattctctaagtctgtttttaaccactattcgttctgtctctctaagccacggcaaaaatcagggctctgcccagtgaccgtcagccagagaagcaggaagaaatgcaagaagaggcagcaagagtacaattgagccttggctgcccatggggtatttaccttccttgactaaaattgttgaaaatcaacctagatattgataacaacaacaataaaaccaccttagaacattcgtacaatgacattatgtggccattaagaatgaaggagatcgctaatggaataaatcattgtctaaatcaatgacagagctttgcaacttgaagccaaatagagcaatcatcttgcagagatagagatggatttgaaaataatattaggtctttaaacaaggagcatccaatgccacaactaacaacctgggaaaataatggcgtaggactcaataggggagtagctcaagtgcaaataacagaaatctaaacccaagctcacctttccgctcaatgccacattggctaaagctccttaccagaactcacagaggtggaactgatagttgtaatcagaactccactgactagcattcgtatcattatgtatttatgcataagatacacacacgcacatgcacacatgtatagccttcattttctcatcaggattcaaatattcactctcttttttccctataaattccaattttttttttttgagacggagtcttgctctgtcgcccaggctagagtgcagtggtgccatcttagctcactgcaacctctgccttccgggttcaagagatcctcctgcctcagcttcctgagtaggtgggattacaggcacgtgccaccatgcctggctaatttctgtatttctggtagagacagggttgcacaatgttggccgggctggtcttgaacacctaacctcaagtgattcacccacattggcctcccaaagtgctgggattacaggcgtgagccaccacgcccggccaaaatccaaaatttgaaaggccttttgctggtaacgttaaacgtagatttctgcattggatactatctattgataacgaagatctgttacctggagtgggtaaaaccaggtaagtaacactgtatcggttagctattactgcaggacaaattactccaaaccttggtgacttacagcagcaacagtcacttattatttttcatagtttctgtagatcagaaatttggagaggcccagagggagaacagttttatttctgcgccacaatgtctgggggctcagctggaagtctgacaggtgggaactggaatcctctgaaggctcattccctcacttgtctgaccactgatgccatctgtcaactgagagactaatagggttgttggttggaacactcacatatggcttctccatgtggtctggtggctgggatccaagggcaagcatccaaagatggagagagccagacagaagctgtatccttgttatgacctaacctggaggtcacccagcactgtttccaccaaacttcactgaccaagctgatcacaagcctctactcagttttaaagggaaggaacatcaacccacatctttgtgggatgaacatcaatcacaccctaagaagagcacatagatggggatacatctataggtaagaccttctttggaaaatacaaccttcccatacagaaagctgccttctgtagggatgtccatgatgcaataagttataaacaagagtcttaggtggatcctaacagatgaatggaagaatatttggtttctggtaacgtggtgggagacgagattagaaaggtatgtaaggggccaggagcagtggcttaggcctgtgatcccagcaatttgggaggccaaggtggggggatcgcacaagctcagcttgggcaacatggcaaggccctgtctttaccaaaaattaaaaaattagctgggcatggtagcatgctcctatagtcctagctacttgggaggctgaggcagaaggattgcttgagcccaggagtttgaggctacagtgagctataatcataccactgccctccagcctgggcggcagagccagacccggtctctaaaaaaagaaaaagaaaaatattacgatatgaatgtggatcatgaaaaaaaaaatttaagaaaagaaaaatacggtagcaccaggtttcagaaagtccagaatgacacattagaagtgtgggctttattccgggggcactagcgatccataaaagtgtttctagcaaagattgcctcatggccctagagaaaatggattagagaaaggagaaccaagagtcagggaaaccaattgggagttatttaaagtggtctaggtgagggccgggtgccgtggctcgtgcctctaataccaacagtttgggaggccgaggtggacggatcatttgaggccaggagtttgagaccagcctggccaacatggcaaaacctcatctctactaaaaatacaaaaatcagccaggcgcggtggctcacacctgttatcccagcactttgggaggctgaggtgggcggattacgaggtcaggagatcgagaccatcctggctaacatggtgaaaccccgtctctactaaaaattaaaaaaaaattagctgggcatgctggtgggcacctgtagtcccagctactagggaggctgaggcaggagaatggcgtgaacccgagaggtggagcttgaagggagccaagatcgcaccactgcactccagcctgggcaacagagcaagactctgtctcaaaaaaaaaaaaaaaatttaaaaatagaaaacagtttataaaataaggagttaaagatagaaaatgtttttgtacagctgtacagtgtgttcatattttaaactaagcgttactacaaaagggtcaagaagttaaaaaaattaaaagtttatagaggccaactctgggcatgctgcctatgggttagccctgctctgcaaggagcagtaccagaaaaaaaaaaaaagtttatagagttaaaaaggtacagtaaggtaaggttaatttattgcaaaagaaagaaaatatttttaataaacttattgcggcctaagtgtacagtgtttatgaagtctccggtagtgtacggtcacgtcctaggccctcacattcactccccactcatcactgactcacccaggcaacttccagtcctgcaagctccattcatggtgagtgccatgtacaggtggaccatattttaccttttttttttttttttgagatggcgtttcactcctcttgcccaggctggagtaccgtggtgcaatcccggctcactgcaacctccacctcccgagttcaagtgattctcctgcctcagcctcctaggtagctgggattacaggtgtgcaccaccacacccggctaatttttgtatttttagtagagatggggtttcacaatgttagccaggctggtcttgaactcctgacctcaggtgatctgtccatctcggcctcccgaaatgctgggattactggtgtgagccaccatgcctggccttattttaccttttatattgtatttttactgtaccttttctatgtttagatacacaagtacttaccattgtgttccgattgcctacagtattcagttcagtcacacgctgtgtaggtgtgtagcctaggagcaatagactatactgtatagcctaggtgtttagtaggttatactgtctgggattgtgtaagtacatcctacggtgtttgcacagaaatgcctagcgatgtgtttctccgaacatatccctgtcattaagtgatatatgattgtatagttttgtatctgtaaccgtacacatacagtataaagcagtttgccttaaaattacacttacttaacacatggctatacaattttataaagcattgattttgcttataaaccccacaagcggtcgggcgtggtggctcacgcctgtaatcccagcactttgggaggccaaggcaggcagatcacaaggtcaggaaatcgagaccatcctggctaacatggtgaaaccctgcctctactaaaaatacaaaaaattagccgggcatggtggcgggcacctgtaatcccagctactcgggaggctgaggcaggagaatggagtgaacccgggaggtggagcttacagtgagctgagattgcaccactgcactccagcctgggcgaagggcaagactccgtctcaaataaataaataaataaataaaaataaaccccacaaacttcctccttcagcttcttcttcgactggttttgagtatattgcttgaatatattactttggtccctctgtttttcttttctgactgacttaacccttagcataagccaaaatcactgagcaaattatatccctggttctctagaaaacttgattgatagttgaactatgattcaagagttctaaatattgatgggaggagaaggcagaaagtcgcaggcatctctaagaatctgatgaaaattcacagctagtatggcactctcaggtgagatttttgtctcattaaatgggaaatagctttggggtactggcttgagtcaccagggtcatatgaatcagctgtaaattgtcacctggattaggtcagaggggtcataggtatccctggcccttgaaataagggctctgtctgacttagggcagtcacccatctctttgaacttcagtttctcaaaatgagaatgacaatgatgaaaactgccctctggaagcagtgtcctgaggtgctagccatccgtttggaaatcagtattcccttgtgtgcacaatcaaaacaagtgtaacctgtctgttccactgactcttcagaggttgcttttaccactaggacttgtagtttagtttaccgttgaattgctttatttaaactctaatctagttatataaacacacttcagcacaatttataggcttgcgattctttctatcatggctggctcttttttttcttcctgaaacaaactcttgagtctagactttgtcaggttgatacatgagtttggggactgtttatacggaaaccatatacacattccagaaacctgccttgttactgatctgcaataaagatgataagcctttgactcataaaaagacacccacgatatcctttgaagtgcaaaccctgatctactactgaaaaggggcacaaagagattcctcaaaactggccttgttgctttaagaagaggtgactattaacgagagagcaactctatgggcgagaactttctcatgatacaaactgttagcaatgcaaggggctggggaatctgtaaatagtgattttcctcctgggggaagttcttaagcaagactgattgaccatcctcaagaaacagtatgaaagggattcaatcaatcagtggcaaagaagatggatttgtaggtacctttcaattcaaatatcctgtcttcgatttctctaataagcctaggaagacaggattgtgctaatgactcagtcctaaacaatagatccttgtaaacagtggatgtggccaccctaccattggtgacgtagggcaagtggtgggggtatatgtgtggtaatccactgggtgttttaggccaagtgtgtagtccaaagaacacatttctaaacttttaaaacacagacaaattatactcaataaatcaatgttcagtgactgtttcttgccagtgcagaaaaaaacaaacatagaaatggccaaagtttactttgccaatctgtcgtagactacagactattaggagggggatctcagtaaaggtcaggcctaaagcaatgaggagagaaggggagctcttggtccttcagagaggaccgatgtcacagagtgatgacagtcagactagtaccaatgcgcatgagaagcaaatcagttcctgaagctcggtgctatatattcatcacaaataaacctgaaatgcattacctggtctcttctgaatctcatatggatcagtatctaaagagcaataaagttcaggagctgtatcttctaatacaaatgactatatgactatagatatagttatagatagacatagatatagatctaaggatatatgtatgtatattattttggccaacaatttcttctctttcaactaccagaaagtaaaaatacagagatgaaacagtagtgcttttgttacttctttctgggtttttttgttgttatcatttttcttttcttttgtttttttgagacagggtctcactttgtcacccaggccagagtgcagtggcatgatcacgactcactgcagccttgacctccctgggctcaagcaatcctcccacctcagcctcctgagtagctgggactacaggtgtacgccaccatgcccagctgatttttgtattgtttttgtagagacaaggccttgccatgttgcccacgctggtcttgaattcctggactcaagcaatccacctgccttggcctcccaaaatgctgggattacaggtgtcagccactgctcctagccttcttactacctcctgtgtactgatgactcacatcctactgtggaatagatatactgcttttgccttcctagcattgaatcctctttgtctagaaatgacaccttagttttcctttggggaacctcatcactctacgcttgagtgattctggtgggacaaacgccatcgctggctccggatatgagctagtaacctaggtatgctgatatggtttggctgtgtccccacccaaatctcatcctgaattgcaatccccttaatccccatatgttgaggaaaggacctggtgggaggtgagtggatcatgggggcagtttcctcatgctgttctcatcagactgggtgagttctcatgaaatctaatagttttataaccatctggcatttcccctgcttgctcctctctctcgcttgctgccatgtaagatgtgcctgcttccccttctgccatgattgtaagtttcctgaggtgtccccagccatgccaaactgagtcaattaaatctctcttctttataaattacccagtctcaggcatttcttgatagcagtgtgaaaatgaactaatacagtaaattggtaccaggcatagggtactgtataaagatacttgaaaatgtggaagcaactttggaactgggtaacaggcagagggtggaatagtttggagggctcagaagaagaaggaagatgtgggaaagtttattgcttcctagagacttgttgaatggttttgatcaaaatgctgatagtgatatgaacaatgaagtccaggctgaggtggtctcagaaggagatgaggaacttgttgggaaatggagcaaaggtcactcttgctatactttgcaaagagatgtgttagataggagttctaaatttcttttcaaagaatcaatgtcagtatgttcaattctttgcattctacttttaaacttaactaccttgtaaggcaaccttttttgattacctgctccaccctgactcatttcaatcacctgctccaccctgattcattcagattacctgctctgtcataaccatttttcccaccaaaccactcacccgtcactctctttaaattagccaatcagaatcagtttagcctgtgcggtctaaccctagccaataggggaacgacacagcagcaggggccacgtgggtcagggataagaaccccttcccctcccttgtccaagtgtgcgctcatcattgcttcatctgtaaggacacacccctctatagaagtaacttgccttgctgagaattaaaaagaaaattttatatttgagtggtatttcttttgtggcacttttatttataacagatgggtggcattttgcccctgccctagagatctgtgaaactttgaacttgagagagatgatttaagatatctggcggaagaaatttctaggtagcaaagcatttaagatgtgatctgggtgctcttacaatcattcagttatatgcattcgcaaagagatggtttgaatttagaacttgcgtttaaaagggaggcagagcatcaaagtttagaaaatgttcagcctgataatgcaatagaaaagaaaaactcattttctagaaagaaattcaagccagctgcagaaatttgcataagtaacaaggagccaaatgttaatcaccaagacaatggggaaaatgtctccagggcatgtcagaggtcttcacagcagcccctcccattgcaggcccagaggcctagcaggaggaaaaaacaaacaaacaaacaaacaaaccagggccttgctgctttgtgcagtctggagacttggtgccctgcatcccagctgtgactaaaaggagctgatgtacagtgcagaccattgcttcaaagggtgcaagccccaagccttggcagcttccacatggtgttggtcctgtgggtgcacagaagacaagaatcgacgtttggaaacctccacccagatttcagaggatacatggaagtgcctggatgacccggcagaggtgtgctgcaggagcggaaccttcatgaataacctttgctagggcagtgcagaagggaaaaggggggttggagcccccagactgagtccccactggggcactgcctagtgaaggtgtgagaagagggccactgtcctccacaccccagaatagtaggtccgctgatagtttgcaccatgtgtcaggcctctgagcccaagctaagccatcatatcccctgtgacctgcacatatacatccagatggcctgaagcaactgaagatccacaaaggaagtgaaaatagccttaactgatgacattccaccattgtgatttgtttctgccccaccctaactgatcaatgtactttgtaatctcccccacccttaagaaggttctttgtaattctccccacccttgagaatgtactttgtgagatccacccctgcccgcaaaacattgctcctaactccaccgcctatcccaaaacctatatgaactaatgataatcccaccaccctttgctgactctcttttcggacttagcccgcctgcacccaggtgaaataaacagccttgttgctcacacaaagcctgtttggtagtctcttcactcggacgccatgtgcctggaaaagccacagacactgaacaccagccatgaaagcagccagggtgggaggctgccttctgcaaagccacaggggtggagatgcccaaggccatgggagcccacctttgcatcagcatgacctggatgtgagacatggaatcaaaggagattattttggcgctaagatttaatgatttccctgctgcattttggacttgcacggggcctgtagtccctttgttctggccaatttctctcatcgggaatgggagcatttattcaatgcctgtacccccattgcatctaggaagtaactaacttgcttttgattttacaggctcctaggtggaagggacttgccttgtctcaaatgagattttggacttggacttttgggtgaatgctggagtgacttaagactttgggggactgttgggaaggcatgattgtgttttgaaatgtgaggacatgagatttgggaggggccagggaatgatatggtttgcctgtgttcccacccaaatctcatcttgaattgcaatcttcataatccccacatgtcaagggagggggacccagtgggaggtgattgaatcatgggggctgtttcccccatgctgttctcatcgtagtgagtgagttctcgtgagtctgatggttttataagtgtctggcatcatccctgcttgctcttctctctcacttgccgcttgccgccattgtaacatgagccggcttcccctttcactatgattgtaagtttcctgaggcctctcaagccatgccgaactgtgaatcaaacctctttcctttataaattactcagtcttgggcagttctttatagcattgtgaaaatgaactaatacatatgccaatggtttatggatggaaatgtaacccaaattaggctggtggaagccaatcctaggacttttctggggatagcaggaggttttggagaaacaaagtactagttcttcaactcaagttgctgagttagtaggaagtaagcctggacctactacggtaccacctagagagagatgtcttgagaatgaagccgacaaaaaagaaaggatagtgaatgatgaagaaaggaaccacgtcctgatgacatttgttaagcccctggattcagtgatgactcaagccaaaccattccccaaactcttcagtctgagccaatagaaacacttttttatgttacacccatttgcgttaaatttctgtcatttgctctctcaagtgacaagaaatcaaagcaaaagccaagctgtgatggcacattataaagaacccaatcctaatccatatagtggcacatgcaaggggtctggctgggctgccttgaatagacccagtgagaacagctcaacttagtgacacttttgagacctaatcatgtcttaaacctgtattgtctagacttcggagataaattttttttttttaatatgatttgtgttccaatggggaaggctcataagtcattaggagtttagactgtgtagtgattttggaaatctaagtgctcctgcgggtgactcccagtgcgttcttggagattagcattttataaggagcaccaagacatctttaaatagttttgtccattttaacttgacttttttgcatgtgttgaagtaaagcagatttgcaaggtctcaagggaattaggttggggcctgcgctcaccatttcttcatcctttgctagctcatgtgtaatgggaattctatgttctcaattcatgatgaagtgtgagatgcttaagaaaattatcttatgctaagtctaagggaactggttggccatactgaacatttgtaagtttgtttcctctgaaggactgtggagtttccaaattcactttactaagtatgcatatttaatttgcatccaattagataaagcagctgggcagaaactacagcccctatattaatgcactcatttgggcatcagactgggagctttatatgcaggcatcatccagatgaatgcatttaaattgttctaatttacaaattgaagcaaagtctctgcagtttgaaatcttggcaatgcttccattacaacatattttctgaagcattcagaattatagtgctgatgcagtctcactttctagaagcatgctttttaagcaggagaatgatgtgatcagtttcccattatagggaagatcattttgatgctaaccagaggagggcctagaagagagcaggtggccgggcgtggtggctcatgcgtataatcccagcactttgggaggccgaggcgggcagatcacctgaggtcaggagttcgagaccagcctggccaacatggtgaaaccccatctctacaaaaatacgaaaattagctgggcatgatggcaggtgcctgtaatcccagctactcagggtgctgaggcgggagagtctcttgaacccgggaggcagaggttgcagtgagttgagatcatgccactgcactccagcctgggcgacagagcaagactccatctaaaaaaaaaaaaaaaaaaaaaaaaaaaaagaccgcttgtgggcaggaaggcaacttttatgataagctggccaagaaatgaccaggaggtgatccaagacagtgtcagacagtttccaaggcacattagtagggtgcctgtggtggatagaatcgtgcctttccccacaaaaggtatgaccacccagaacctgtgaatgtgaacttatttggataaaggtctttgcagatgcaatgaaggatctcaacattagatcatccctggattaaccaggtcagacttgagtccaatgatagatgtccttataagacacagaaggggagaagacacagagacacacgcaaagaagaagccaggaaaggatggaggcagagattggagtgatgcagccacaagccaaggaatgcctggagccaccagcagcagaagaggcaagtgtggattctctgctagaacatttggaggaaacttagccatgtccacaagctccatttcagacttctggcctccaggtctatgagaaaatgcattcttgctatttgaagcctgatatggtttgtctgtgtcctcaccaagatctcatcttgaatcgcagctcccataattctcacatgttgtgagagggatctggtgggagataattgaatcatgggggtggtttcccccagactgttctcatggtagtgaataagtctcatgagatctgacggttttataaggggaaaccccttttgcttggctctcattccctctttgcgggctgccgtgtaagatgtgcctttcgccttccgccataactgtgaggcctccccagtcacgtggaagtatgagtccattaaacctctttcctttataaattacccagtcgcaggtaggcctttatcagcagcatgaaaaatggacgaatacaaagccactaaatgtgttgcttaaattcctgttgcagcagccagaggaaactcagatggcccctgccaagaggcactcccagcaatcacgttttgttttttctcatctcaccacctgttttagggactaaagatgaccaccttaaagcaaatatgccttcttctataaagaattactctaagctaaagctcctcccactgacctagaagaagaaagcaatacaacttttagggggtgcggggagaatagctttaataaaaatgcctctcttggccaggcatgatggctcacacctataaccccagcactctgggaggctgacgtgggtggattgcttgagcccaggagtttgacaccagcctgggcaacatggcaaaaacctcatctctataaaaaaatacaaaaaaattgctggatgttgtggcacatacctatagtcccagctacttgggaggctgaggcgggaggatcacctgagctggggagatcaagactgcagtgagctgtgatcacaccactgcactccagcctgagcaataaaggaagaccctcgtctcaataataataataataattaataataaataaaaagaaaaatgcctctcccctttaggagcaggaaggatgggaatgcagagattaggaaagacagggagatggtggttctgagttacatgtagaacacaaaattaactagactaggtcagtgtatcaagacgcttggctacaagacacagaaagctcattttaaacaggccgaaacaacaaaggaaactgattggcttacgtatttgaaaagacccaaggaagggctgatgtgatccagcagctcaggcctgaagaccctgcttccctccacgtctctgccctgccttgcaccatatagggggtagttctaactgtgggtatgagattgcccacaagactatagactggaaagaaaaagggtgaaaccacgagaaacaccagcatggaattatagatagaggtagacgaatcagcaaaggaaactaggataaaccaggcgtgtgtctccgaggcgaagaaaggaagggttccagaagaagggaatggttagcaaaggcaaatgccactgggagtccagtaagagaaccacagcaaatgttcgttgggtttggtagtttggtgtttactgatgaccttggcagtagccggttgctgaagcaatgaagacagaagacagatcatatgggatgcagactgcatggaaggggctagagggacagagcatttatgaactgagaaataagccagggagagacagagagagagactgaaagagtaaggccttgggaggagctggaaaggccacttgagaataacagaagggaaggattaaccttgaataggaaaaatgtctcttcctcccagtccctgagaccggagagaaattgtaaggatgatgtggatgtaaacaagttggcccaggtgtggtggctcacgcctgtaatcccagcactctgggaggccaagacaggtggatcacttgaggtcaggagttcaagaccagcctagccaacatggtgaaaccccatctctactaaaaatacaaaaattagccaggcgtggtggcccatgcctgtagtcccagttactctggaggctgaggtgggaggatcgcttgaactcaggagatggaggctgcagtgagccaagatcgcaccaccatactccagcctgagtgacagaataagactccacctcagaaaaaaaagttagggagtgtgcttatgggtaagtgtaagaggacactgtgggaaattgagagaattcacaaccaatggtctctattttcacccactgaataagaatgtattcgtttcctgtggctgcagtaaaaaaatagcacaaacacactgggtggcttaaaacaagacacttatcctctcacagttctaaaggctcaaagacagaaatcagggctatgcaccctttgcaaccagcaagggagagtcagtccttcctcgtctctttcagcctctggcggcctcaggcattccttggcttgtggctgcatcactccaatacctgcctccttctcatatgaccacctatcctctgtgtctctctgtcttctcttcttttaaattgaccagtctttctttcttttcttttttctttttcttttttttttttgagatggagtcttactctgttccccgggctggagtgcaatggcgagatctcagctcactacaatctctgcctccctggttcaagcgattctcctgcctcagcctcctgagtagctgggattacaggcccctgccatcatgcccggctaatttttgtatttttagtagagacagggttttgccatattggccaggcaggtctccaactcctgacctcaggcgatctgcctgccttggcctcccccaaaagttgacatgcttaaatgctaatcccaggacttgtgaatgtgactttttatggagacaaagttttggagatataatcaagttaacataaggtcattagggtgactggtgtccttataaaaagggaaaaattggccggcgtggtggcttatgcctgtaatcccagcactttgggaggccgaggtgggtggatcacctgaggtcgggagttcgagaccagcctgaccaacatggagaaaccacgtctctactaaaaatacaaaattagctgggcatggtggtgcatgcctgtaatcccagctactcgggaggctgagggaggagaatcgcttgaacctggtaggtggaggttgcagtgagccgagattgtgccactgcactccagcctgggcaacaagagcgaaactccatctcaaaaaaaaaaaaaaaaaaaaaaaaaaaaaggaaaatttggaaacagacacgaagggaaaaaggaaaatttggaaacagacacgaagggaagaagtgaagagacacaaggagaagacggcctctacacaccttggagagaggctggagcagagctttcccttacagccctgagaagacaccgaccttgccagcagctggatttttggactcctagcctctagaactgtgagacaatacatttctgttgtttaagtcatctagtttgtttaaggctgccctcgcaaactaatacagggaccacagagccgtcctctgtctatccctgggattctcttactaacagggcgctgctgctcacagagttaaaagaattcactccaggctaaccattgatctggttctcacacttcaacgtttcctttcttccacctggcacataaagaatcgtttgccagcagccagcagtctaatcattaagcggctgggaagggagacatcaaagcagtaaacaacacacagaacagtgttacttgagcaatttgcctaagaaaccactttatcttctcggagagctagatgcataaattgtctgcagttgtctttggggagagttgacgaggtccgcaggggaggagttactggtatggccagtgagtgtactgaatactgattccaggaaaattaggaaaacacttctggtgtgtttgctcctgtaaccccggctgctgcaccaagcttctagtgtgttgtttttcttctattctctgaccccctcctctcaagtaagccatattttgtgcagatcttcggtctttggggaatgtgtctcttccattttctccctcccagccctgcccctcctctctttccgacctttgggtcctccacttcagctgagggaccctaaaaacttggctaccactttcccaaatctcaaaggaagataacagtgatggccattaaaatactgttcagctgggcatagtggctcctgcctgtaatcccagcactgtgggaggtccaggcgggtggatccattgaggccaggagttcgagaccagcctgggcaacatggcgaaaccccgtctctattaaaaatacaaacattagccaggcatggtggcccatgcttgtaatcccagcttctcacgaggctgaggcaggagaatcacttgaactcaggagacagaggttgcagtgagctgagatcctgccattgcactctagcctgggcggcagagtaagtgaaactctgtctcgaaaaaaaaaatactgttcaattacctctagaggaaagcaggaatagttaaaattggtattgctatgacaccagaaaacaaattttagactgacagatcacagcctagtgtctacttagactattatttttgcattgatttgtctacagttaacatcatacagaccatctaggagttactgcaaaattgataccagggaattaaaatacactttaaaatacaaagttctatataaattgtaaatcatctttcctagcggaggttgctcttctatatcagctttcttcctctgagcctctcatcatgtctcattaccttttgctgaatgcagcaggctgttcaatgctgttctcactgtcaacttttaagccgtgggtgccatgattatatagctgaaggagcttattttccggaagatttatgaaacctttgggagtcatctgctttgacagaaccctttgtggaatgagggaggggataaataaatatacagtcatgcatcacttaacctaaaaaatgcgttcagagaaatgcaacattagacaattttgtcattgtgtgaacatcatagagcaaacccacgcaaacctagatggaataaccggctacacacctaggctacaagcctgaacagcatgttactgcactgaatactgtaggcaactataacatggtggtaagatttaataagatttaatatctgtgtatgaaaacatagaaaaggtagagtgaaaatgtggtactataatcttctgaggccactgtcatacatgcagtctgttgttgaccaaaacattgttgtgtggcacatgactgtagagataaatgctaggatttcaggcccaaaggttttatatatatgtatacatacatatatgtatagacatgcaaaggttttatatatatgtgtacacatatataacctttgggttatatatacatatgtatgtatgtacatatacctttgtatataccccaaaggttatatatgtatatatgtgtatataaaacctttgtatgtctatacatatatataaaacctttgggccagaaatatacgcatatatatgtacacatatatacagatatctatctatcacagatagatagagatagagagagagagagatctgtatcatgtgtacacatttgaatacagaccagggctcaacaaactctttcagtaaatattttaggctttgcaagccacatatcgtctctgtggtatattcttcatttttattataatcttgtaaacgtaataaccaggccaggcatggtggctcaccccgtgctgtaatcccaacactttggaaagccaaggtttccaagtgttggaaggttccaagccaaggttccaagccaaggaggatctcttgagaccagaagtttgagaccaccctgagtaatatagtgagaccttgcctctaagaaaaaaatttttttttaaattacgcacctgtaatcccagctaacaggctgaggtgggagaatcacttgagttagggaagttgaggctgcagtgagcagtgagcatgccattgtactccaacctgggtgacacagtgagactgtctctaaaaaacataaacattaaaaatgaatacatgtagggctgggcgcggtggctcacgcctgtaatcccagcactttgggaggccgaggagggtggattgcctgaggttaggagtttgagaccaatctggccaacatgttgaaaccctgtctctactaaaaatacaaaaaaattagctgagtgtggtggcgtgcgcctgtaatcccagcaactcaggaggctgaggcaggggaattgcttgaaccagggaggtggaggttgcagtgagccgagatcaccccactgcactcattattttatttgaatttcaccacaagtttgttaattccttgtattatcctcatttaaaagctgaaaaagcccagacactttggtttacacctgtaatcccagcactttgggaggccaacgcaggaggatcacttgagcctgggagtttgagaccagcctgggcaacagagcaagattccatctctacaaaaaatttaaaaattggccgggcatggtggcatgtacctttagtcccagctactcaggaggctgaagcagaaggatcgcttgagcccaggaggctgaggctgcaatgagctgtgattgcaccactgcactccagcctgggcactctttctttaaatagccaggttgttgagtgatagcggagtgatcatgggtgaaataaaatggagtcccagctttgatcctttgtctttagtcactgtcatctcctcttcctcctttccttttcatggaactgatatttactgagtgactgtgacatgctgaggccctgtgcgaagctggagatccggtggagcgccacaggcacggtccagcctgcctgatggcgccccgttagctggcaggcaggcaggaagctagcaatcagagcaccgtgtgctcaggggtgtgacggggtgagcgcagggggccgagggggcaccaggcagcgcagccaacccaaacctggacaggcagaaaaggcttccatgagaagtattgtctgcattgaagggtcaacaatgaggagtgtcagctggggggagagctttgcagagcctcagacacccctgtttcaggaccccacagcgcagatctgcaggggcagggttttatccagcctctgcctcaggcagctcgtctcccaggctccggactcatgaaccacttcttaggggagtatgcaaaccaggagaaccagaggcccagatctgtagtacctgtgtggttggttatttagtgcatctctacctgcccagaagggcagaaacaagaggtttggagagcatgtgccttgttcacggctgcatccccagtgcctagaacagtgcctggctgagacaaaattccaattatttagagggtagaggaaacaggtggatgcacggtccttttcacactgaccattgctacttgcgggcagggagaccagggaggagcccagggcaaggaggcccccacacctaggagatttttgaagtcagaaacacaccctaaagatgctcatggcctctcatctgcctttctccaccagccctcacgttgtacttggtgaatacgctgctccgactttaaagtttcttcctaataagagagatctaggtttaattaaacccaagtaatagaaaacaagggcatttgggcacattcggctcacacaacaggattccctacttagcctgtccactaaagggagtttctactgtcaaagttattattgccctctgtgtgaaagaagaaatgtgtacaaagcactatgagttaattaataattgttgattgacagtgattggcatgtaatattggtgccccaaaagaaattttaaaaacaggtttctttaatctttgaaaaatgccacgtgaagagggtcttcattctcggtgttactctccccaccatgccagctccccctatattcctgttgatttgagggattgttcttaacagaaataagttgatttattcctgttgattacagggattcctgtaatccctgatgtattcctattggttttgtcccaagttcagtgccaaaattgctctggttgggagaaaacttgaaaatggccattatccaaacctaaagctgttcccagctggtcctaaggctacagatgtttctctacaacagcccaaatcacagagacaggggattggcctacacacggtgcttcagaggctcccctgaagccgacccaaggggagtctactctacatgcttgggaccctgcaggaaccagataaagatgtagtctttggaccatcgcatctagtggcagtaatatttattgagcacttactatgtgccgggcacagttactcatttaatactcacatgatccccaaggaagaagttaccatcatcatccccatattatagatgcaaaaactgaagcccagaaagattaagtcacttgtgaaaaatatggcagggcccagacttgctgccaggcaggcaggcagcagaggcggcatgcttagctgcaaggctatgttgcttttgtccaactcttgccttttttgctgttgtagccatttttgttttgccaacatacaaaaagagtttaatacatgaaagttatctaaagccattcagtctcttctttccctctagaagccaaagctggagagattccaatcacggcatcactgcgcatagacattctccttttaaatgcaaacacctttgataagagtaactcaggcctgaaaagagagctcccagaggaccaggaccttctttatctgcatgcccaggactaagcagggtatcgggtagtgggtgctcagtaagtatttcttgaatgaaccttggtgagtatttaatggtttcatgtaccttgttttatgagaacaaacttttgttgagtgattgctttagcctcctagtctgttaggctctaaatatagcaaagaatgtaatctagttcctgtcctaaaggagcttccggcctactgggagaagaaagagactagtaagcaaataattacagaaaaataaagccacagtgggtgtgtatagcattgccctatgggaacacggggcaggacagcctaagacaatctgggcgtgtgcgtgggaggattaaaggaatttccagtagtgcggggaggctggaatctacagtagtcccaggaatggccccaggaggagtgccttcagtggaggctgggaagggaaggaggccagatcacagagggtttgtatacagacagggtccaggtgggccaggccacgccctacattttggcatagctattaatagtctcccattactcactagagcatcccaatcaattatgcagacatcctatttatatttatgtaatatgtaccatatatatacatatatatatgtatatatatatagactaaggacttgaacttcatccaaccacttgcattgcaaatgtagaggaatgttaagataataagataggccaggcgcggtggttcatgcctgtaatcccagcactttgggaggccgaggccggtggatcacgaggtcaggagattgagaccattctggctaacatggtgaaacaccatctctactaaaaatacaaaaaattagccgggtgtggtggcgggcgcctgtagtcccagctactcgggaggctgaggcaggagaatggtgtgaacccgggaggcggagctgcagtgagccaagatcctgccactgcactccagcctgggcgataaaacgagactccatctcagaaaaaaaaaagatgataagatcaatagaatgtagatttgacctgggaagaggaggaataatcagagtccagttgtgcacatatgtaactgcccacacccggcttcaggggttctgcgtcagaatcacttggggtttcataaaatggacagtcaccctaactcagtcagactctctagaggagaagctgcggaaactgtagggttaacaagccacccagatcattttcatgcgctccaaagtatggaaaccacagactgaaacatcaccaagctaacaggtgcctgaatgaggtaggaggaggggggcatagcagctctgctccaatgctgtgtctgctgagggacaggcccgcaggccccacagagtctgctctgagtatccaggggcagaggaggacatctgctcctgggagtggggagagaaaataaagtaagaactataactaatcaccaggccaggcaaggtggctcatgcctgtaatgccagcactttgggagggcgaggtgggtggattgcttgaggccaggagttcaagaccaaccgggccaacatggtgaaaccctgtctctacgaaaaatacaaaaattagctgggcatgatggtgtgtgcctttagtcccagctacataggaggctgaggcaggagaatcccttgaaccgaggagatggaggttgcagtgagccatgattgtgccactgcactccagcctgggcaacagagtgagacactgtcccccctccaaaaaaacgaaacaaaaaaccacacacacacaaaaactaatcaccaccttcataaaagcatccagggctgccctcatattcaaggcttgtgcagagatagagaaagaacaggcagtagaggaaaggacggcaggaagaaggagccagcaaagccaggactctgctgggaacagagggcattgggctgtggggcaggaagttaaaatccaggagtgtcctacccgtgcaggatgtcccatcacattcttttcgtaaagggccccctgcgtcctgtgcaggctgtgaattgacatcagcccctgcctgacctccacccccagcaagcttgcagccaagctgcaaacagaattcatgtctcctgattcctaaaggttcattctgaaaaaagaaggaaataaagagagagaaaaagaaagagaaagaaagagagaggggctggatgtggtggctcatgcctgtaatcccagcactttgggaagctgaggtgggcagattgcttgagccaagtaggtcaaggctgcagtgagccgtaatcgtgccaccgtactccagtctgggtgacagattgagatcctgtctcaaaaaaaagaaaaggaaagacagaagaaaggaagaaaacagagaaagagagggaaaaatagagagagaagagagtagaaaagatagaaagaaaaggaaggaaggaaaagaaaaaggaagaaagaaagagagaaagaaaaaaggaccaaacttagaactgttgtgagtttgggcaggaaagagaaggccagctgagtcaccgtcatcaagcaacgacacttggaacatctcctggcatcagggttttcaggaaagggcccattttctaacctaccagcgagcacaaggaagatacctgttggcaggtagctttcatgtacactgacactttccaccgtgttcaaactatcagctaaacctgtcaatattttccttctcctcagctctccctctcctctttggccgcctatccttttttttttttttttttttttttttttttttttttgagatggagtcttgctctgtcacccaggctggagtgcagtggtgccatctcagctcactgcaagctctgcctcccgggttcacaccattctcctgcctcagcctcccgagtagctgggactacaggcacctgccaccacgcccagctaattttttgttttctctttttttttttagtagagacggggtttcaccatgttggccaggatggtctcgatctcctgacctcgtgatctgcccgcctcggcctcccaaagtgttgggattataggcgtgagccaccgcacctagcctgctcctatccttattgattgccacccttctcaagaccctctgtaaaatttctgcattccttctaaacacagagcccaaacagcaaaaaggatctaatcaacaacaaactccctgttcttatttgccagacttttaatattgttttaagacacagttaacttgcattcagtttacagctcactgttgcttatgttcacttcagagaagtctgtctttctcagcaatataaaaactgaaaacattcttccttaatttgtatctgggtagttttactcttaactcagttgagctgctttaggtcaaatggtatcccaaaatttcctaaagtatgtttctcagagcaggagtattagattatgttcctggcttagggatcaaattaggtggaagggaggtggtaatgcagacatctcttggagatttacaatgatggtagcatgtagaaggctgcgagaagtctgcatttttctaattaagtattgccctgcttactagcctactcctgacactgcaacctctagcatctctttctgacttcccgggagcaagggctttcctggtgctggaccaacatgtctccctaaatcctccacgtggcaaaatgatattcctcactatgttgctgatgacaagtttcagggttttttctttccccaaatgaaataaatgtctttgattgctttttattattattacaactatttttcatattactatatattatataatttattattatattatatattaataacaagcaatacagagcagcaaaagaatgtaaaacatctacgctctcaacaaaaaccaccgtcaacatttctttctagatttttcttttttttttttttgagacagagtctggctctatcgcccaggctggagtgcagtggcgctatctcagctcactgccagctccacctcccaggttcatgccattctcctgcctccgtctcccaagtagctgggactacaggcacccgccaccacgcctggctattttttgtatttttagtagacacggggtttcaccgtgttagccaggatggtctcaatctcctgacctcgtgatccgcccgcctcagcctcccaaagtgctgggattacaggcgtgagccaccgcgcccagccgttctttctagatttttctaggtataatgtgtaatacatgtgcttacgtatttttttatgagttcataccgtaatgtatttttttaacttatcagtgatttgaagctcaccataatgtatttttatacaagtaaattagtaacatctttccacatcgagagttccatttctgtaatgttattttaacagctacataggattgttttgtatgactgcagcataattaattaattgatcccctatggtgagacatgtggattgttttcagctttcctttattccaagcagaactgtgatgaacatttttagagttacagccttgcacgttttctcagttatttcctcagggtagattcccggaagtagaattacaatgttccttttgacatggtgctgagatcacgggtaagcaccaagtgtgtgcaggtaggtcccagtggtgggttaggaacaggcaggatcccctgttcccttctcacagggacggcacattcacgtgccccacaatgcttctgctagtctccttgacaaagtaccaccaacgtggtggcttcaaacaacagaaatttctcttagttctggaggccagaagtttgaaatcagactgggcatggtggcttatgcctgtaatcccagcactttgggcggccaaggccagtggatagcctgaagtcaggagtttgagaccagcctggccaacatggcaaaaccccatctctactaaaaatacaaaaaattagctgggcatggtggccagcgcctgtaattccagctactcaagaggctgaggcaggagaatcgcttgagcccaggaggcggaggttgcagtgagctgagattgggccactgcactccagcctgggcaacagagcgagactccatccaaaaaaaaaaaaagttagaaatcaaaggattggcagggccacactccctctgaaggctccacgggagaatcctacctcatctcttccagcttctggtggtcccaggcattccttggcttgtggctgcatcactccaatctctgcctctgtcttcacaagacttcctcctcttctctctcgatctgtgttttcttctcttctctctcttataaggactcttgtcattggatttacagcccaccacataagtcaggatgatctcagctcaagatctttaacttaattacatctgcaaagatcctttttccaaagaacatcaccttatgggctccagggattaaggcaaggcatgtctttgcaggggccaccatgaaacccattgagatgtgcttccaggctagaaagagtggccttcaaactggtacacacatgcatacatatgtgagcaggggacattcttaccaagtacaatcttatgtgacaccccaatatataaagggggtaagtggagctgtttggctgaggtggaatgcagggagagcagcatcactccatcaaggacacactggattgtaggggacgcaaggactccaagccctcgatgtctttcaaaggaggtcagagggagggccacattgtacttgctgtccttgggagaacgccccaaaccctccctctctggctctgcgccttggcccacacaggccccgtctctttgccaccacagagagaatcaggcacccagagaagttctgcacatgataagaaggacttgggtgagaatcacacggaggtcctgacttacagtttttttgaaaagcaaatcattcgcatatctcagcaaaagtcctcaaaggacattcctgagtttcagtgggaggaaaaatgagttgctttctgagccctctcagcacctttctggactggtgaatgttacaatatgctgtgttgctacaactttatctacaaactgggcccgagcgtccgacacagactgttcctgcactcacaaatgacggtgtattccagaagttcatttgtaggtgagttgtttgcatctcagaaagccttttccctctgtcgggggctagagatctcaatgtctattgattgttacagacagcaagacagagctcttgtagctggctggcctccaccgtgggcctcgcagagcccccagactcagagccctgggcaacactgggcttgaaagcagggctagaagggaagggcaaaatggggcacagggtctcccaggcactcagcagtcatgggcattgctgagggggtgccaaggacaagagggttgaggggcaagacggtcaccatgggggtggctgcagaaggccggagcaatctgtatgtcagataacttggtggggcaggcctgcctgtattgttgccatctggctaataaggatttgaaggctgtgaaagggaaggggttttgctgtaatcgtttcctagggctgctaggaaaaccaagtgccaccaactgagtggcttaaagcaacagaaatgtattctctcgcagttctggaggctgcaagtctgagatcaaggtgtcagcagagctgtgctctctctcccgccttctggttgttgccagcaatgcttggcgttcctggcctgcggctgcatgacacatttctctgcctccggtgctccatggccacctcccctctgcacgcctgtctccacatggccttctccctgtccatgtgtctcttctcataaggacaccagtcttactggatcctaatgaccctatcgtaatatgatcacatctgcaaagcacctatttccaaataaagttacatttacaggtactagaggttaggacttcaacctatctttttttggagaaacaatttaacccgtaacagaggcatataatctgtcatcccacctaaaataaaaatacaatctataatggccatgatgtgtagccacagagcctctgctaaatactgccagcaacaggcagggaatccattccatttttaggtagccccagtcatgagctacctcattccttaaaatggcccaaaatacgcttctccagactttcacctgttgaactgttttcctttattgaactacatagaataaatccaatcactcttgacaaaatcttttcaaatatgtgaagccctcccagccagcctccaaatattttcttaaagctaaaaattctccagatctttatatgattgacatgagggttttttgttttgttttttgttttgttttgtttgagacagagtctcgctctgttgcacaggctggagtgcagtggcacgatctcagctcactacaacctccgcctcccaggctcaagcgattcttgtgcctcagccactggagtagctggaattacaggtgtgagccaacaacacccagctaatttttgtatttctagtagagacagggttttgctatgttggccaggctgatctcgaactcctagcctcaagtgatctgcccgccttggcctcccaaagtgctgtgattacaggtgtgagccactgtgcccagccatggttttaagatctctcaggattctagtcactgaactctggacatggtcaatggtctaggcccatcctaagaagaggcttccatgactgaaagcctacaatgtagatatgatctgatggatgaagaaatcaatgggtgtatttatttctaggatttgagcattaccccactacagaaacctaaccttgtattgagatttctgttttggtttggttacagtttgggtttatccgcttgcttgttttgcagagggtcgcagagtttagtggcaaagctgggctgttgactcagattacgtttgcgtcagttaaaatctctgagctttttcataattcctcttaaatcacatcttccactcattacttgtgctgtttctttttgaacctcctgcatgttggttcctattaaatttcatcttactgctctttgtacttcaatgtaacagcacattccacctcttgcaaatgttggcatgtcattcctgcattagccatccaacccagctctggtaatctgcttccaacaggaaaaaacaaggaggaaagagaaccaatatctagaacatttattaagacgccagcaagctagacaattgttaattgacatctttttaattgacatcaacacacaaacagaaaagtgcacaaaaaaacatacaattcaatgaattctcacaaagcagatgcctgtgtagccacccatgtcaagaaagagaacattaggctgggaatgttttaataagcatttttctctttaaatcctcaagcctacttggtaattattattaaacctggtttacaagatgataaaacagattcagaaaggttaagtggcttgcctagctgactgccacagctgggagttgtaaagcacggaatgggccccatgtggtggctcattcctgtaatcccagcactttgggaggccaaggcgggtggatcacttgaggtcaggagttcgagaccagccaggccaacatggtaaaaccccatctttttttttttttttttttttttaaggcagagtctcactctgttgcccaggctggagtgcaatggcttgatctcggctcactgcaagctccgcctcctgggttcatgccattctcctgcctcagcctcctgagtagctgggactacagacgcctaccaccacgcctggctagttttttgtatttttagtagagatggggtttcaccgtgttagccaggatggtctcgatctcctgaccttgtgatccgcccacctgggcctcccaaagtgctgggattacaggtgtgagccactgcgctaggactgaaaccccatctctactaaaaatacaaaaattagctgggcatggtggcacacacctggtagtcccaggtacttgggaggctgaggcaggggaatcgcttgaacctgggaggcggagactgcagtgagctgagattgcaccactgcactccagcctgggcgatggagtaagaccctgtctcaaaaaaaaatctaatataccccataaaaatatagacctattatgtatccacaaaaacaaaaagaaaaagaaagaaggaacccaacatttgcctataagaacagaaactacgcttactacaagtcaacaaagaaaaaaaaccagtgtagtcctattacccccatgcttagcactgtctgaaatgtcctctccctccctcccatccttactttttttctgatcaacacctcttcatccccacttcagcattccttccgctgtgaagctttgggagactttctcaggttgagctaatcagctcctcttttgtgaccttctggtacttcctattcttctagttagagcagcggtctcatgaatagactcctatttcctgggttatctccctcacgaaagagttgtcttgaggggaggagtatggtttgttcatctttgtgcttccactggttaacaaagtacctggaaaaaaataggcattcaatgtgtgtgctgtggtattgttgaatgcggtagaggatggctgagagaatgcagagcctgagtgcagaagcggggctgcaggtgctgggggctgaaccagggcagcagtagtggggatggagatgcttaggacagctggtcctaaatcctggtcattattaaatcgccttaggaggctggggaggactttaaaatgcagatgctcaggctacttccagatgtactgactcagtctctagggaggggactccacatctgaattcattagaagtcctttagcagggccgggtgcggtggctcacacctgtaatcccagcattttgggaggctgagcgtgtggatcacctgaggtcaggagttcaagaccagtctggccaacatggtgaaaccccatctctacaaaaaatacaaaaattagccaggcatggtggcatgtgcctgtaatcccagctgctcgggaggctgaggcaggagaattgcttgaacccaggaggcggaggttgcagtgagccaacgtcacagctctgcactccagctatctcaagaaaaaaaaaaaagtctttcaggggattcggatcctcagacaagtttggaaaccactgacataggtagtgtcctgagtcaaacttggaggacacatggaaggcagggaaaggggggaaaagaaagaggagtctgggtcctaggtttgcccagcatggatgatgatgatggcattgacggagcgagtgctggaggagccttggggtgaagttgttctgcacgagctgagtgtgcggtgtccgcacatatcccgatgaagatggccttttggcaactgggagccaagccggggactcaggagagcaatctgtcatttaggaccttgagaatttgccgttttgctaggaaaaaggtcatcttcccatactcactctgtcctctagtttagcagaaagaggtaaaaattacttttactttctaactgattaagcctgacaatcagtagtgataatccagaaataagtacatttaattcatttatgacagtcctagagtttgcatagttacctgtttctcataaacaaatgctttaaaagaaattaaaagaaggatatttttgagaaaatatgcactttaaaaatggtcatgtttaaactccagtggatgttagtaattgacttgaaagtctgtttttacaaataaatcctggacccataaatggatatttgaccccctatagcataaaagggcaaaaacatgtctgtagaaacatctgacctaatcaattttcaaattaatctaaaattactatttgaattcaaatgtagtaaatgtcatgggtcctttccctggggcacagacataaacctgatctcctaaatgacataaaatagagaacggagcaatttctttggtgaatatgaataagcattggagcccatctggataatttacataaaaattggattttcgcccttgaattatctttttatagtggacatctctcatattgtctcctcagcctcctgttccccttgtcttcccctgtgagactcctgcagaaactgccctttttttaatttgtttatttttgagacagagcctcgctcagtcgcccaggctggagtgcagtgacgccatctcggctcactgcaacctccacctcctgggttcaagtgattctcctgcctcagcctcccgagtagctgggattacaggtatgcaccaccatgcctggctactttttgtatttttggtagagacagggtttcaccatgttgtccaggctggtctcaaattcctgacctcaagtgatccgcccgcctcatcctcccaaagtactgggattacaggcgtgagccactgtgcctggtcagaaactggcctgtttttatggtgctcccttcctctggtggaagttcactggtccaagatcaagctcgcctatccccatgggccaccagctctctccccaagggcatctgcctttgggatccagccttgaaggcaatccttttctagaactaagaactcccaggataaaacttgggaactgactacgttacctaccattaaaagaaatcctttcaaaagagaatgaagcccaaataagagaataagaaacatcctgacccactggcgcccctagttctagtagcttcggaagccaggctggaatgaggacctctcacagtcggatggttcattcttctttaggttctgtgatccaagaactcctttcagcctactctagagcaagatgggtttccagtctcctgaaactaggactgccaagaataataatgtaccatttcatacagattgactctccaactcaacctctgagatcctaactttcctcaaaaccaaacgaaaaggaatgagcggaagaagatgctctctcttaccggttgaattgtgtcccctccctgcaagagatatattaaaagttctggccctggtgcagtggctcacgcctataatcccggcactttgggagcccgaggtgggcagatcacttgagctcaggagttcaagaccagcctggccaacatagcgaaaccctgtctctaagaaaaacacaaaaattagctgggcgtggtggcgcacgcttgtaatcccagcgactcgggagtctgaggcaggagaatcgcttgaaccctggaggcggaggttgcagcaagctgtgatcacaccactgcactccagcctgggtggcagagcaagactctgcctcaaaaaaaaaaaaaaaaaaaaaaaaaaaaaaaaagaagaagaagaagagaagagacacagagacagagacagggaaacaagagagaagatgaccatgtggtgacaggtgcagagagtggagtgatacagctgcaagccgaaaaacatcaaggattgctggaaaacaccagaaactagaagaggcaaggaaaggtttttccctacaggtttcagagagaacatgggtaaaaccttgacttcagtcttctggcctccagagctctgagacaatgtgtttgtgttattttaagccacccagtttggcatacattatttggtagccctggcaaactagtagtttctaagatactttctatccctacattgtcctgctttggtgcttttatatggttgagaaggggccaaaggtaccaagttcttttccttgtgaagttcagatggatgccctgataaatggggcaagagggatgagggaggggattacagactgtgggattatagacttttagcctaaggctttgtatccaacagttgtcaaattgaggttacacactgagacttggttaggggggcacttcagacatacagcagaccctcaaaaaaggttgcttttctttatatcttatattaatacaaagaagagctgaaaaaataccttcaaaagctgtttgctgtgagctcaactgctgactccaccccccagcccagttccatgctgctcctgtccactccttcttttttttttttttttttttttggatttttgccaaagttccaggccaaagtttgtaaaagtcccctcttcaaggaacatttatttagaatgtcttgctacacgggaaaacacaaatctctcttggtttgtaccatgcggtcttaaccagagcaaaatctagttggtaaacaaaccaaaaaaaaaacccactttggcctccacagctgccaccccttacctccatctctcacacattttctagtatgtaaagaacttgtgactgtgaggacgagtagattttcacacagatagaaactgagagtacagccattcatcactctgtggacaaatcttcaaatccatgccttttcactcactggaatataagaagttaactgtattttcacaggataaatctggatgtttcagtaaatcttaagttgttcatgctaaccacgagtgtgtctgtcagtaatacatgaaatctccaaaagatttaggagcgacattgatgaaggtgtttatttttatttattttttttatttatatattttatttattattattttgagttaaattaaattaaattttcatagagtcttgctgtgttgcccaggctggtcctgttgtttctttttcccttccttccttcctttttctttctctctctctctttctttctttctttctttcttctctctctctttctttctttctctctttctctctttctttctttgtgtttctctctttctttctctttctttctttcttcttaagacagagtctcactctgttgcccaggctggagtgcaggctggagggctcactgcagcctctacctctgcaggatcaggcaatcctcctgcctcagcctcccaaatagctggggatatgtagatttggagtgggtatccacttcaggtaggaggaagaacaatattagcaaaggcagaggcaagaaagcaccctgcattttggagacaatagaatcaagcttttctgagtggaagggattttaacacattggttagtccagtgatttttcacatcatgttaaattgcataactctaaaagatgatttagagacaatatataaagcagacaaaagtggagctgatctgagtagatcagggtggatctagtgggacccagccatgatggtatgagagacccatgtgtaaccttcataagagaaatgtaaactgaaatcaagataaggtttggttaacaaatatagataggaggagaattgaataaatagagacattcatgtccctgggtggagaagtgtccattgttatctaattaatgtatacctttactgctattccaactcaaatccccatggaagttttgtagaacttaatatttttttcagaaagaagactctagaattaggagaattactctaacatttaacagtatattgtaaaactgtaataatttgcattctgtatactttatcatataatactataatactttctaatactatgctattagatttcataataaagaacagtgtgataatggtatacaaggcttatccaaagataagccttattatacaataaaattaaatacatgagaaaaagccattataaaagtcaaagggaaagaaagaaaaatgcagttttctttgggaataatatataggtcatctggaataaaaatcctattgttattcactacaaacctataccaaaataagttccagatgatttaaggttttaatatattttaaaatataaaaaagaataaaataaattaaataggtggtaaacatctagatagaaaaatgacattctatactaagaaacacttgaaatcaaaagatgaacagattttaatagatacaatgttaaattgccctaagtaaaaaataaaaataaaatcaataaccaaaaataaggcaccaataggctgaaaagtgcaaaaataaatattatacaaacttaatagcctttttatatgatttcataaagtaagaaacatcaccaagaccttccccacaaaatgagtagacaacccgccaaataaaatttgtgaacacatatatggaaagataattaaacgtatttgcaggcaaagaaatatagactttggccggatgcagtggctcacgtctgtaatcccaacactctgggaggatgagctgggtggattgcttcagcccaggagtttgagaatagcctggcaacacggtgaaaccctgtctctaccaaaaatacaaaaaaactatccaggtgtggtggcgcacacctgtagtcccagctacttgggaggctgaggcaggaggatcacttgagcctggggggctgaggctgcagtgagccaagatggcacctgcactccagcctgggcaatagaatgagaccttgtctcaaaaaaataaaataaaaataaaaataaagtaaaaggaaatatataggctttgattctttttgtcattctggccaattaaccttttctaaagaaattattatgaaattccaactagcctaaaaataattttttttttttttttaattttcttgagacaatctcactcttgcccaggctggagtgcagtggtgcgatcttggctcaatgcaacctccacctcctgggttcatgatgcaattctcctgcctcagcctcctgagtagctgggattacaggcatgcgccaccacgccaggctaatttttgtatttttagtagagacggggtttcaccatgttgtccaggctggtctcgaactcctgacctcaggcgatccagctgcctccccatcccaaagtgccaggattacaggtgtgagccactgtgccccgcctaaaatagtatttttaagtgtctatccttaaaataaaataattcaaaaacatgagaaaactcgatgtacaaatccattcagggcactattatttacaacagcaaaaagctaatatgcaaacaaatgaataaattaagccacaatggaagattggttaagtaaaatggaatataataacttgatagcagattatgcatccatttaaagtttttaatgcaaaaactgtgcaaaatgattttatgttgagtagaggcaacagcaaacctgtgttactcctactgtatccccagtgcttagcacagcgcctggtccccaatagggaaccaatatgacttgttaagtgaatgaaaactgcacacacaaggtatgactccagaccatgtaaaacctacttacagagaaaagaatgagaagaaatataaataatggtagaagtgtagaagaagttatactcctactttacatttcttttcattttttggagaaaaaaaaaagaggcaatgcccaaaatattatatggggccatacttacaattgtttatcaaactttaactaggtgtcctgtattgttatttgctaagtctagaaaacctactagacaacagatttcaaatccttatggttaatgtttgcttgttttatatagatatatatttttgagacaggatctggctatatgacccaggctagatggcagtggcacaaacacagctcactgcagcctcacctcctgggctcaagtaatccttctgcctcagcctcccaagtagctgggactgcagatgtgtgccaccacgcctggctaattttgaaattttttgtagaggtagggggtagcactttgttgcccaggccggtcttgaactcctgggctcaagtgatcttctcgccttagcctcccaaaatgctgggattacaggcgtcagccactgcgcccagccccttacagttaatttttgaagtctattgaacaaatcagttcccttgatgcatgattatttttttcttcctcatatataatcatgtgtattttttctgtatagaaaaagtataaacaaagagaaaaaactgcactaaatcccactaccaaagataactaccatttgtatttgaagacattccctacgtatatgcatataagatttatatatgtagttttacatgcatatgaaatcataccataaatgctttcttgtaatcgtgttttttgctgtttatgttttccatgactgccaatttcactgcctgttcagaggtctgacttccataaaaatcccatttacttaccattcccgggggccagcagtacatgggccacatatgcagatgattaactggtagtttgtttgttgtttttatggcaaatcacatagcacaggcttacagagggtcctcccttgagagcacaagcccagaacctgttatctaagccctccacagtcttgaaaaagagacacaattttgtgagggatatgttcatgtgaattggtacttactaggctttatttcatctcataccaattttgttccagaaacttcctagaaagctatgaaaacatgagacaatgaccatggatatggtatctgggagaagtactgattacgtaatgcagtctttattttttattttttatttttttttgaggcagagtgtcactcttgtcacccaggctggagtgcagtggtgcaatcttggctcactgcaagctccacctctcaggttcaagcaattctcctgcctcagtctcctgagtagctgggattacaggcgtgcgccaccacgcccaggtaatttttgtattttttgtagagacggggtttcaccgcgttggttaggctggtctcaaattcctgagctcaagtgatccacccacctcagcctcccaaagtgctgggaattataggcatgagccaccacacctggcccatgcaatgcaatcttagcagctgagttcaacatttattgagcagctactatcagccagacacagggttaagcacacaaagcataggaagaccaagaaaatgtaccccagccaggggaagcttcaatttaccaaacataatatgaagtagacattcatctatgattctaccactcagaaatactattattaacatcgatccagatataagaattataatacccagcacttacagagtttttcttctttctttcttttttttttaatagagacagcctctcactaggttgtccaggttggtctcaaagtcctgggctcaaataatcctcccacctcggcctctcaaagtgctgggattacaagagtgagccaccacacccagcctgcagctcttattttatagagactttaagagtttaaatagtcacttatgaaatcctcaaaatattattgcaatgtacaatttgtatttctattgcacagatgaagaaactgaggcaaagaaagattatttaacctgccttaaattgcatagttgcaatgtggtagggcctcgattcaaaaccaatgtctctccatagatgagacagagagagagagagagagagagaagaggagagagatgacattgctttggaaaccagactttgaaacaaatagcatacaacactatgtgtcaatcactatcctgagtattttaaatattatgatttattttatccataaagttagcaggtactgcttatttcatccagacaacttagtgaccacaagtgactttaagaactttaacaagagctagactgccacgacaaccggggttgccctgcatttcatcagagcttctctacattagggggttctgcctcacctgaaaatcaagatcccttaaatgaaacttttcaagtctgctttcccagccttgaatgtcatggtcacacctgaagtcgtttatctctggacccatctcctggaaggtttaggcatgattgataaatgcctatgcacaggtgagcaacagccccagattgttagctgtataattgcatccatacacctgaaaaacgtgagcaatttcgctccgagctctgaggtggtttcgtatgagcagattttcaagtgatgcctgggaaactttgagaacacaattgtcagccccgggagaactgagcaccacccaaagggaggtagtcccgggaaggggcgctgtgcagacctccaggacccagcggtatcagctgccttgagcgggtgaagctccatggtgagtgtgccagagcacagctttaatttcctctcatccgtccctttctcttgggcaaaatgaaccataaagtttatattcactttagtgtatacattttaaatataccctataaaccacaggagtaatgaattcaagatgcccacatcatagtaattctgcatgcaagctgtgttttatgatttgtatccagcctttttaggatttttcaataggaccagactccagactgcagggaaatgaaaagaaggataatgatgtgaagtttcacgtcaccgctaagtttccagcactgttgtcctgtagtcaccaagcgggtgcattttttgtgtgcggtgaagtgagtggattgtcccaggctgagagatgcccaggtaggagggacacttggccttcctgtgctccttccattggctctaggtgtcccctgtgggttgcgattggtcatgtgagcaagcgagcacgtgggcttgtgtacatttctgcatttctgggatagccctgccttgcaggtgccagagaaacacgtgcttcagaagggtcagattggtcatgcatctgtgctcagattgaaggagtggcctccctgaagaattccagcttgcagaggcactttcaaaatgcagtgagctcaggttccaggagctgttacggcagtttttgtctcgacactccgttcccctgaattccactttgggaagaagggaagaagccaccatgggccaggcaggcgacagagcaagccctagccagatcgcaagccatcagagccctgttccttctctccaaagtgggcttcatttacccctcttcaagcagcaggacagtctgttcaatgcaggggaggctttaagacatgggggcagggaggggtcatatttttggcctcgctcctgctctgcgggctttctcatgaatgcagaccagtgtgcacgaatgtggccaggacacatgcttttcgctcagaatgctcacttgaaatgtaaggatctcttgttccctgtaactttagatgaggtttcaaaacacagaatccatgctggaaccgccaggccagcagcgggaggtgggctgtcttcagagcagatggaacaaaggattgggttcccaagttcttatggtaagacaaaagggcaagatgtcaacccaggaccacccaaggaaaattaaatacagatcgacttttgatggtttatgttaacagaggggagatggggttttgatcttgagaaaaacaaacatcacaaactctaccgtaatcactgtttctcacaccctacaatagagtagcaagaactgctaggtagccacaaacacacaagtggggtgggagcttctgtttcttctgctgtttagtgtgccttccatgggctagcgagcgcggggcaacatcaagaaaaggcaccccaggtttcccagccagccactgatataagagaaaaaaatgggtcctccagcagtcaactcccctttctcaactccagatctgggatcagaggccctcctggctcagtcctggatcaggggcagcccacccaccgacacctctctctcagccacagcagcgtccatcacatcggagctcctacgcagcctgggattacaggtggaatgaacatcgctaactctattctcaacccaaatctttttctagctttttaaaaaaatgcattatgaggctggcacagtggcccacgcctgtgatcccagcactttgggaggccgaggcggatggatcacctgaggtcaggaccagcctggctaatatggtgaaaccccatctctactaaaaatacaacaaaattagctgggctcaggggtgggcgcctgtaatctcagctactcagggggctgagacaggagaatcacttgaacctgggagacggaggttgcagtgagccgagatcaagccattacactccagcctgggtgacagagcaagactctgtctcaaaaaaaaagaaatgcgctaatgaaaaatttcaagcatcctcagaagcagaggacattctacaatgaacccgagattcagcagttaccaagatttgccacacttcttcatctatcccaattttcccctttctttacagcaaattccagatatcatgtcattttagcccctcatccttcgggacgcatctctaaaaatatagacattttcttaatttcaatgtcattgtcactcctaaaaaattaacagtaattccttgatattatctagatcacagtccatatcagatttcctgtatttcataaaattgtctcgattagttggttaagtttccttagtagccaagaaagatctgcacatttcatgtagttgtgatgcctccaggttcatctttcctgccccactccttgaatcagccatttctctaagagtccttggttccttttattggaaaatggtgttagaaactgagccactgtgtctggctctttcatttttataatcccagcactttgggaggctgaggcagacggatcacctgaggtcaggggttcgagaccagcctggccaaaatggcaaaacctcgtctctagtaaaaacacaaaaaattagacagacatggtggtaggcgcctgtacttggaagcctgagatgggagaattgcttgaacctgggaggcagaggttgcattgagccgagatcgtgccattgctctccaacctgggcaacagagagagactctgtcttaagaaaaaaagaaaagaaaagaaaagaaagaaactaagatctagtcctgttgctattgctcagttattggggtgcttgttgctattggggtgttattgcctctaagcctttcagctgagagagcaaggaaatatatgtccatgtactatatttgcctatgtatatccatatatctaaaaatagttctgtatgtacatctatatcagtattaagctaaacatgagttatactgatgtctccaatgctaatccagtgccatctggatcattctaacaccctcccttgcttacctgtaatctcccactccaacagtgagaaaactggcttccaacaaccgtatttacccttgacttttttttttttttttaagatggggtatcgctctgtctcccaggctagagtgcagtggtgtgatatagctcactatagcctccaacttctgggctgaagtgatcctcccagctcagcctcccaagtagctgagactactactacacaccatcaagcccagcaaatttttattttttgtagagatgaagtgtttctttgttgcccaggctgcttgatgtctttctaacctacatccgccctccaaaaaaaatcactacaaaatccattgtaagttatttaaaacaaaaaaggaatttattgagtttctttttttttttttttttgcagtggagtctcacttcgttgcctaggctggagtgcagtggcgtgatcttggctcactgcaatctccacctcctgagttcaagggattctcctgcctcagactcctgaatagctgggaatacaggtgcccaccaccacacccagctaattttttttttggaatttttagcagacatgggtttcaccatgttggtcaggctggtctcgatcttctgacctcaggtgattcacccacctcggcctcccaaagtgctgggattacaggcgtgagccaccacctgtatattttaaaatatactaccaagatttccgtgggagtccaagaatcaggtgtggggctttgcagctagcaccactccggaccaattatgcacaaatgtggcaggccatgtgtttttcattcagaatgcttagatgaaatgccgtgccaggcccgggcactgccagtgtgtgccagaatctccaccgccactgccccaaagccaggcacccacaccaccctctcacaagagctgtttccttgcattaccctctttctaaatgaagtctcggctgggctcgtctcattgacagagcctgtgtcaatgacaaagccctaaccccaagggaaagtgagtttcctgtttcctccaagggaagtcaagattcacagtgcatgaaattccccaaagagaggaaaactgtccaaaagatgttgggtggctattttaaaaattgtacagccagagggctgggtgcggtggcttatgcctataatcccagcactttgggaggccgaggtgggcagatcacctgaggtcaggagttcgagaccagcctggccaacatggtgaaaccctgtctctactaaaaatacaaaaattagctgggcatggtggtgcatgcctgtaatcccagctacttgggaggctgaggcaggggaattgcttgaacccgggtggtggaggttgcagtgagccgagattgtgccactgtactccagcctgggtgacagagcgagactctgtctcaaaaataagtaaataaataagtaataaaaataaaaattacagagtaggattttgtgtcaaccaaaatcattcctaagaatctgcacgggaatcaccaagcccagagggtactcttcaggctttatcctcttggcctcattgtgctatctatgggtgggctcagggttcctacaggaaacttgttggaagtctcacccctgactacagctacaattctctcgcctttcctcttactttgcaggtcattgtttctcagcctctcatggacccttcttcttacacaccttttatatatattttttcaattatttattaattgaataggtaatacacacatggtacaaaacaaaaggtaaaaaggggtgtataggccgggcatggtggctcacacctgtaatcccagcactttgggaggttgaggcgggcggctcaagaggtcaggagatcgagatcaacctgaccgacatagtgaaaccttgtctctactaaaaatacaaaaaattagctgggcgtggtagcgggcgtctgtagtcccagctactcaggaggctgaggcaggagaatggcgtgaacccaggaggtggagcttgcagtgagccaagatcgcgtcactgcaatccagcctgggtgacagagcaagactctgtctcaaaaaaaaaacaaacaaaagggtttatagtaaaagttaagactctcttccttaccatccatgttatttctctccccaaagactgttactttcctatattttcttccagagatattttatgcatatataatcaaaaatattcggctgggtgcggtggctcatgtctgtaatcccagcactttgggaggccaaggcaggcagatcacgaggtcaggagattgagaccatcctggccaacatggtgaaaccccgtctctactaaaaatacaaaaattagctgggcctggtggcatgtgcctgtaatcccagctactcgggaggctgaggcaggagagtcacttgaaccagggagtcggaggttgcagtgagccgagattgtaccactgcactccagcctggcaacagagcaagactccatgtcaaaaaaaaaaaaaaaaaattcataatttttccatccagcttccagaatgaaggtatatcatgctttacaccttcagtctgtattttgcttcttttatttaattatatatcctggagatgttttaatagcaaagcatgtagaacagcttagtttttgtaaagactgccttgtagtccattgtattattaattagttatgaattaaactagtcctatattaatggatgattgtttcaaatcttttacttattacaaacaaagctgcaatgaagaaacttgtatatccacaatcttgtacatgtgccagcacatctgcaggaaaattcctagaaataacatttctggggcaaggggtatgcacattgcaaattttgatgaataccatcaattactttccataaatgtactaatgtgtattcccactaacaaaacatgtgatagtgtctcttccccaacctcttgccaacacagtcgttaccagctttttacctttgccaatctaataggtaacccatgtgacctcattttagttttgtgcctttgtatatcttgtgttataaatcaggtaaagcgtcatgttaggccaggcatggtggcttaacgcctgtaatcccagcacttttggaggccgaggtgggtggatcacttgaggtcaggagtttgagaccagcctgaccgacgtggtgaaaccccgtctctactaaaaatacaaaaattggcggggtgtggtggcgggcgcctgtaatcccagctacttgggaggctgaggcaggagaatcacttgaacccaggaggcggaggttgcattgagcccagatcacaccactgctctccagcctgggcaacagagcaagtcttcgtctcaaaaataaataaataaataaataaataaaaagcatcattttacctgacttcagccacagaagaggagatacactggttttcctcttctgtggtttgtctctttgtatcctttgccaccttttcactgggaagttagtaatttatattgatttataagaattctttataaattaaggagattgtgctaggtgaagatctggaaaaagggccttccggggaggggagacagccagcacaaacccaggaccaagcaaaatgtgtcctgggagcaggaaagactcatgatgtagcacaccgagagaagccaaatgacgtcccagggtggaggccacgtcacactgtgcctgatcacaccgtgctgtttttctaactgcaatgggaagctgttagagaattttaagcagaatccgctcaggaggatttggatctggccacctgccagatggtaacatttattaagatggggaagatgaagaagaggatgattatgacgggaaagcctagggagggataaaaagttctactttcaatgttttaacctggagatgcctgtcaatctgccttggagaagtccagcagactggtggatttctgagtttcgcattcaagagaatggtcagtgctacagataaaatttggagtcatcagcatctgaatggcattgacagccttgaggcaggatgaaatcaccaagggtgaaagtactgagacaagggacttcaaccagaggaggaaccagcaaaagaggcaatgagataggagtaaagccgggagagagtggtgcccacggagccaagaaaaggtcatgcgtctagaggaaggggtcagccactgaatgccatagtgaaaccaagtcgatgaggattgaccactggtttaggcaaatggggatcagtggtaaccttgacgatggtaatttcagttctctggtggagatggaagccaaagggcagtgagttgaggatggagttgagtagaaacagcacagataattctcaagaactcttgctgtgcagaagagcaagggcaaaggattggggcagttgctacaggggaatatgggttcagggctttttggtttttgtttggttggtttctttttgtctttttttttttttttttttttttttgagacaaagtctcactctgttacccaggccggaatgcaatggcgcaatctcggcttactgcaacctttgctgcccgggttcaagcaattctcctgtctcagccgcccgagtagctgggattacaggcacctgcctccatgcctggctaatttttgtacttttagtagaaactgggtttcgccatgttggccaggatggtcttgaactcctaacctcaggtgatctacctgcctcagcctgttggttggcccaaagtgctgggattacaggcgtgagccaccacacccggccggttggttgtttttaattatgggatactcatgggtctatcgatcagaatgacccagtggagagggaaaaattgatgacaccagatacaggaaggaaattgctggaatgaagtcctgtaataacttgcaacctctttcagggatgttaagcgcagcctcctctgaagtaagaagtgagtgagtagggtgtggagtggcccggagtcctaatggcacactgaaagctgaatgtgatgaatgtggagtggttagggaaggtgggaggagaagcagcaagataaaaggaagaggaactaggatgtattgggcagtaaccctgtgccaggcagacataggaactttgaagtaccttttgaggaacgttttgaatatttatatcctttgttttggtttttcattgtggtaaactatacaaaatctaaaatttcagagtgggagacaatcttcacaatctatacatctgacacaggacttatatccagaatctgcaacgaactcaaacaaattagcaagaaaaaaatgaacaatcccatcgaaaagcgggctaaggatatgaatagacaattctcaaaagaagatacacaaatgaccaacaagcatgtggaaaaatgctcaacatcattaatgatcagggaaatgcaaatcaaaaccacaatgcgatatcaccttactcctgcaagaacggccataatcaaaaaatcaaaaaataatagatgttggcatggatgcagtgaaaagggaacacttctacactgctgttgggaatgtaaactagcacaaccactctggaaaacagtgtagagattccttgaagaactagaagtagaactaccatttgattcagcaatcccactactgggtatctacccagaggaaaataagtcattacacgaaaaagatactttcacacacatgcttatagcagcacaattcacaattgcacaaatgtggaaccaacccaaatcccagttaatcaatgagtggataaagaaactgtggtatatacatatgatggaatactactcagccataaaagggaatgaattaatggcattcacagcaacctggatgggattggagactattactctaagtgaagtcactcaggaatgggaaaccaaacatcgtatgttctcactcataagagggagctaagctatgaggatgcaaaggcataagaatgacacagtagactttggggactcagggggaaagggtaggacgggggtgagggataaaagactacaaattgggttcagtgtatactgctcaggtaatggacgcaccataatctcacaaatcaccactgaagaacttactcatataaccaaatagacctgttccccaaaaacctgtggaaataaaaagttaaagaaaaaaacaaaataaagtgaagaagtataaaataaaataaaaaaacacaaaaactctaaaatttaccatttttaggtacacaactcagtggcggtaaatacggccacagtgttgtacgaccatcaccactatccacctccagaactttatcatcccaaactgaaaccgtatccattaaacaatattcccctttcccctcctcctagcccctactaagctctattctactttctgccactatgaatttgcctattataggtacctcatgtaagtgaaatcatacaatattttgtgcctggcttatttcacttagcataatattttcaaggttcatccatgttgcggcttgtatcagaatttcattcccttttattatggctgaataatatcccactatctgtatagaccacacttcgtttatgcattcctctgctgatgaacacttgggtgtttccacctttggctattgtgaatgatactgctacgaacatggctgtttgagtacctgtttgagtccttgttttcaattatttggggcatgtatctaaaagtggcaccctttatttttttggttaatgctcacagcagccctcagacagatgttcttcaggctggggccccttctttattccttcagtgggaggccgtatgctcccaggtcccaacacaattcctcagactgaattccccttctttattccttcagtgggagcttccaacacaattcctcaaactggatattgtccattggttttgttctcaaacagattgaggttcctcaccagcctctggtcctcagcctcttagtcctacagctcctgtgtttgcggaagagaatcccatcacaggctctcgtggggaaggtaggccacacctcttggtcccatggctgtctgcggtgagaaaagggtgggcgtgaggaggctgccttattgatataaggtgcttggttatagacgcctcatgtatatgtctgtaggtagacttctgcctcattttttggatccttttgagttgcaaaagagctttctctcctgaagtcacgctgcttctgggaagagctaaaacctgacttttccaggcaaaaaacagtcacctgaaagcaagtcatgataacgtcatcacttgaatattttggccgtgctaaaacataacactttaaacactagaagataagttatcatgatagtagattgagctaggaaagttatttatagaaaacaagtaaaacaatagaattgcaacaatttttaacgctaagatttcctgtaaaccgctatagtcacaggatagtctctcccttaagatataaaattatcttgtgatccaaaaaatagctggtgtcagcattgtttcagcaaagtttcccttaaaatataattttgctttccttttatgatgttatgatctgcacgattctatagaacttccttgtctttacaaagacattcctggaataaaaaccaatttcgtggcccgtggggggaaaaaaggtaagttctgagtgaatatttctggctcctttctggattgcaagaagccagtgagttgagtaccccaaaataaatcccgttggtgggtggggcaagggtcagaattggggacttgaattacagaatgacaggatatccaggatcatagctttttttttttttttagacagagtctcactctgcaacctctgcctcctgggttcgagcaaaccgggatcatagctcttgcactgccatgcgtagataattgcagcacacttgtctgtgatgtatgtacaagtcattattttttggatggtggggtgcatttttcttattttctctatctttcctctttctttctttttctttctttcttctgtcttttctttctctctttttctttcactctcttttccttctcccttccttcttttcttttcttttctttctctccctatgctgcccaggctagtcttgagctcctgggctcaagtgatcctccctcctcagcctccgcctcccaagtatctgggattacaggcacaaacgaccgctcctggttgtctttctttctttctttctctctctctttccttctttccccctttctctctctttccttctttccccctttctctctccctctctctttctttccttccctctttctctctttccttctttccctctttctctttctttccttctttccctttctctctctctctttcccttcccctcccttcccctcccttcccctcccttcccctcccttcctcccttcctctctctttttctctctttctctctttctttccttctttccttctttccttctttctttctttctttctttctgatggggtctccctatgctgcccaggctagtcttcagctcctgggctcaagtgatcctccctcctcagcctccgcctcccaagtatctgggattacagacacaaacgaccatgcctggttgtctgtctttctttctttctttctttctttctttctttctttctttctttctttctttctctctttctttctttctctctttctctccttccttccttcctcccttccctccctccctccctccccctccttcgttccttccttccttcctttctttctttctctttctttttttttttttttcaagatggagtcttgctctgtcgcccaggctggagtgcagtggcgcgatctcggctcattgtaacctctgcctcccaggttcaagcgattctcctgtctcagcctcccaagtagcttttcaatttggtcttatcaactttaaactgatctcagatgtgtcttacttccctaatacagttttcatatctgttccttagtcattaatacctaagatatttttccagctgggtgcggtggctcacgcctgtaatcccagcactttgggaggttgaggtgggtggatcacctgaggtcaggagtttgagaccagcctggccaacaaggtgaaaccccgcctctactaaaaatacaaaaattagctgggcatggtggtgggcgcctgtagtcccagctactcaggaggctgaggcaggagaatcacttgaacccaggaagcagaggttgccagtcttggagccaggattgtgccactgcattctagcctaggcaacagagcgagattctgtctcaaaaaaaaaaaaaaaaaaaaaaaaaaagatatttttcctagagctttttgtttgttttgtgctttttggcttggtttttggtgactcttgtttgactctgtctagatctttttccacttcagagttttgttgttgttttacgatttcccagttctctttctggagtacattattgcagctatttgcttttttttttttttccccattccttttagacacgtgtcttcattttagctttcagattatattttcttgaatttacttgaaaaaatacttcttcaatatatagttaaataaagaataaatcagtgtttggatgactactgacctatttccatttttaattttcaatcctctagagaatcagtgataaagattgtatttgtagggatagcattcggagatatacctaatgctaaatgacgagttaatgggtgcagcacaccagcatggcacatgtatacatacgtaactaacctgcgcattgtgcacatgtaccctaaaacttaaagtataataataaaaaaaaaaagattgtatttgtgaaattccttatggcacacacttgtttggatccttttatgtgaaaagatcctttttctattccatttatatttcttatatggtataaatcaaaattatgaaagcttttaaaaatgatgtttatttaatagttaattctggcccagtgcagtggctcacacctgtaatcccagcactttgggaggccaaggtgggaggatcatttgaggccaggagttccagactagcttgggcaacacagcaagacactgtttctatttttaaaaaattgttaactctaaaaatatgttctttcctatttaagtcaggaataagaaaagaatagtccctgtcacattactcctgaatatccttctggaatcttggccaataaaatcagactaggaaaacaaagacacacaagtattaggaaggaaggaacaaaaaagcaatttaaagatggtatgtttgactacctagaaaatccaagagaagcattctattttaaaaagacatgcttaaggggaaaacatcaaaaacacagaacatcagtaagaaaataatgcgaatcatccataatccctctagccagaggaaaccactgttaaaaatgaacaatttggagccagtcacggtagcatgcacttgtaattctagctactcaggaggctgagacaggaggatctcttgaggccaggagttcaagaccagcctgggcaacatagtgagacccccccccagcccccatctcttaaaaatttttaaagtaaaaaaaatgacaatttggtctatatctttccttatgtttttgcacatatgtgtgtatgtttatgtgtttgtacacataatatatttattccaaacatcttacatctaattatatggccattgactgttatgtaaagtgatcctacagagggaattcctgtattactgtggcagaagtttagtccctgctgtgagaatggtgatagagcatttcacctgggtcagaggacagagactcaagcctgaccataaaaagttccaaaacacaaaaatgttttaaaactaatttggtaacaaaccttaacctaaaatgatataaggctattcagcctttattcaccccaattaggattaacattcatatcatatgaaaatatgttattgcattacattacagggatcttccagaggacccctgggttttggtttttgttttttttttgagatgaagtttcattcactcttgtcacccaggctggagtgcaatggcgccatctcagctcactgcaacctccgccttccaggttcaagcaattctcctgcctcagcctcccaagtagctgggattacaggcatgtgccaccacacctacctaatttttgtatttttagtagagacggggtttcaccatgttggccaggatggtctcaaactcctgacctcagctgatccacccaccttggtctcccaaagtgctgggattacaggcgtgagccaccgctcccggccactcctggtggttttatgctctgtgttacctttcaaaaatccaaaatattatgaattctgaaacagtccccaaggctttgggcaagagattatgtatctgtaatatactgagcagcagccagggatgccaaaaatatagaaatatgtgtgctacagcacaggaactcacaaccaaagttgaaatggcaagatatgtgcacaggaaaagctttaaacctttcaaatacaccattaagccaatatgcatatagtcctagtctatattgacgtgaatggctctacagcactgcctatgaatgtttacttaatatgcgagtgccccaaatcatacagaatcacgtttgatggatagcgtcctgacctaaaatacagaagagatgtgtctgaccagaggggaggaaaagattcttttttttttttttttttttgagacagatggagtctcgccctctggcccaggctggagtgcagtggtgcaatctcagctcagcgcaacctctgcctcccgggttcaagcgattttcctccctcagcctcccgagtagctgggattacaggtgggtgccaccacacccggctaatttttgtagttttagtagagatggggttttgccatgttggccaggatgatcaggaggaaaatattctttatcatccctgtgtatttgagtcttctagtggcaagcatcagaaacctgacttcaaatgaatgaagcaaaaaaggaaactcttggctcctgcttggatgaagcccctgtgttgatcaccaccaccccctcagtcccactttcttctctgttgtttctttctctgtcaggcactttccacatcgtgggaaagatggccactgccggtgctcagtctccagtccctgcagactgcaatcccaggagggaaaaaaaagaaaagtctcttgccctgtatccatctcagtctctcagaatgacccagcctggccttgccggtgtcttggcccctagctggtctgatgactgtaccttgaggggatgggggacgctgacccacacgagtcacatcttggtgggagggaatgcaggactttgtaattgacagccatgctctagtcacatggaaaggagatgggcgatttcaaatccaaagggtgctgggacaattaaaaaaaaaaaaaaaaagagggccctctttgcagaagtggtcacagggtgagagcagaggatgacgacagtcgaaaggaccccagttgctctttggtcacagtgctgacgttcctgcatatgcaataggcacggcattcacaggagagcagtggcataagaaagctttggaagtgccttgtgctaaattagatgagtcttaagaagatgcttaaaggaaagacgggaagtgcgttggtgggaggaatggaagagagtatcataggtaggagtgcagcatttatctgcttaaatgattttgctcctggctgagtctaaataagaatattcttgtgagtagtttttttttccttctatacatgagaaatttctgactcctttctgcattgagacaaacttgtgaggacaggctcatgtttgatggatggagccctgacctaaaatacagaagagatgtgcttgacaagggaaaaaaagagatcagttataatccctatgcattagatttttccagttgcaagcactggcaacctgacttaatatgaatttaacaaaatttatgctgggcgcagtggctcatgcctataatcccagcactttgggaggctgaggctggtggatcacctgaggtcaggagttcgagaccaacctgaccagcatggtgaaactccatctctatggaaaatacaaaaattagcccggtgtggtagtgcaggcctgtaatccctgctacccaggagactgatgcagaattatcactggaacccaggaggcagaggctgaagtgaaccaagatcatgccactgcactccagcctgggtgacagagcgagacacttttgcaaataataataataataataataataaatctgttggctcttttggagaaatgttaaggagcagcagacaacaattttatgactggggctggttctattataattctgatattatatatcagagtctcctacattcaagctgcaataactttctaaacagcttgctgaaagtcacccagggaattatttgttgatgttccagaagagggagatacaaaggcaaagggattgttcccggaatttttctgagtaattaagttacagttgctatttgcaagtcactgcaaaggaaatcttccagtagatgctacttattcagccatgtgtgcaaaactagatatttcttacattaacattgtaattatatttggcatcattttttgttttgctttagatggacaaagattaagtcttaagtgtacaagtcagagaaggagaagacacatttctgatgcctttgagtaattctgatctgctaaattagacacacagcctggcatagaccaaccccagtccattatcacagactgaagaccaaagaaaggaataaatgaaacctgtaatgtgctgagcattttacataaatcatctttggaattctcacaatgcaaggaagataccattatccctatcttagcagataaagaaagcaaatctcagagagcttttactcacttttccaggaccagtcagctcttaagatgtaaagccaggattctagaactgaatcatctgatttcaaagcctgagcaagggggaagtggtgcacgcctgtagtcccagctactaaagaggctgaggtgggaggatcccttaatcctaggagtttgagtccagcctgggcaacatagcaagaaccaatctcaagaaaaaaattagcaatgcaagaccatgagcccagcttcatactggtggtatttttgggggataattaagctgtgtaacatgtagcttttgatttccttttacaacttctctccttaacacctatagatttattatcatcaaaatacaatgtagtctgggcacagcggctcacgcctataatcccagcactctgggaggccgaggcaggtggatcacctgaggtcaagagttcgagaccagcctggccaacatggtgaaaccctgtctctacctgaaaatacaaaaattagtcaggcatggtggcaggcgcctgtaatcccagctactcggtaggctgaggcatgagaatcacttgaaccagggaggtggagattgcagtgagccaagatcatgccattgcactccagcctgggcgacagagcaagactcagtcccaaagaaaaggaaaaacatacaatgtaaaaagcacaatccaaggagctgaaaacgcaagagagaactgcctaccacctttgcttgccaggaattcacagactattgggagagagaacacaaatatgaaacaataaacaacctatgggtggaattgggctgagcaaccaggaccagaagcttctagtgatgccccaatgcccatttcccttcttcagtaagacaaccctcctgcctccttccactagataagactgtagccatgtggaacagagactgtacttatggaatcctttatggcagtttcatgtaagtaaattctgtctagtgggatgcaagcagaaaggacaagtgcagtttctgacagggagtcttaaaggaaaaggacaatccattcctcttccctgcctgttagagccttggcagccatcttgaatcaggaggtgagtttggaagtggaagtcgctcgtggcagaactacccatgggagaatcccggggatctgactctgaggggtgcagctcctaccctggactgcccacctccattcttttatgtgaaagagaagtaaacttcaatctaacttaagccattgttattttgggtttttgtcattgtaagcaagtttaatcctaactattaaaaaggtacagttctataagcactcgccacctcccccaaatcctaccaggtgaccttcattcagcaagtgacttaaccttccccagggtggctgtgagaacccagtgagatcaacccatgagagaccaggaaaaagctcgcggggttttgagttggcctgtgtgatgcagtgtgactgggggaaacaaaggaagaaaactaatacccaggactcatcaattcacaatttcctgaagtgcttcacggtcagcatgtgcagaataatttctaaaactgtgtagccttagtcccagggaggctgagctgggaggatcacctgagcccaggaggtcgaggctgcagtgagccgtgatcatgccactgcactccagcctggatgacagggtgagaccctgtctcaaaaatttatttatttatttgtttgtttatttatttatttaattaaataaaaccatgtagcacagacattaagttctttgtagattcagagctgataaaatttgtgtgctgcagtaaatgattaaaggtttgatgagggagatgaagtatgagtggggtgttaagaaatgaatccgatttggtatgcaagtcatgactcctaactacaagttatggaaaatcaaccctgtttggaaaaacaaaaaaaaagtgggtggggaggaggttggtggttgaatcatgtaattaaaaaggcaagaagtaagctcagggaaggctggatggagaccaaatgatgtcattaggatgcggtctcagctctgctttcctgagttcattgcattttcataaggcaaggagtggtgtctggcagctgtggatgtacatcctatcagctcagcaacccaggtggaaaataccttcttccttagggctgcagagaaaccctcaacctacctgactccctgtgcctctgattctgcagacctgggtcatgttcccacccctggagtggataggggcagaagaatgtagcctcagccccatccaaactgcaagaattaagagttccaaaagggtggttttccaaaaggaaaagtgaggtgctattggcaggagaaggggagttgatgctgggaggaatgttattcgagtgttatggcagaggagagaaaaagcaaagaaagaaagtctagaatgagtggaataacatgagctgaatggaagagaaaactcaagtaggcaagacaagtgctggcaagggaccaccttcctttgtattatttctctctctctctctcgtttttttttttttttttgagccggagtctcactctgtcacccaagctggagtgaagtggcgcaatatcggctcactttaacctctgcctcccgggttcaagtgattctcctgcctcaacctcccgagtagctaggattaccacatggtgggagtagccaccatgcccggctaatttttgtattttttgtagagacgtggtttaatcatgttgaccaggctggtctcgaactcctgacctcaggtgatccacccgcctcggcctcccagagtgctgagatgacaggcatgagccccgccaggggatccccttcttctttgctgcactagtttgcttggactctcataacaaaataagcggcatcaacaacggaaatttatcgtggagactggaattctggagttccaagtttcctctgaggccgctctccttggcttgcagatggcctccctcttgctgccctgctctgctcatgtgtccccggtatcacttcctcttttttataaggacaccagtcacattggattagggcccacccataggaccgtatttaatcttgattacctctacaaaggccctatctctaactatagtaacagtctgaggtactggggattaggacttcaacatgtgaattaggtggggggacccagttcagcccatgtcactcactgttgtccaaagggcagtaatgaaatgcatggattggggatttcttatacatttataaaaaatgcagtagttacagctggatggtgtgagcagccagttctcagcaaatcttccttatgatccttgtcaaaagacaaaattacaacaaatttagtttaaagatctctagtggctttatttgcgattcgagaatcgtgcaacacttcattccataaaatagaatgagtgttctgatgagctgagcagagaagggtggatttataggcagaaaaagtgctgaagaaagcagaaacaaagaacaaaaagcagattggtcatttcaaagttatttcccttgtaaggtggggacagaacaatagaaaaattactgactgggtatgatcagtttacttcagattaagggttaaaagaggggcattcattatcatgccgatcgaagacagaaactggcctggttgggagggagattgccagttatctctctctcctgatttctcagaagatcagcttgacagttttagtttggtgcctgggaacctcagcattagtgacatcattttgatctttagtctggtctggtgggggcttttgcaggagctcagtccaaaacaatggactccgataattttttttttttttttttgagacggagtcttgctctctcgcccaggctggagtgcaatggcaggatctggactcactgtaacctccgcctcctgggttcaagtgattctcctgcctcagcttcccaagtagctgggattacaggcacctgccaccacacacagctaatttctatatttttagtagagacgggctggtctcatgttggccaggctcgtctcaaactcccgacctcaggtgatccacctgcctcggcctcccaaagtgctgggattacaggagtgagccaccgcgcccggcctgctaatttttatataacactctaaatcagtgaaacctgccatcatgaaaattaaatccgtcttctagagaaactaggcttccagaaagctcagcccactggaatggcagtgcatagccaaaaccaagcaaataaacaaaaggaagaattgcaaccaaggaacccacaaatcaaaggtgcagttacacaaaggctctgcaacttgtcagttatctatgggaaggccagtgacactccaagtagccagccttattgggcaaagctaagacatgtagggtcaggatggatggaaggcacattgcctaatgcagtgttctgttctgttcatagcagacacacaggaagcagtggctagatgaatttatcaaaaatgagcagaaggaagaagaaagaatctctgtggtattggtgagttgtttgttctgacaatagacatagagcaaaaaactcctgacttccagggcagggagatgagagtggagaggcaaaggccacttgagctttgattcagaagcacttgaagccttaagtatgagataagttacctccagaatgtgtgtgtggaagggaggggaggtaagaggaggggcaagcaacgtgttacgttcctggatcacctaaccaaaaatagagacactccccacccccagcactagagacacccccatccccagcactagagacatcccccacccccagcactagagacaccccccacccccagcactttgggaggccaagacgggaggattgtttgaacctaggagttcaagaccagcctgggcaagatggtgagatcctgtctctacaaaaaaaaaaattttttattagccagggagggtggcacgtgactgtagtcccaactacttgggatgctaaagaggactgcttgagcctcggaattcaaggcaacatcgagctatgatgatgccactgccctccagcttcggcagcaaagtgagaccctgtctctaagaaaaaagagagattccctctagcccccaccagcctcatcctatgtcatctaccatctgtccactctatttcctagcacttatcaatatatgaaatcatcttatataattgtttaattactttaatattccatccccaccacctccagattataagtgctatgaaggggccttcaggtggttcctcaccatgtcttagtagccagaacaggacctacctagcatatactcggtgcccagaaacattgtttaatgaataaaagagaaagagcaaaggatatcagagatttctgtaataaaataaaggtaaccatgtgttgggaacaggccccccaaaatctggccataaactggccccaaaactggccataaccaaaatatctgcggcactgtgacatgttcatgatggccatgacgcctatgctggaaggttgtgggtttactggaatgagggcaaggaatacctggcccacccagggtggaaaactgcttaaaggcgttcttaaaccccaaacaatagcatgagtgatctgtgtcttaaggacgtgctcctgctgcagataactagccagagcccatccctttatttcggcccatccctttatttcccataaggaattcttttagttaatctataatctatagaaacaatgcttatcactggcttgctgtcaataaatacatgggtaaatctctgttcgaggctctcagctctgaaggctgtgagacccctgattttccactccacacctttatacttctgtgtgtgtgtctttaattcctctagcaccactgggttagggtctccctgaccgagcttgtctcggcaaccatgtccaagtaattaatcattctgtggggagcttggggatcctgaatgcttcattccctgaaattgatgcatagtcagtgtatacattttggttagaaaatctgtgatgacatcatgaaaaatcagcattgttttcctgttccttttgcaatattaatagtaaaaacatgatctcctaggagcgttattgaacttttatgtacgtatgtatgtatctagagatggggttcttgctatgttgcccaggctggcctcgagctcctaggctcaagggattctgctgcctcagcctcccaagtagctgggactacaggcacacaccactgcccctggcctaaacttttagtgaatttatctattaaccatgtcttcttttctgtaatctgatgctttgacatctggggccttgctgaccctggaagggtcaattcctagagatactaaacaactcagtggtaagcatatttctcaaatgtaaaccaaaaactccagagcccaaacctaaccacctcctttatggagccctcatactctaggccaccacccacctgcccttaccaccccagggctgggtaccagacagctagggacagcccatgtgctccatagctcacagagtttactcaaactgggctgggtgcggtggctcacgcctgtaatcccagcactttgggagaccaaggcgggcggatcacgaggtcaggagatcgagaccatcctggctaacaacatgaaaccctatctctactaaaagtacaaaaaattagccgggcgtggtggcgggtgactgtagtcccagctactcgggaggctgaggcaggagaatggcgtgaacctgggaggcagagcttgcagtgagctgagatcacgccactgtactccagcctggccaacagagccagactccgtctcaaaaaaaaaaaaaaaaaagaatttacttaaactggccaatcctaaattgcctgctctgcctcatctgtttcttcctttggaaaccacaataaaggctcttgctacccacagtttctatcatcactcccccactcccccagccccctacctctagccttctgaccaaccctggcatttccctgtgtggcccccaatggcacgatgtgcccctttctcttgggaactgtgagtatcaaactgtcttttcaatggcagtcatctcctgatctgttggccttagtatacctaagattttctattactacattatattttaataacaatataccaattaaggccgggctcagtggctcacacctataatcccagcactttgggaggccaaggtgggcagatcacctgaggtcaggagttcaagaccagcctggtcaacatggtgaaacccatctctactaaaaatacaaaacatgagccaggtgtggtggcccacgcttgtagtcccagctactgtggaggctgaggtgggagaatcgcttaaaccgggaggtagaagttgcagtgagcaatcacgccactgcactccagcctgggtgatggagcaagattgcatctcaaaaacaaacaaaaaacaaaacacagacaatataccaaaacacagacaatatacagtgacatgttcaactgtaaataacagaaaacccaattcaaactgccttaagccataaaggagacaggatgtggattgagagttggggcagcctccagggttcgtttatttcagtctctggtgatgtcttcaaggccctactgtccatctgtcatctgggttctggaacagcagattgatcctttactcccaggcccacgtgcatctccttccaagcctagggagagagaccagggctcctctggaagctgtctgagaagaatgggcagcttcattcccaagagctcctgcaagtacctttgcaaaattggagtatgtgctcatccctggctaagaaaagaattatgttgatgaatttgggcctgagccaaatgacttccctggaatcacaagggcagtcagtcaactttccaagaagctcgtgagctgagaggagtcgtggacaccaagtcaagaaaagggaaaactcatgctcagtgacaccacaatgtccagtgcaataatataatagcagagagggacaaaacataagaaacggcacaggacaataatctgtgttgaggaaggtggtggtaccacatagctgctctaggtaccatatttgcaagtaaaattctctatctttattgtttatttatttatttatcttattttttgagatggagtctctctctgttgcccgggctggagtgcagtggcaccatctctgctcactgcaagctctgcctcccgggttcatgccattctcctgcctcagcctcccgagtacctgggactacaggcgcccgccaccatgcccggctaattttttgtatttttagcagagacagggtttctccgtgttagccaggatggtctcgatctcctgacctcatgatcggcctgcctcggtctcccaaagtgctgggtttacaggcgtgagccactgcacccagcgaaattctctatctttagtggcttttactagaattacaaggagacaacttcacttcttctgagatatggttctaattttgagatagccatgggaaaaaaaagtcattaaatttatattttatttctatcttacatttgcctgcctgatctttgagggttgtaaacctgatgggaaagaggtcatatattttaatagcatgttggcatttaaaatgccaagaagtgaaaaaaaaatcaggattccttttagcctgagaattttaatgcatgttcgttgcttttcttcaataattcctctcatttcacacgtacacaaagacatgacctcccccctccacccccgccaccatcggacacacatatttagtcctgggagagatgtggcatcaaatcagaagcagtttttctctaaagaaccagagtaaagaggctaatttaattagcgtccagtctggaaggaatgaaaacagcatagcatctgtaatgcagaaaggttatttgctatctgcctcttgaaaagatgtctgcttgatttgtgtcattctgctgccctcaacaatagagatttgctctcctctctgcaacagacatatttccaatcaccaagctcttgtggatttatgctctcttcctgatttaaacagcaactcccagaaggcagtctacatttcagcatcagaggatggagggttccttagacattctgcaagcatgtattgcatttatcaccaaattagaggtaattgtgagcacagaagaaaaatgatcaaattcacaaattacactgctaatttacccaactacaattatgttgaatatatgcattttgccttgatttttgcatttggtgaaagtcatatctgctatgaaaacaagactagcaagcaatatttcacgtgttacttctaataaaaacagaatgagaaaatggagaggaaagcactttgtaaatcctaaagcactatatagaagtgagttactctcagtgattccattgtttgctaagctttacttaaagaaaaaaaggttgcctagagaactgcataagtgagctcattttcttcctttactgacattctaaacgcattagaatgatctgttttttctacatattttaacatgttcagatggaaagtctcacccagataaatattttcacagtctaaaaagctgtctgctcccaactcagttttttttaatgggcaaaagacttgaacaaggacttcacaaaagaggtcatataaatgacaaacaacatttaaaagtgctcatggttaatcaccaaggaaatgcaaattcaatccacatttattgaccactacatgctcaactgaatggctaacattgataaaagctgccaatactggggatcaggctgggcgcggtcgctcacgtctgtaatcccagcactttgagaggctgaggcaggcccacttgaggcagaagtttgagaccagcctgggcaacatggcaaaaccccatctctactgaaaatacaaaacttagctgggcgtggtagtgtgtgcctataatcccagctactcgggtgggttaggcacaagaatcagttgaacccgggaggcagaggctgcagtgagccaagatggtgccactgtactccagcaacagagcaagactgggcaacagagcaagactctgtctccaaaaagaaaagaaaaacaaacaaacaatactgggaattggcaagggtgtggataaactggactctcccgcagtgccagtgagagtgtaaattggcccactgtaaaaactgttggcagtattgattatactgcttgaattcatgcacgccgtatgacccaaccctcccaggtatacacctgtggcaggcacaatgcagtgagccctctgtattcatgggttctgcatcctcagattcaaccaaactccatcgaaaatacagtcacagcatcacttaatgatgaggataatcgttagccaatttcatcatcctgtgagcaccgtagagtgtacttacataaacctggttggtacagcctactatatacctaggctatgcggtatagcctattgcccataggcaacaagtctgcacagcgtgtgactgcactgaatacagtaggcaattgtaacacaatggtgtttgtgtatctaaaactatctaaacatagaaaggtacattaaaaatacagtttataatcttatgggatcaccatatatatgtagcacattgttaaccaaaaagatatgttcatcacatgactatactggaaaaaaagaaactaacaataacaatacaacaataaaagtaatgcaaaatttaaaatacagtataacaactttttctttttgagacagagtctcactgtcactcaggctggaatgcagaggcaggatctcagctcactgcaacttccatctcctgggttcaagagattcttctgcctcagcctccccagtagcagggattacaggtgtgcaccaccacacctggctaatttttttgtattattagtagagatggggtttcaccatgttggccaggctggtctcgaacgccttacctcaagtgatccacctgccttggcctcccaaaatgctgggatcacaggagtgagtcaccatgcctggccaaaatacaaaataactatttacatagcatttacattgtattaggtattataagtaatctaggaatgatctaaagtatatgggagggccagacacagtggctcatgcctgtaatcccagcactttgagaggctgaggcaggcagatcatttgaggtcaggagttcgtgaccagcctggccaacatggcaaagccttgtctctactaaaagtacaaaaattagcaacgggtattgtggcaggtacctgtaatcccagccacctccacctcccaggctcaagtgattctcctgcctcagactcccaagtgtctgggataacaggcacatgccaccatgcccagctaattttttttgtatttttagtagagacggggtttcaccctgttggccagactgatctcgaacacccgacctcaggtgatccacccacctcagcctcctaaggtgctgggattacaggcatgagccaccacacccagcctctattttttttaagtataaaaataatttaaattttttaaaaagaagctctctgtttttattattaaactttaaaaaatttaaactaaagccactttatattaataacagtgaatttttttttttttttttttttttttttttttttttgttggagtcttgctctgtcacccaggctggagtgaagtggcccaacttggcacactgcaacctctgcctcccgggttccactgcaatctctgcctcccagattcaagcaattctcctgcctcagcctcccaagtagctggtattacaggcgcctaccatcatgcctggctaatttttgtatttttagtagagacggggtttcaccatgttggccaggctggtctcaaactcctgacctcaagtgatccgcccgccttggcctcccaaagtgctgggattataggcatgaaccacctcacccggcctaataatagtgatttttttttccttttactgtttagctaccctttgaattttcttttttctttttttttttttgatagggtctcactttgtcaaccagactggagtgcagtggtgcaatctcagctcactgcagccttgacttcctgagctcaagcgattttcctgccttggcctcccgagtagctggggctacaggcacacacgccaccatgccctgctaatttttgtattttttgtagagatgaggttttgccgtgttgccaagactggtctcgagctcctgagctcaagtgatccacctgcctctgcctcccaaaatgctgggattacaggtgtgagccactgcacccaaccctgatttttcatcacagactgttccccttaggccagaatagaaacatctagtgaaagaccaccaaacatcatggtacattttaataaatttaaacatataccctttcacagactctacttttaaattttaggtattattatttattttgagacagggtttcactctgtcgcccaggctagagtacagtggcatgatcttggctccctctagccgtgacctcctggactcaggtgatccttccacctcagcctcccaagtagctgggactacaggtgcacaccaccacatctggctaattttttgaattttttaataagagatggagtttcaccatattgccccagctggtcttgaactcttgggctcaagagttaaattttatttattatttacttatttatttaatgactatcagattcttctccccaaaagcaattaattgcattttcttctgtttcctttcagagattttctataattataaattacagaaaataaagaatatatatatatatatattaaaaaaagggctgggcatggtggcccacatccgtaatcccagcactttgggaggccaaggcaggcagatcacttgaggtcaggagttcgaggtcagcctggccaacatggtgaaatctctactaaaaatacagaaattagccagacgtggtggaccgtatctgtactcccagctacttgggaggctgaggcaggagaatcacttgaacccaggaggcagaggttgcagtgagccaagattgcgccactgcacttcagcctgggtgacagactgagactccgtctcaaaagagcaattgagcccgggtgcggtggctcacgcctataatcctagcagtttgggaggccaaggcgggcggatcacttaaggtcaggagttcaaaaccagcctggccaacatggtgaaatgccgtatctactaaaaatacaaaaattagtcgggtgtggtggcatgcgcctgtaatcccagccacttgggaggctgaggcaggagaattgcttgaactggggaggcagaggttgcatgagctgagatcatgtcactgcactccagcctgggtgatagaatgagactccatctcaaaaaaaaaaaaaaaaagcaattggatgtaaaaccatccctcatttaattagttcctctattgacagacatttgggttgttgccagtcctttgctattataaacaatgctgcaataaatatccttaaatatccattattttgcacaatcacaagttacttttcagtaaatttacttcaataaatattgatttaaaggtcagtggtagatgctaacatttgtttcctaaaatagacagaccatctactgagaagaatacacttgttaatgaatgtattcctccaatagatacttcagtgcctaactctggttagacaaggctgaacatgggggaaaaaaatcttacacctgtaaatgatttttgaaatgatgttttagttttttagggctgccgtaacaaagtagcacaaatgaggtggcttaaaacaacagaaatttatggtctcaaaattcttgaaactagagaggagaggacaggtggctaggacaaaggggtgtcgcagatgctgggatgggtggtggagggagtttcaaggaggagaataatcacatataatacaaaaggtaagtgggatgcaagcttagtaggagccactggatttggtaatgagaaggtttctgttgaccttagcagtcagattgcagtggatggaggaaagaatgggaagttagtaagtagggtgatattatctgaaaggaaaacaactccatcttctgacttaataatacgtttgaggttgataaatcacggtgctgacctcttttccctcctcctgttgggggatgtctgggacctcatttagtgcttccttctggagggaactggccttccaggtctgtctgacatgcgcagcactgatgctgacatcagcccttgtccttcaggggttcaaatgctacccatggctcagattctagctcaaagggcatctcttctcgaaagtcttccccagtctccccagctctaagtcatctttttgtcctctgaatctctacaatattcatctctacatctcttaaagtatactttactttaaatgtttattccttttattataatttttagtgcttttcatcttttcttcttaactagagtaagagttctagacaagattcatggatgattcaccttgatattcccaaagatatcatatttcttcacatttgcaccagatattaacatcaaatgcatgctggctattccataaatatttattaagtaaattaataaagggagataactggacccaacaagacaacataaaatagagtccaacaggccgggcaccgtggctaatgcctgtagttccagcactttgggaggctgagacaggtggatcactttaggtcaggagttcaagaccagcctggccaacatggcgaaacctgtctctactaaaaatacaccaattagctggacatggtggcaggcccctgcaatcccagctactcgggaggctgaggcaagagaatcgcttgactccgggaggcggaggttgcagtcagcctagattgcaccactgcactccagcctgagcaacagaatgaggctctgtctcaaaaaaaaaaaaaaaactagagtccaacaacctcacacggtgtgtatatctttaggttaaatgctctttgcagttaaaaacagcaattttgaagtcagcagaagcaaacaattagatgccaaacgtctaacccaatctgaagtatccaaaatccaggaagtaacacagatgtcaaccaagggtgaaattgctatagtaaaccacggtaatagggagccaggttgcatgggagagatgggtttggaagggcacagccaaaacgtagcctataactttctgtgattttgaggaagtacgcttgcctctcaaagccagtcgtcacatcactaccctgaagacagtaattcccctatgattgttatggggtatatatatatatgctatatacagggtacccgaaacagaagaagccctcaataaaaaataacttttaactgttatagcaataagatgaaatattatgcaaacattaaaatgattactctgaagaccatgtagcaacacgtcttgttatatatcagtaaatgtattttgctgattcattattgttagtatataatttaagatatttggctgggcgaggtggctcacgcctgtaattccaacactttgggaggccaaggtgtgcgggttgctttgagctcaggagttcaagaccagcctgggcaacatggtaaaaccctgtctctacaaaaaatacaaaaacttagtcaagcgtggtggtgcatgcctgtagtcccagctactcaggaggctgaggtaggagaaccacttgagcccaggaggtcaaggctgcagtgagctgagatcacgccactgcactacggcctgggtgacaaagtgagaccccgtcccccaaaaaaagaaaaaaaatttaacataccaattataataaaattataaatgtattacatattaataatacaccattaaattagagaaagcagaataaaaattatataaaactgctagttatacaacaatataagaaattatgcatacttgttaacaagatcaaaatgcaatctgcctgggcgaggtggctcaagcctgtaatcccagcactttaggagaccgacgcaggtggatcagttgagcccagaagtttaagaccagtctgaccaacacggtgaaaccctgtctctattaaaaatacaaaaattagccaggcatggtggcatacgcctgtaatcatagctactcaggaggctgaggcatgagaaacacttgaactcgggaggcagaagttgcagtaagctgtgattatgccactgcacttcagtctgggcagcagagcaagaccctacctaaaaaaaaaaaaaaaatgattgaaggcattataaagataagaatatcattattcattactacagatgcctcagaaagaaaaaggattgatcacaagttataatgaactagtatgaacaattatatgccaacaaatttgataatctagaagaaattgataaattcctagaagcatgtatacaacctatcaaaactgaatcaggaaaaagtagccaaaaccgacaattcacaaataagactaaatcagtaatcaaaaaccttccaacaggctgggtgcagtggctcatgcctgtattcccaggcatgtattcctagcactctgggaggttgaggcgggcagattgcttgagttcaggagttcaagaccagcctgaacaacgtagcaaaaccccatccctactaaaaacacaaaaaaattagctgggcatggtgtgcatctgtagtcccagctactcaggaggctgaggtaggagaatcacctgagcctgggaggttgatcctacaatgagctgagatcatgccactgcactactgggcatgattaggcgacatagtgagaccctgtctgaaaaacaaaaaaccttccaacaaagaaaagcctaggaccagatggcttcacaggtgaatcctaacaaacattcaaaaaaagaattactatcaatccttcttaaactcttctgaaaaataaaagagagacaacctccaagaccattttatgaggttcacatcaccttaatatcaaagacaaagaataacactaagaagaaaaccacaggccaatatacctggtgaacagagatgcaaaactcctcaaaaaaatactagcaaactgaattcaacagcacattaaaaggatcatacactacaatcaagtgggatttatccctaggatgcaaggatggttcaacatatgcaagtcaatgtgatataccacattaacagattgaaatataaaaactacatgatctactataaaaactacatgttctactataaaaacagattgaaatataaaaactacatgatctacaaaaactactgcatcatttcaataggtgcagaaatagcattcgacaaaattcaacatccattcatgataaaagctcttaacaaaataagtatagaggggacatacttcaacataataaagatcacatatgtatttccatgaacagttcacaaaaataaaaaaaaaatatatgaaaggccatagctaacattgtaatcaatacggagaaactgaaaggtttttctctaatatcttatcttagctacaaatgcccactaacaccacttctattcagcatagtactagaaatcctaaccagaacaattagacaagaaaaagaaataaaagccactgaaatcagaaaagaagaggtataattacctctgtctgcagaccagcctgggcaacatatctcccccaatctctacagtaaaaaaaatttttagttagctaagcgtggtggtatgtgcctaaagtcctagctatttgggaggctgaaacgggaggatcacttaagcacaggagttagacgttgcagtgagctgtggtcatgccactgcactctagactgggcaacagagcaagaccctcaagaaatcaaaaagaaaatgaagggtgtgtgtgtatgtgcatatatatatatatgtaatattcaatggactattatttagccttaaaagaaaatgagggctgtgtgtgcgtatgtgcatatatatatatatatatatatatacatatatacatatatatatacacatatatgtacacgtaatattcagtggactattatttagccttaaaaaaagaaggaaattctgccacttgcaacgtgggtgaacctgaaggacattatgctaagtaaaataagccagacatagaaagacaaatagtgcatgatctcacttatgtagattttaaaatagttgaactcacagaagcacacagtagagtggtggttgtcaggggttggaggatgggggaagtggggaaatgttggtcaaagggtacaaagtttccattatgcaggatgaataaattctgtgaatctaatgtacggcatggtgactatagttaacactgtattgtatacttgaaatttgctgagagtagatcttgtcttctcaccacacacacacacgcctacacacacacagaggtaactacgtgaagtgatggatatgttaactagcttgatgtgatgatcatttcacaatgtacacgcatatcaaaccatcaagttacacctgttaattatatacagtttctatttgtcaattatactccactaagcttttttttttttcctttaaagtagagacaggggtttcattgttttgcccagggtggtttctaactcctagattcaaggaattctcccactttggcctcccaaagcgctgggattacaagtgtgagccaccgtgcctggcttttttacaaagctttattgggcaggacgaggtggctcatgcctgtgatcccaactgctcagaaggctgagatgggaggattgcttgaggccaggagtttgagacaagcctgagcaacatcccaaaaccttgtctccaaaaaaatttgtaaaaacatttagctggttacggtgcatgcctgtagtcccaactactggggaaactaaggaaggaggatcccttgcacccggaagttccagctgcagtaaactgtgatactgccaccgtactccagcctgggtaacagagcaagaccccatctctaaaacaaacaaacaaaaaagcttttaaaaaaagaatacagtttaatgttgaatcagttaggactctttgttactgttatgggggaaaagaatctgaacttgaactaacttgggccaaaaatgaaatttattttctcccagatcccaggaaaggattgagcaatacagctatagaagggcaggaatccagctggcccacagaacagctgggaccaggggtttcaacatcttcaggagcttcttccatctccagatcttgccgttggcctcattcctattcaccacaatgagatttgtctacaggaagaaaacagggctccccaatgcacagtttccaacttctgcccccaaagagggaatccctatgttccttcttctcaaacaagggtgctcttcagcctgcgtgcactgctgcacccatatcaattgtttttcagccaatgtctgtcctaattggtgggtacccggatctccctgattgttgcagatattgataatcacccctggaatcaggttcaaatatcccagagaagaggatcattggtactgtttttctctaatcagccctaggcagggccaggccatgtcagagcacagctgctcccacaggaatcatcaggttaaaggaacagaaagagcgattcccaaatgagggttggtactgggcagatcaaaaaaagacatgctggctggtcacagtggctcacagctgccctctcagcattttgggaggctgagatgggaggatcacctgaagccaggagctcgagaccagctggcaacaaagtgaggcctccatccctacaaaaaaaaaaaaaaaaaaaaaaaatatatatatatatatatatatatatatgtatatatatatatatatatatgtatatatatatatatatatatatatatatatatatatgcacacacacacatattgtctgggcacagtggtacatacctatagtgccagctacttgggaggctgagatgagagattgtttgagcccaggaggtcaaggatgtagcgggccctgatactgccactgcactccagcttaggccacagagtgggaccctgaaaagagagaaagagaaaaagaaagaaagaaaggaagaaaggaaggaaggaaggaaggaaggaagagagaaagaaagaaaagaaagaaagaaagagaaaagaaaaggaaagaaagaagaaagaaaagagaaagaaagaaagaaaggaaagaaaagaaaaaagaaaaaagaaagaaaggaagaaaaagaaaagagagaaagaaaggaagggagagatgggaggaagggagggagggaaggaaggaaggaaggaagtctactataagtgtacttgtagtttttattttccaaaattttaaatttccaaaatttaaaaattactataacttttaaaaggaaaaaaataattgtaggtaccagaagccccatctttcttcgttttacttctactctgtcttagaatgccatcagcagctctgtcccatctacgaataaacatggtcacaccgtattagaaattccctaagaaacagggggctattgatagccagcttagtgttacctaccctggttaagcaagaaaataagtcactcatttgatgttagaacaggttcctgtttgatgtatccagtttcctctaaaagtttcagcatttgggttaaattttattcagtgatagccacacttaatctccccaaggcactaaccagaaaaaaatcaggccctgactttgctatccaggcccatctagacatcctaatcttttccctcagcatatgtagagaattcaaaaattaacttgcatacaaatgcagagaatctatttccaggttctgtctaaagccttttagtaagatcttccaaattcttacttttgaatatcccctagcagtgaaagataacttgactgctgagatatcattcacagaagagatgagaaaaatgattaatttctgaacatgttcaatttcatacattcttgagctcataattgagtggttgagttctagttcttccaggtacaatcacaccacagagacatgattttaaagatgaagttttagtgagggactaataaatttttcaggccagctctcaaggctttctcaattttctacatactattaaagagcaatacatgcccagtgattagaatgcatgctagtgcccctgggcatagaaacatctggataacaaaatggaatccaccttaagtgtctaaacagcaagctaacaaaaatgaaaacagcaagcaggtgaacagaacaatcccggggcagcagcctaatccagagtaatccattgccatgacagcaaacatcacagaaacttccagagggtgttcagggcacatgttccatgagaaatccttgatccctttgtggtttgcttctttccttagtgtttgcagtgggaccgtattcccaggttatgggccttttcaaaaatgcaccagaaaagctctctgccaggccacgtgcatagcatggtagagaaaacaccctattgcagattgctagtttaaatgaaggctaaccaaataaagaatcaaactaagatgcaaaagttagaagtatgcccaatccaacctgctggagaagtaggatcataaatgttaataaagaattgtagactgggatcgttttataaaaataaattttaaaggccgggtgcggtggttcatgcctgtaatctcagcactttgggaggccgaggtgggtggatcccttgaagtcaggagttcgagaccacctggccaacatgctgaaacccctgcctctactgaaaacacaaaaactagccagatgtggtggtgcatgcctgtaattccagctactcagaagctgaggcaggagaattgcctgaacccgggaggtggaggttgcagtgagccgagatcatgccactgcactccaccctgggtgacagagtgagactctgtctcaaaacacacacacacacacacacacacacacaattaatttaaaatttcatgcataggcccagacatgatggctcatgcctataatcccagcacttttgaggccaaggcaggaggatcacttgaggccagaagtttgagaccaacctaaacaacacagcgagatcctatatctctacaaaaacatttacaaaaattagctggttatgatggcacgcatctttaatcttagccactcgggaggctgaggcgggatgattgcttgagcccaagagttcgtggttgcagtgagctatgatcatgccactgcactccagcctgtgtgacagagcaagaccctgtctgaaaaaaaagttatgcataatcaactaattctagagttcgtaactttcttcaatactgttttttttttttaatattacaatggcatctgtccaattctccacagggaaaagtgtcatggtctttcatcagatgaaaggtgcagtctggatttcagtcaacatgatagaacattgtacccctccagattcacaccctaagtgtttgggaattaaagtcccccaatctttttcttcttattaaatcacaagggccgtactggcatggtgattagcaattctggcctggaaaaaaaaaattctagcacagctgcaagaaaacagacaaaaagaacagctgggaagacctggcctatttttgctttgcatttagttggcaaaacaaaactcccttctggaggaattcccactttattccaccacatttatcatctccttttttctatttctttttattcattttttctttccttaatattgctgtctttttcttcacagagtatttccttattttttcattcatttaacaaatatccattgcatgcctagtataggtgagaaactctgccaggcactgtaggatgtagaaagataagttaaacatgagcactgacatccaaaaccttattatcctaatagacggtgtgactggtatgtaaataagtcaaatcaaaagtaaaaggtggccaggtgccgtggctcacacctgtaatcccagcactttgggaggctgaggcaggtggatcacttgaggtcagaagttcgagaccagcctggccaacatggtgaaaccccatctctactaaaaatacaaaaatcagccaggcatggtggcaggtgcctgtagtctcagctacttgggaggctgaagcacgagaatcgctggaacccagaaggcagaggttgaagtgagctgagatcacgccactgcactccagcctgggtaacagagcaaggctctgtctcaataaaaattaaaaaaagtaaaaggtaggtgataagagaaaaaataaatataaagtgacatagaaactcaggagagcaattcattccagttggagggcttagtgaaagcctgtagaggaggtgtctgaataaagggcattctgggcagaaaacaaaacaaacaaaccaaaaaaagcccagcatgagcaaaggcaataatctctaaaaaacatggagcgattgaatttgactagagcatcagtgctcaaggtgtggtcctggaccatcaggaccagcatcatttgatatcttgttacacatgtaaatccttaaaccccaccccaggtctactcaatcaaagactctgtggtaggacccagcaatttatgatgtaacaagccctccaagagattctggtgcatattcaagtttggaagtcactgaatcaaggtataggatacctggcgtcagaaatctgcttgaaaagtaagattggaataaataaaagaaaatcaactttaaaaggatagttaggtgctagctttgacagcatacacactaaagttagaatgacacagagattagcatgccctctgcaaaaggatgagatgcaattttgtgaagcattctaatatttttttaaaaggaaggtggaaaaaatagacaaataggactacataaaacttaaaaacctttgtgtgtcaaagaacataatcaatgaagtaaaaagggaacctatagaatgggttgaaatagtagcaagtcatatctgaaaaggggttaatgtgcagaatgtataaagaactcctaaaactcaacaaaaaaaatccccagtttttaaaagggcaaacgacttgaacagacatcatagacatctctaaagatgctatacaaggctggctgtggtggctcacacctgtaatcccagtacttttggaggccaaatcaggtggatcacttgagatcaggagtttgagaccagcctggccaacatggtgaaaccctgcctctactaaaaatacaaaaattagcccggcatggtggcacatgcctgtggtcccagctacctgggaggctgaggtaggagaatcgcttgaactcaggaggtggaggtcgcagtgggctgatatcacaccattgcactccagcctaggtgacagagtgagaccgtgtctcaaaaaaaacacacaaaaatgatacacaaatagccaacaaacatatggaaagatgctcaatgtcactagtcaccagggaaatgcaaatcaaaacctcaatgagatatcacctcacactcattaggacaagtacaattaaaaacaaattaaaaacccagaaaataacaaggccaagatgtggagaaatcagcatccttgcacactgttggtgggattataaaatgttgcaacctctatggaaaacagtaggcagcttctcaaaaaattaaaaatagcactattatgattcagcaattccacttctgggtatacatccaaaagaattgaaagaggagtctcaaaaagatatttgcatacccatgttcacagcagcatttattcatggtacccaagaggtgaaagcaatccaagcgtctaccaaaggatgactggagaaacaaaatgtggtctatgcatacaatggaatattattcagccttagaaaggaagacaatccagctgggcacggtaggtagctcacactggtaatcccagcactttgagaggccaaggtgggcggatcacctgaggtcgggagttcaagaccagcctgaccaacatggaaaaaccccatctctactaaaaatacaaaattagctgggcgtggtggcacacgcctgtaatcccagctaactcgggaggctgaggcaggagaatcacttgaacccgggaggtggaggttgctgtgagccgagattgcgccatcgcagtccagcctgggaaaacaatagcgaaactttgtctcaaaacaaaaacaaaaacaaaaacaaagcaaaacaaaaaaaaaggaagaaaatcctgttacatgctgcaacatgatgaactttgagaatattacggtaagtgaaataagcaaatcgcaaaaagatgaatactgtatgattccactaatatgaagtagtcatcaaatttatagaaacaaaaagtagaatggtgggtaccaaaggatgaggaggaggaaaggggaagttattattgaatgggtataaagttttgaatttgcaagatgaaaaagactgggagatctgtttcacaacaatgtgaatacacttaacaatattaaactgcacacttaaaaatggctaagatggtataatttatgctatgtgattttttagcatcagtgtttttttttaacaggaaggtgggataattgagggcttgaaattctaacaccttttccttccattggtcaatccttccattggtctattaatcctttcttttcttacatttgatcttgagctcttatgtgttggaagtattttttttttatttttgcttttgtttttactattacttcaatctctttgtgataggtctcttcagatttccatttcttcttggatcagtttacatagtttgtgtctctttagaaatttgtctatttcatatctgctgtctgatttgtttgcatacaattgttcaaaatatcccctcataatttttttttatttctgtagagtcggaagtaatcaagtcttctttttttcttggttagtttagctaatattttgtcaattttgttggtctttccaaagattaacattttgttttgttgattttctctcttgtttttctattctgtatttcacttatttccattagagtctttattctatccttccttctacttgtttttgggtttagttttcccttccttttccagtgtcttaaggtgaaagtttagattattgattttagctctttcttcttcattaatattggcatttacagctataaatttccctctaagcagcaggttagctgcatcccgtaagtttgggtatactgtgtttttattttcactcatctcaaactattttctaatttctctaattactgagattcagccatttttcttgaatgcatacttcctgaattcctgccagaatttgattaatttctagagccctaaaaaagttgattcttcccttttttgccagttttctcattattttcatagaggagaaatttttcagaggtcctttctctgacatttttgctgacatcttccttccttcctttctctctttctctctttctttttctgagacagaatctcactctgtcacccaggttggagtgcagtggcatgatctcagctcactgcaacctctgcctcccaggttcaagcgattctcctgcctcagcctccggagtagctgggattacaggcacctggcaccacgcccggctaatttttatatttttagtagagacagggtttcatcatgttggccaggctggtctcaaactcctgacctcaagtgaggagttcatttggcctcccgccttggcctcccaaagtgcagggattacaggtgtgagccactgcgccctgccagacatcattttttcttgcatttcaaaccttggtgggagctttcctccctcagctcagtggtatcctcatggcctgggacaaggcctctggcctcttttctctgaacatcactgtcctagtctgctgggactgctgtaacaaaatattatagactgggtggctcatacaacagacatttagttctcacagttctggcagctgggaagttgccctcactgaggaactaaataggcaggcaccctgatcttggacttcttacatcattaattcaaatgcaaagggatttactctgagggaaactgatgaaagtttttcttggctttatgctgggggcggtactaggagacgtcaccctgtgaggtcactctcagttcctccctcctcctttctcttacctttcacccagtccctgagataaggcaggtttggagcccaccaagatgatttgatcattccttgggcttagtctgaagcgattcaagaccatggttcctgctgatcgagtggcaagagcattggctttagagtccaatgtaaattggcctaaactcagctgtgccacccactgcataggtccctggtaagtcccttaccatccttgagcctcagtttacttttccgtaaaatgggggtaatactattcactttagggagttcctaaaaagattaaattaagtaatgtatgcatttgaagtgcccaagagactgccaaacttctagatagggcttgatcataattatgcctcagtattatgcagtaagggtgacttacatagccttgtcaataatcttttcctttattaaataaatagttctctctgaaagttatttcttatatttaatctcaattccagattgtatttatttattttttattttatttatttattttttttctgagatggagtcttgctctgtcaaccaggctggagtgcagtagcatgatcttggctcactgcaatctccgcctcttgggttcaagtgattctcctgcctcagcctcccaagaagctgggattacaggcgcccgccaccatgcctggctaattttttttgtatttttagttgagacgaggtttcattggccaggctggtatcaaacgcctgacctcaggtgatccgcccacctcggcctcccaaagtgctgggattacaggtgtgagccactgcaccccagattgtatttaacgcctttccttcagtcttagctagaaaaatagaaaagaaaaaggaaaagaaatggctgctaacactgcctccagaacccttcccagcctgcattaaagctgtcccttggtcgccttatcattaatctagatgtctttgctcagcctctctgctctccgtctctttactcctcctttgataatcctttacccactttcatgttgctctttcttgcatctcttcctatgtgtattaactgatgtattctgcaggtcagtggactgcaaaggtcaaagtctgtgtgtctgagacttggattcagctgtcagcccccagcctcttagacaattcaagacagggttaaagttgcaatcagagacaatgaggctgcaagagaaacaaaggctggatttgatgggcaactgggacagctggagatgacaaaatctctttagactgatttttcctgaggtcaaaagacttgggagggtggggtagagcaaggagtgttcaagaataactgtaaacatgagccttgcacacatataaaacacgggtcagaaaatgctaggcctatttcattaattttcacaaaagattccctcagacttttcagtctcttttttaagtaatcgatgcatgccctaaatcccattcattcattcttcttttatttgtttatttttcattatctgccctacccgatttattatgcacttaattgtcatattcccttttgttactggtttctttgccacttttctgactggtcactcttgtcctcattacagatctttcaaggccatttatttgatataatgaaaagaatgaagtttggaatctgatggttcagccactaggagttgcacaaccttcaacaagtgacaataggcctgtttcacaatgacctcccagaactgttagagctctaaagcacaaccaacctttacttagcaaagcctgctcttggagttggtgttatggtttgagttctgccctccccaaatttatattcctaaaatttctaacccccaatgtggaatgtgatggcatttggagatgggcgtttgtgaggtgttaataattaggtttagatgcagacgtgaaggtggggcgctcatgatgggattagtgcccttataagaagagacacaagacagcttggtctctctctccctctcttcctctccacgtgaggaaacaaagggacggggccatctgcaagccaaaagagaaccttcaccaggaaccatataggccagcaccttggtcttagacttcccagcccctagaattatgagaaataaatgactgtagtttaagccacccagcctgtggtattttttcatggcagcgccagctgactaagaaaatggattttcaggaataaagatgagcttgattttcctcatgaccaatggctggcatttgtgagtaagagaacttacactctatgtctgtggtgaaaatagaggtaggtagcactgggtgtggtggcttacacctctaattccagctattctggaggctgaattcggaggatcgcttgagcccaggagtttgagtccagcctgggcaacatagcgagaccttgtttcaaaagaagaaaaatagaagtagataagtttcactgtcccaggatctaccatcaaacctctagacaatgtagggtcttaccctgatttcattcacatcagaatcatcgggggagttgttttttgttttttggctttttttttttttttttggagtttcactcttgtggcccaggctggagggcagtggtgcgatctcagctcattgcaacctctgcctcccaggttcaagtgattctcctgcctcagccgcccaagtagctgggattacaggtgcctgccaccacgcctggctaattttttgtattttttttagtagaggtggggttttgccatgttgggcaggctggtcttgaactcctgacctcagatgatctgctcgccttggtctctcaaagtgttgggattacaggcgtgagccaccatgccctgatttttggctttcatcatagtacctcacatccagagcgtctatgatttcggcctgtggtctctccatgaaggggtcaggagtgagaagggggccctgaaattgattgactgcatgcactctgccaggcactgtctgtgtcaggcattcttcacacacatcattctgtctgttcattctcacagtaatcccatcaagaagatgttaacagccccattttagaaaggaagaaccaggtttcagcagtcctgcccaagcttccacagtcataaggtagagctaggattagaacagtaacaaaataaattagcatactcttgaaggaaaagaaaaaaaatggcaacagctaatgtttctctcctgggcttaatgccttgcatcttttatctcatggaatcctttcaacaatcttttgtacattggcttttttttttttttttgagatggagcctcgctctgtcacccaggctggagtgcagtggtgtgatctcggctccctgcaacctccacctcccaggttcaagcaatcctcctgcctcagcctttcaagtagctggaaccacagacgcctgccaccatgcctggctaatttttttgtatttttagtagagacggggttttgtcatattggccaggctggtctcgaactcctgaactcctgacccatctgcctcagacttccaaagtgctgggattacaggcatgagccaccgcgcccggcctagattgtcttttatatccccacttcacacatgataaaacagaaatgaaagtgtagagacattaagcaatccatccaaggtcacacagcagtagagtcggatctgtctggcagtaaaggctgtgatcttggccacagtatgacacactctcatccttcccttcacaaagtccacacccattgtatatgtgccacccctgtgactcaggtgctcctgtcacttgcaatttctctctttacgtttcaattaatctttttttgtttgttttttgttttgagacaaagtcttgctctgtcacccagactggagtgcagtggcgtgatcccggctcactgcaacctccgcctctgggttcaagtcattctcctgcctcagccttcccagtagctgggactatagacgcatgtcaccatgccccgctaatttttgtattttttgtagagacagggttttgccatgttgtctaggctggtctcaaactcctgacctcaagtgatccacccacctgggcctcccaaagtgctgggattacaggcatgggccaccatgcccagccctttcaactaattttatgagacatacccaacctgacaaggaagatccaggcaagcctcactgatgcgcattgctcatctctaacacaacccagccaaagtcactgatggagagagaatctcttccataaattagagcacaaagttgttgaatcatagttaatttatccaagaataaacatttctgttggtttctgaacatttgatttagaaattacacagacttaaaggaagcatttatagtcactgcaatgacacagtgaatgtcagatgcaggtcctagttattaagcacatttgaaagaaagaaagctttatccagtttgaattcaagaggctttacaaaaaaatgcatagctaagataatcagtaaaaagaggagttaggatttttgaatacaaggcaagccagtttcaacctcattttatcctctgcctgtcctcccattcatcttgataatgctttgccaagtcactgcaagcttttgcttgaattaactagccatattttattatgtccagaacacacactaacagagactgcagaacaaagggtaaaaatcaaggataaagggaggaaggacagctctgtattacaggtagaagagtctcttcacttctactgcagattgagtcgggagaaactgtgactaagaatagctacacggccgggattggtcatacgagcccacaggcactagcagctgaggtggctgctgtctgtttaaattgctttccggtggcaaacacttaattgtaatcgagacagagttcaggtttattttctgctcgttccctgcatcctgctcttgttctcgataagcttttcccctgccctggcgcccactgcaccctccatttcccaaggagcccagctagccccgacaatgtgattaagtgttctctgtagacgtgagtccttgcttctgctgggtgcctctctgtgtcagcagcaaatcagcctgcagaccaggggtagtgtttctggaggatcaggtgagaatgcctggactctgcacagttggaagctgttcatgagataatggtacctcttgttttcatgtgcagctttatatcaacagtccctcggtttctcccattggaaatcagctacagatatgagccgtgtaagaatataagtactgtaggctgggtgaggtggctcacacctgtaatcctagcactttgggaggccaaggcaggcagatcacttgaggtcaggagttcgagaccagcttggccaacatgatgaaaacccatctctactaaaaatacaaaaattagctgggcatggtggtgtacacctgtagtcccagctacctgggaggctgaggtaggagaatcacgtgagccggggaggcagaggttgcagtgatccaagatcacgccactgcactgcagcctgggagacagagggagactctgtctcaaaaaaaaaaaaaaaaaaaaaaaaaaagaatgtaagtattggatgtcctggccagagcaataaggcaagagaaataaataaaaggcgtccaaattagaaaagagaaagtcaaattgtccctctttactgctaatatgatcttatatctagaaaaacgcagactccaccaaaaaactcttaaatctaataaataaattaagtaacattgtaggatacaaaattgatgtacaaaatcggtagcatttctatacaccaataatgaactagctgagaaaaaaatcaagaaagcaatcctatttatagtagctataaaaaaagaataaaacactcaggaatatacattcaacaaaggaggtgaaagagctctacaaagagaactacaaaacactgatgacagaaactgaagtggacacatacaaatggactgacatcccatgctcataagctggaagaaataatatcattaaaattatcatattggccaggcgtggtggctcacgcacgcctgtaatcccagcactttgggaggccgaggcaggtggatcacttgaggtcaggagtttaagaccagcctagacaaacacagtgaaaccccatctctactaaaaatacaaaaattagctaagcatagtggcaggcgcctgtaatcccagctacttgggaggctgaggcatgagaatcacttgaacccaagagctggaggctgcagtgagctgagatagcaccactgtaccccagcctgggaaaaagtgagaccgtcaaaaaaaaaaaaaaaaaaaaagaccacattgcccatagcaatctacagattcaatgcaatccctatcaaaataccaatatcatttttcacagaattagaaaaaaaaatcataaaattcttatggaaccaaaaaagagcctgaatagccaatgcaattctgagaaaaaagaacaaagctggaggtatcacactacctgacttcaaaatatgttacaaagctatagtaaacaaaacagcatggtattagtataaaagacacatacattgatggaacagaatacagaatacagaaataaatacatgtatttatagccaactgattttcaataaaagtgccaagaagatacactgagggaaggacactctcttcaataaacggtgctgaggaatgaaagtggaccctatctctcaccatatacaaaaatcaactcaagatggattggagacttaaatataagacccagaactaatagaagaaaacacagggaaaatacttcaggacattagtctaggcagattttatggctaagatctcaaaacaacaaaaaactaaaacaaaaatagacaaatagaactatattaaatgaaaaagcttctgcacagcaaagggaacaatagagtgaagagacaacctgtcgaatgggagaaattatttgcaaacattcaccctgcaagggattaatatcctgaatacacaaggaactcaaatgagtcaacaataaaatgtttaaaatgagcgcggtggctcatgcctgtaatcccagcactttgggaggccaaggcaggcagatcatgaggtcatgagttcgagaccagcctggccaatgtggcgaaaccctgtctctactaaaaatacaaaaattagccaggtgtggtggcgggcgcctgtaatcccagctacttgggaggctgaggcaggagaatcactagaacccaggaggcggaggttgtagtgagctgagattgtgcgattgcactccagcctgggcaacaagagcaagactccatctaaaaaaaaaaaaaaaaagtcccattaaaaagtgggcaaatggccaggcgtgagggctcatgcctgtaatcctagcactttgggaggctgaggtgagtggattgcttgagtctagaagttcaagaccagcctgggcaacatggtgaaaccctgtgtctactaaaaatacaaaaaattagctgggcatggtggcacatgcctgtagtcccagctactcagagggctgaggtgggaggatcacctgagctcaggagatcaagactgtagtgagccctgatagtaccactgcactccagcctggacaacagagtaagaccttgtttaaaaaaaaaaaaagtgggcgaatgacaacatatttctcaaaagaggacatacaaatggccaataggtacatgaagaaacttctagactcaagcaatccactcacctcagcctcccaaagtgctaggattacaggcataagccctcatgcctggccatttgcccactttttaacgggaccttttttttttttttttttttttgagatggagtcttgctcttgttgcccaggctggagtgcaatggcacaatctcagctcactgcaacctccaactcctgggttcaagcgattctctgcctcagcctcccgagtagctaggattacaggcgctcattatcactaatcatcagagaaatgtaaatcaaagccacaatgagataatcacattaccccagttagaatggctattaatgagaccgcttttgcaaagattctgacagtgagagaatctagcatggctgactcgaccttccttctagcctcgcaagctggctgtctttgctgattcctggtcacaggccaagctaaccataggaggaatttagtttacatttaacttggaagcaaagatgataatagtccctccttaaaactgacaccctctttgctcaggggccaaaactcacctttgtgaaaggtgattaggattgaccgggcgcggtggctcacgcctgtaatcccagcactttgggaggcagaggtgggcggatcatgaggtcaggagatcaagaccatcctggctaacacagtgaaaccccgcctctactaaaaatacaaaaaaaaaattagccggatgaggtggcgggcacctgtagtcccagctactcgggaggctgaggcaggagaatggcgtgaacccgggaggcggagcttgcagtgagccgagattgtgccactgcactccagcctgggcgacagagcgagactccgtttcaaaaaaaaaaaaaggtgattaggattaaaggaggggcctgaattccgctaaaatgtagacatagtttctacaattgcttactgtgagaagccatgtggccagaggtcacaaaatttatgaacttccccaattgcttctataggtaacataattatcgtagaacctaagattggtcttttaagatgtttttcggactttggtgttctggcaaccgactgacccaacctggacctgtgactcatgactcaaccagtcctgtggccccacccagaagcagactcagtacaggacaattttccacacccctcggacttcatccttaaccaatcagcagcacccattccctaggtctttgcccaccaaattattcattaaaactctagcctctgagttctcagggagatcaatgtgagtggtaactagttctttcacgtgactggccttgtgttaattaaactcttactttactgtaacaccacagtctcagcaattggttttgtctgtgcagcagacaggaagaatctgtcaggtaatcacattattaaaaagaccaaaaataacagatgctggtgaggatgctgagaaaaagaaactgtacacagttggtgggaatgtaaagttgtacaaccattatggaaaacagtatacagatttctccaaaaacaaaaacaaaaccactattcaatccagcaatcccattactgaatattttacccaaaggaaaataaatcggtatatcaaagggatacctgtacttgcatgtttattgcagcactattcacaatagccaagagatggaatcaacctaagtatccatcagtggatgaacaaataaaggaaatgtggtacatatacacaatgaaatactattggtttatgaagaagaataaaatcatatcatttgtggctggggtcagtggctcactcctataatcccagcactttgggaggctgaggagggcagatcttttgaggtcaggagttcgagactagcctgcgcaacacggcgaaaccctgtctctactaaaaatacaaaaaaattagccaggcatggtggtgcgcgcctgtaatcccagctactcgcccagctactcaggaggctgaggcaggggaactgcttgaacctgggaggtggaggttgcagtgagtggcgatcgtgccactacactccagcctgggcaacagagcgaggctttgtctcaaaaaaaaaaaaaaaaaaaaaaaaaatatatatatatatatatatatatatatatacatacataaatcatatcatttgcagtaacatggatggaactggatgtcattatgctaagtaatataagccaggcatagaaagacacaaattgcatgttctcactcatatgttggagctaaaaaacttgatctcgtggaagaagagagtagaacgatagataccagacgctgggaagggtatgcaggtggaaaagggtagatgaagagaggctggttaatgggtacaaacatacagttagataaaagaagtaagttataatggtcaatagcagatgatggtaactatagttagcaacaatttattgtatatttcaaagtacctagaagagaggacttaaagtattaccaacacatagaaataataaatactctacagtatctacttcccaaaaaaagaaaaaataaataatcatcatggggtgatggataccacaaataccctgacttgatcattacacattctatgtgtgtaacaaatactcacatgtaccccataagtatgtaaaatactataaaagaaaaaaagaatataattattgacttcaagatcccattttggggccgagcaatgtggctcatgcctgtaatcccagcactttggaggccgaggcaggaggatcatttgagcccaggagtttgaggccagactgggcaacatagtgaaatctcatctctacaaataatttaaaaattagccaggtgtggtggcacacacctgtggtcccagctactcaggaggctgaggtgagaggatcacttgagcccaggaggccaaggttgcagtgagctgggatggtgccagtgcactccagcctgggcaacagagagagaccctgtttcaaaaaaaaaaaagaaaatcctatttgggtctttcttgctgttattaacttaaaaacttaaaaagtgtgagtatagcttactcacacttcccattttacctaagctcctaaggagagcctcaggttggagcatatgcaggtgaagaatctaggacaaaacacttttctgtaacttacccaaggaaatgccatattaatattagctttgagtttcagtgtaacctgtccctggcaaacatttcttatggtttctgctgttacattgggtacccttccttcttgtcttttgaggttagatatgttcctcctgacgaaattgttagtaatttcttttaacgctcttttaacgttctttcttttttttttgagacaggatcttgctctgtcgcccaggctggagtgcagtggcacgatctcagctcactgcaacctctgcctcccgtgttcaagtgattctcctgcctcagcctcccgagtagctgggattacaggtgtgcaccaccacatctggctaatctttttatttttagcagagatggagtttcaccatgttttccctcctggtcttgaactcctggcctcaggtgatccacctgcttcggcctctcacagtgctggaattacaggcatgagccactgcctggccttttacattatttcttgatgatcaattgagtggacttgaaagtcaaattacctaatttgactttaagataccagattgctaaaccagttcttccaaaagcagagagctcaggctgccccaggtggccagccctgggagagtggggagcagccacagctccccctgtagcccacccccagcaggtcttccagggtggcttgtggctggcctcaccaccaggaaagggataagtctgcagacctgtatcctggtcaagactcaactggctacaaaagagcttcccaaccagctcccagaacccaaggacgggaggctcagatgcctcccagaaggaaaggaacccaggaactggaccggtttatgaacaaaggcagctgccccctgggtttctctcttccctcttctgagaagtcatctgtttctctctactgtgtctacttcactcttctttctatgcagactggattctttcattgctgctgaaagtgtgctgaaaaaaaaaggaaaattccaggcacagatgatatccttctaggcaaggacttggcatccctgaattcagctgtgttccctgaaaccaaagagtgtagggagaggaagagctttgtaggcagaacaaatggcatgcgcagaggtatggaggtgagagaggtgtggacagattcaagggcttccacactggagtgaagaagggagaggaaggtaggtgcagatcctggagggcaggagttgggattttactctgaatgtaatgggagggagcggaggggtctactgaagaattcggagtgagaaattgacatgacctgatttgcattgtagggggatgacaggagaaattcagcagcctctcaggattagaggcagccaagaggtccccagggttttaagcagatacaaacgtcaggagcaagcaggcacagaaacagtcatacatgctgttgtgtgagcaagaccggtgaaatcctagctctctagcctgttggagcagagatagctcacacaaaagacccaacccatgacaaatatgacaacgctctgaggacaggttgtcagcaagccttctctaacaaaaatccttcattaaatgtgactgagtggggatgggaatggaggggacacgctaccggatttctagaatttctatactaaggaatcactctgaaggtgttgggctactgcgttcatctgtgcacacatttgtacaagagggtaagtgcttatgtagctttctagcaggcactgtctttatcacttcgtttgccaattgaaaatgatctttgcactccagcctgggtgacagaacgagaccccatctcttaaaaaatggggtcagcggtggcagttcatgcctgtaatcctagcaatttgagaggctgaggcaggggaggatcacttgaagccaggagttgaaggctagcctggcaacaaagtgaggccctatttcttcagtcaatcaaataaaaagaaaatgatctttggcagctgaacccaacctctctaccccactgcaaggccccattgcagtggtccctatacaaaaaatatttacatatatatatatatgtaaaagaaaatgttctttaacacccttctgctgatcagtgaatcctctagtacagattttttttttgagatagagtcttgttctgtcccccaggctggactgtagtggcacgatcttaactcactgcaacctccacctcctgggttcaagcaattctcctgtctcagcctcccaagtagctgggactacaggcgcacgccaccacgcccagctaatttttgtatttttagtagagacaaggtttcaccatattggtcagactggtctcgaactcctgacctcaggtgatccacccgcctcagcctcccaaagtgctggaattacaggtgcaagccactgtgcccagcccctctagtacagattaaatgaggtatctgaagtaccttctgtgggtggagttttgattagggcctgggcttgttgttgttgttgttgtttttgagacagtctctctctgtcacccaggctggagtgcaatggcgcgatctcagctcactgcagcctctgcctcacgggttcaagtgattctcgagcctcatctcctgagtagctgggactacaggtgcactccaccacacccggctaatttttgcatttttagtagaaacaaggttttgccatgttgcccaggctgattttaaactcctgaactcaagtgacccgtccacctcaacctcccaaagtgctgggattacaggtgtgagccgccgcacctagccttcactcttttttttattgtggtaaatatgctaataaaatttatcattttaatccttttaagtgtgcaattcagccgtattaagtacatgaatattattgtgtaatcatcatcactaccatccatcttcagaactttttcatctttccaaactaaatctctgtacctataaaacacaaatgccccattatcccctcctcccaaaccctgggaaacaccagtctacttcctgtctctatgaatttgactattctaaatacctcatataagtagaatcatacaatatttgtcctcttgtgtctggcttatttcacttagcatgctttcaagcttcatctaggttgtaacctgtatcagaattgtattctttgtaaaggttgaaaaatatcaggatcagggtcttggaaatgttaactaacagctcctagaatgtagattaaagttaacctgcacaaacatacatatgtcacactggacatctgtgctgtaatgtaaattaggacaatataataagggggagattgtaagggcctaatgataacagtctgccgcggtgacaatggtgggagagaaacaagtaccaaaagctctcaggagacagaatgaatcaggtttcattactggatgagggagatgtggagtttggcatgacttgaagttttctggcttgatgaactagcatgatatgaaatacaagagaaaaaataggtttataggaaaaggaggtgaatgcactttgatgttcttgttgatgtgcgctgaggcaactggatagtgtgttctggatcacagaaaagagactgggctaaggtacactttcgggcattctcagcaagtaagtggctactggaagattccagattttgccactttggcaaataaaggttatttcgaactgaaggcatttgagaatagatttttttccaaactcctttacctgcctaaaagcaaagcttcccaaaagaggtcataaattccctgtcctggagcagagaagggatgtcagcaccacacccagacagacgttgttgcaaaatgatcacatcttacatctagtcttctaagggcagtttatctttcctaagagtcatagatttttctacaagtatccctaaacctcctccctccttctattaagggaatacacaagcccgcaattctaatagcctccttgagtcacatttttctgggcattcccatacatatgtgaataaaaatctgtcttttctcttgcagatctgtcttttgtctgtttaactcacagacctcaataaaggtaagataaataaataaagggcaaaataaatttttttcctcccaaacactgctaaagttgtaaaaggggctgagttcacttaagaaggagatagatgggcaggcgcggtggctcacgcctgtaatcccaacaatttgggaggccgaggtgggcagatcatttgaggtcaggagttcgagaccagcctggacaacatggtgaaaccctgtctctacaaaaatacaaaaaattaactgggtgtggtggtacacacctgtaatcccagttactcgggaggctgtagcaggagaatcgcttgagcccaggagtcagagactgcagtgagccgagattgcaccactgcactccaacctgggtgacagagcaagactctgtctctaaataaataaataaataaataaataaataaataaataaatggagatagagaatgagagaaaggagaaggcctaggatggggccttgaggaagagccatattaacaaaaaatcaaaaataagtctgcaaaacagtccaaagggcagtggcctagagatagacaaaactgggaagaagagatttcccaagggaagtggtcaacagcgtcaaatgctgcggggtatgaacaaagatagaggcagagacgtgttctccgtatgtggcagccgggacagacagcagccttctggagtggcaggcacagacaccatatggcagagcattggggaatgaggcagaggtgaaaacctagtgctatatagactgttctttcaagaatctggattgtaaaagaaaagcaatctctttggtcactgagcaaagtcttgcggttaatttttttttttaatgtatgtgtgtggtaacaaaatgtataacacaaaatttatcatcttaaaccatttctaagcgtataggtcagttgtgtcaagtacattcacatggttgtgcaaccaacttccagaacttctttttttttaattaaaaataaataaataaggctgggtgtggtggctcacgctgtaatcccagcactttgggaggctgaggcgggcagatcacaaagtcaggagatcaaaaccatcctggctaacgcagtgaaaccccgtctctactgaaaatacacacacacacacacaaaattggccaggcgtgatggcaggcgcctgtggtcccagctactctggaggctgcggcagcagaattgcttgaaccccggaggcggaggttgcagtgagctgagattgggccactgcactccagcctgggcaacagagtaagattccatcttaaaaaaaaaaaaagatgttagacaaaaagcaaattcgagttcaaaataggtcataaagcagcacaggcaacttgcaccatcaacaatgcatttggcccaggaactgcaaatgaacatacagtgtagtgatggttcaagaagttttgtaaaggagacgagaatcttgaagatgaggagggtagcggacagccatcagaagctgacgacgaccaactgagagcaatcatcaaaggtgatcttcttacaactacccgagaagttgccaaggaactcactgtcgaccattctatggtcgtttggcatttgaagcaaatgggaaaggtgaaaaaagctccataagtgggtgcctcatgagctgagcaaaaattttaaaaaatcgtcattttgaagtgtcatcttctcttattctacacaacaacaacgaaccatttctcaatcggattgtgacatgagacgaaaagtggattttatacaacaaccagtgattggactgagaagaaactccaaagcagttcccaaagccaaattttcaccaaaaaaaggtcatggtcactgtttggtggtctgctgctggtctgatccgccacagctttctgaatcctgacgaaaccattacatctgagaagtatgcttagcaaatcagtgagatgcaccaaaaactgcaatacctgcagctggcattggtcaacagaaagggctcagttcttcttcacaataacataggattgcatgtcgcacaaccaatgcttcaaaagttgaaagaattgggctacgaagttttgcctcatccgtcatattcacctgacctctcaccaattgactaccaggcgtcttgacaactttttgcaaggaaaatgcttccacaaccagcggggttcagaaaatgctttccaagagttcgttgaatcccaaagtacagatttttatgctacaggaataaacaaacttatttcttgttggcaaaaatgtgttgattgtagtggttcctattttgattaataaagatgtgtctgggcctagttataatgatttaaaattcatgggccaaacccacaattacttttgcgcaatcccaccaacagtgcactagagttcaaatttctccacatcctcaccaacattttttattttctgttgttttgaaagtagccaggctgggcgtggtggctcacacctgtaatcccagcactttgggaggccaagacgggcggatcacgaggtcaggagatcgagaccatcctggctaacacggtgaaaccccatctctactaaacaaaatacaaaaaattagccgggcgtggtggcgggtgcctgtagtcccagctactcgggaggctgaggcaggagaatggcatgaacccaggaggtggagcttgcagtgagccaagatcgcgccactgcactccagcctgggtgacagacagagtgaggctccgtctcaaaaaaaaaaaaaaaaaaaaaaaaaaggagccatcctagtggttgtgaggtgagtcatttgaatatcatttctatttattgaagaaatgtctattcaagtcctttgcccttttacatcgggtcatttgacttttttgttgttgagttgcaggagttctttctgtattctggatagtaactccttttcaggtatatgatttgtacatattttctgccactccgtcagttaccttttcagtcttttgattgtgttctttaatgcaaagaaatttgtagtttttttttgttgtttttttgagacaaagtctcgtcctgttgcccaggatggagtgcagtggtgcagtcttggctcactgcaacctctacctcctgggttcaagcaattctcctgcttcagcctcctgtgtagctgggactacaggcacgtgccaccacacccggctaatttttgcacttttagtagacatggggtttcaccattttgcctaggctggtctcgaactcctgacctcaggtgatccactggcctctgcctcccaaagtgctgaggttacaggtgtgagccaccatgcccagccagtttatagttttgatgctgtctgatttacgcatttttaccattgttacctatgctttttgtatcatatctgggaaacacttgccaaatccaacgtcagcttttcccctgttttcatctaggagtttaatagttctaagttttatatttagttctttgatccattttaagttgcttttcatgtatggtataaagaaggactcaatttcatttgtttgcatatggaaatacagtttttccaacaccattttttgaaaggctgttctttcttccttgaacggtcttggcatctttgtcaaaagccatttagctgggtgaagtggcagacatatgtagtcctcactactcaggaggtgggggtaggagaattgcttgaggccaggaattcaaggccagcaagaccccatttcaaaaaaataataagaatttaaacaaatcatttggccgtacatgcatgggtctatttctgagttctctattatattccactggtttatatgcctgtctgtatgcataccatattcttttgattactgtagttttataataagttttgaaatcaagaagtgtaacacctccaactttgttctttttcaagattattttagctattcagggtcccttgagagtttatataaatttgggaatagacttttctgccattgggattttgataggggttgcattgaatctgttgatctatttgtgtgtgtggttttttgtttgtttgtttttttaagatggagtcttactcttgttgcccaggctggagtgcaatagcacaatctcggctcactgcaacctcctcctcctgggttcaagtgatctcctgcctcagcctcccgagtagctgggattacaggcacctgccaccacacccagctaatttttgtatttttagtagagacagggtttcaccatgttggccaggctggtctcaaactcctgacctcaggtgatccatctacctcagcctcccaaagtgctgagattataggtgtgagccaccacgcccagcctatttgtgtagtattgatattttaacaatatcatgtctttcaatccatgaacatgagaagtcttttcatttatttgtgtcttctttcatttatttcagccatgttttcaatgcacaagttttttgcctcattggttaagtaaattctgaaatatttcattctttttcataataattttgctgttaatttcctattcagattgttcattgttagcatataaaaatgcaactaatttttgtatgactttatatcctacaactttactaaacacattcattctaactgtgtatgtgtgtttgtatgtgtgtaatcattagggcttgctgcatgtaagcccagatgatctatgaacacttcctttccaatttggatgcctctgtctgtttatttttaaacctaaaatagatttcaacatttctataaaagataaagtcaatagaggaagtgattaaagatgggggtgggtgaaactatccatggaacccatgtactggcattagcctagtattcaaatagcagcttctgttacctccatccaccaggatgctccaataaagatacaagagttacctgtatggttgagtttgagaattaatgagatcccagtggagcagaaagacaggaaatgctctgtttggggctaaaaagttggaaaacccaaagtgactcttttccagtgtgttaacagttcctacctgcagagatgctacctggacacacagacagaggcacaaacctcccggagtggatgagaaatctgcgtgatgggcatgcagtgcacagaggacaacatgaccaatgacctcttcatcacagctatctactatagagggcacaaaaatgaaatggtggacaaaaatacaaggcccaacattacaaactaaacaatggtttcatatgagagatctactatttaattacgatatgagggaaaaaaaggagaccacctattattaaagatcaaagtgtcagcagaggtcatattctacaggcattgtgtcttcactaaattggagctgaatatgattaaactcttgcatttaaaagtggaagtgttttaaagcatttcctttcttccttccttccttctttccttccttcctctctccctccctccctcctttctcttttctttctttctttctttctttctttctttctttctttctttctttctttctttctttctttcttttctttctttcttcctttcttccttccttccttcctaccttccttccttccttccttccttcctttctttctttcctagacagagtcttcctgtcacccaggctagagtgcagtggcacggtctctgctcactgcagcctctgcctcctgggttcaagcaattatcctgcctcagcctccagagtagctgagactacaggtgtgcaccaccacgtctggctaatttttgtatttttagtagagaacagggtttcaccatgttgaccaggctgatcttgaactcctgacctcaggtggtccacccgccttggcctcccaaagtgctgggattacaggtgtgagccattgtgcctggccaaagcatttacttcagtgaaatgatggggcctcaaaagttctaaaaatgtgtggcccctcaaattctttttgtgtatgtgtgtgtgagccaaagatttatttcttcatttcttgcatttgaagtactcttggatgacatccttggcctgagactccttgccatagtccttaactactacacaactgcaaccaaccactttacagggtttcccttctctgttaattttacagaggcctatcctttcccctagtttcttgttgtcatcaaccttaattaggttgatttggtgttcatggcaaagggcctccacgacttgacatacatgggctcatcacagttgggtacaagcacacaaagatgggcttggcacttgtctaaggcttcggcagcttcgtgaattccacgtgctaggccatcgtggatgagggcggtcttcagcacctcttgtaaagcagtattaacgtccattacacctccagcagcaatgccttccttggccatggcggtggattacgggtgaagctgaatcttgaaggcacccaagcctccgcctccgcacgactcggcagaggcagggaaagagcctcaaattcttagcgcgttaaaaatttctgcctagatctgagagacctcctcttaccattgccaagccaacctattgtgtcttttacaaatattgacttttacaatattgactttagttactgcattgactttagttactgcactgactttagttactgcttcgacattccatctaagtggaattaactggaaacttctcttcggcctcccttgcaaagtcgttctttccacaatgggctatttacctctctctgtttctgatgcaaaagcctcttgggcctctagggaaacatctttcagatccgaggactattcttttttttttttttttttttttaattttgagacagagttttgctcttgtcgcccagattggaatgcaatggtgtggtctcgattcactccaactccgcctcccaggttcaagtgattctcctgcctcagcctcccaagtagctgggattacaggggcccgccaccatgcttggctaatttttgtatttttagtagagatggagtttcaccatgttggccaggctggtctcgaactcctgacctcacgtaatccacccatctcagcctcccacagtgctgagattacaggcatgaaccaccgtgcccagccaaagactgtcctatattgaagttggacatttaaatgtacatctaatttgccactccaaaaaataacttgaaattttcattcagaactattaggtctgaatgtaggtagtgttttagtgtcattgtctaaaattctggatcctctcagccccaagcatgaaaaaaaggccattgtacctacagttcaatttcagttgtttttggttgagcacctcttggtttttttatttgcagatgagatgatcatagctgattctgcctctgtggtcacagtacaggttctccttgtagcaccgtcttcgttgtgaagttgttctgtgactctgcctgccgttaaatgaactcatttcccactcacacacctgcctctgagagcttgatgctgatcctattcggaaaccaagcagtgcagcagcctcacagaatagggcttcagccaaactcggacatgagaaacactgaggcctcagctcagataggaacagtaaccactgagaatttgtatttgctaaagtcaagaagaatctaccacagtcctctttataaaacatctgaaaatccttagacttgcaaatttacatgtaatttattcatcctttaaacacaaacacatagcatttttttaaacaccaaaacccccaaatatttattatttcacattttctgaggatcaggaacccagaaatggcttagctggttggtcctgactcagggactctcatgagattgcatttaagctgtcggccaggggctgtcatctcaaggatcatttgacactggactttacttccaaattcactgtcgtagttgttcataggtattggttctcaactcgctagggcaggaggcttcagccccttaccacacaggcctctccactgggtggcttacaagatggcagcctgctttcctcagactgagagatgagagggaggatccaaggtggtagcccaagtctttaacctcaaaagtgataccagggttgggcacacagtccaaccctggtaaaatatgatacgtagcattttacttcatagcactaatgctcaaagttgtggattaataggaagaacatgctctaaataaatgtatatgaatatactggggccaggtactgtggctcacgcctgtaatcccagccaaggtgagtggatcacctgacgtcaggagttcaagaccagcctggccaaaatggtgataccctgtctctactaaaaatacgaaaagtggccaggtgtggtggcagtcgcctgtaatcccagctactccggaggctgaggcacgagaatcacttgaacccaggaagcagaagttgcagtgagccaagatcgcgccattgcagagtgagactctgcctcaaaaaaaaagtatatatatatttttggtagagacggggttttgccatgttgcccaggctggtctcgaactcctgatctcctcagcctcccacagtgctaggattataggtgtgagctactgcgcccggcctgtactagacttttatatgaccggtgtgttgacaccagcatcaccacagacacatgcgtaatgtgtgacaatggctcttacatctccaggcaataggaatttctcagctccattatcatcttatgggaccaccatcatatatgtggcccttcattgtgcaccatcttacctggtgcagactgtactcaaattagtaattaaaatagaatgagatgaaacacatataaatggaagttacctgttttcatttccacctcaagagtcctctgagagcctgctggttgggcatggccctgtgtgcagcacctttgtcattacttagaattgttgctcatggaaaattctagagaatctcagtctcaggattcttgcattcttgggaaatcatgataggcttagagtgcaaccagaagagagaatctgaattaagggggctttaatgatcatacccaatgattattttcaagataaatagttttcctcattttctaggtcctaaggacagattaatgggttgtaattcctgttgtttccatcaatttgtcctctagaaaataagttccccaagtggctaagtctgtcatgttaattgatctcatctcttgttcatcagctattgattcacagacaaaactcgcactttgaattggtggaagcttttgattccacaatgaccagtgagatagattacattgtttaatgttggtttttcgtagttgttgttattgtttttgtttgtttgtttttgctgtgttttttttagacagagtctccttctgtttaccaggctggagtgcagtggtgctatcatggctcactgcagcctcaacctctcaggctcaagggatcctcccacatcagcctccccagcagctggaactacaggtgtggacaactacttccggctaatttttttttttttttttttttttgtagagatggggtttcaccatcctgtcagaggtgtttgaaccagagcaactccaatttgaataggagctgggtaaaataaggctgagctctactgggctgcattcccaggaggttaggcattctaagtcacaggatcagacaggaggttggcacaaggtgcaagtcacaaagaccttgctaataaaacaggttgtggtaaagaacctggtcaaaacccaccaaaaccaagatggcgatgaaagtgacctctggtcatcctcactgctcattatatgttaatcataatgcattagcatgataatagacactcccaccagcaccatgacagctttcaaatgccatggcaatgtcaggaagttaccctatatggtctaaaaggggaagaaccctcagttcctggaactgcccacacctttcccagaaaaacgcatgaataatccactccttgttaagcagataatcaagaaatgacatagccaacgaggagcccatgctgctgctctgtctgtggactagctattcttttattcctttactttcctaataaacttgctttcactgtctgatatggactcgccccaaattctttcttgtgcaaggtccaagaatcctctcttggggtctggatcaggacccctctgggtaacaatgctgctcaggctggtcttgaactccagggctcaagcaatcttcctgcttcagccctcgagtagctaggactactagaggcgtgcgccaccctatctggtttaaatcacattgattagttttcctattttgtggccaaccccttgccccaccgaaacaaacaaacaaaacaaaaaagacaatgcactggtttaaaatacgtccagtttatcaagagagtaacttcattgttcttggggcctgttcccaggcaggcccccctcacccccaccccacaaagggatgaataattgtgccagtttctccaagggtctaggggttccaggacacataacttaggctgctagaggctccaggaagaccaaggaagccctggggcaagtttcctcgcagcgaactgcctccattatcctgagattcccggggctacagaggaattgaggagaatgcatgagaagggagcaggagtgggtgtctggaaagggtggggcagataagggacttcaaatcagatcagcagctcctatgatgaatatatgacaaataagtagtatatgggcagtgactgaaacatttgcagctttaagaaagaactcaaatgagagccaagcccaaacatttttacctgctccaaacaatttccggaatcccactatggcttgggtgggagggaagagactcccacttaattatctacatggttttaaggttttggatgacaatatatttaaagaaagttgctctaggctgagctcagtggctcaggcctataatcccagcactttgagaggccaaggtgggcagatcccttgagcccacgagttcgagaccagcttgggcaacatggcgaaactccgtgactacaaaaaattagctgggcatgcagatcacgaggtcaggagattgagaccatcctggctaacacggtgaaaccccgtctctactaaaaatacaaaaaattagccaggcgtggtggtgggcgcctgtagtcccagctactcgggaggctgaggcaggagaatggcgtgaacccgggaggcggagcttgcagtgagctgagattgtgccactgcactccagcctgggcaacagcaaggctctgtctcaaaaaaaaaaaaaaaaattagctgggcatggtatagtgtcacatgctttagtcccagctactggggaggctgaggcaggaggatcaattgattccaggatgttgaggctgcagggagccataaccatgccactgcactctggcctgggtgacagagcaagactctgtctctaaaataaagaaataaaggaagttgctcttgcaacttatactgagaaaaacagtgttagaattggggggaaattattcttcaacttaattgctagttttttcaaaccaagcccatctcatagatctcaaaggatctcatagaggtcagcagtttgagaccagccaggccaacatggtaaaaccccgtcgctactaaaaatacaaaaattagctggggcttggtggcatgcgcctgtaatcccagctgctcaggtggctgaggcaggagaattgcctgaacctgggaggcagaggttgcagtgagccaagatcataccactgcactccagcctgggcgacagagccaggcaccatctcaaaaaaaaaaaaaacaacaaaaaaaaaaacaaaaaaaattcagcttctggcctggtatggtggcttatgcctctgatccctgtgctttgagaggctgaggtgggaggattgcttgaggccaggagtttgagacgagcctgggcaacatagggagaccctgtctctacaaaaatgaaaaaaattagctgggtgtgatggtgcacacctgcagtctcatctactcaggaggctgaggtgggagaatcacttgagcctaggaagtcaaggctgcaatgagatgtgatcccactactgcactccagcctgggtgagacccagtgagaccttgcctctaaaaaagaaaaagaaaaaaaatagcttctaatgttggtgaacactatgtgctgacagctttaatcattattgaagcttttaaaaaatataattagagaatagttatattaggaggctgaggcaggaggattgcttgagcccaggagttctagaccagcctgggcaacatagtgagaccccaactctaaaaagaaaaaaagtttacttatgtgttaatcttggagagcatcttgctgcattaccttgagtgttgcaaatgtttacaggcaagtgaatatataatagttgttattaaatataggccataagaatgatatggattttctaaattcagaaagtatgaaccatgctcaattttgttcaaattaaatttagtctagaaaatgaacatttaaaaccccaaagtcatcccttttttaattttcttttctttctttttttttttgtgtgtgtgtgcgtgggttttttttgagatagagtctcgctcttgttgcccaggctggagtgcagtggcacggtgcgatctcagctcactgcaacctctacctcctggcttcaagtgattctcctgccccagtctcccaagtagctgggactacaggtgtgcgccaccacactcggctaatttttgtatttttagtagaaatggggtttcactatgttggtcaggctgttctcgaactcctgacctctggtgatccacccgcctcagcctcccaaagtgctgggattacaggcgtgagccaccgcacctggccctttttttctttatctgactctgaacacatcttcatgatccattagattccaacatgcattttacaaactagagccatgctacacattggtgaggagagaaacagagaggtgagagactcttgcaggagcatttggaaatgatatcagccaggaagattatagttgtgtccactacttcttcactggcaagatgaagccaaggagtgaaaggagctttgtacaaagcactgcagagtcaggaaatctattgtttctgtattttatcaagtctgattgtttcagagttaacaagcttacaagcaaaacaaaataccaacctgttaataaggtgttgatctctatcttggcttattttaatattaaaagggtatttcaaatatactggaaagtgaaggaggttgtaagttgaacataaacaggtaccttggacctttattttagcccgtctgaaaatacatattttatcattctttttcagaaattaaaattttcattttgagttaattgtggattaccatgcagttgtgagaaataatacagagagatcccgtatacccttcacccagttttccccaatagtaacatcttgcaaaaatagagtgcaatatcacaaccaagatattgacattgatacagtcaaggaacagaacattcccatcccataaaaatccctcttgttgcattcttacagcaacacccagttctctccaccctctacccttctttaacccttagctaccactgacttcttcatttctgtaattttgccatttcaagtctgtcatataaatgggatcatttgtatgtaacctttggggattgacaggtttctttcagcagaattctctggagattcatgcaggttgttgcatatattaatagtttgtttctttttattgttgactagtatttcatggtatgggcagatcagtttgtttaactaacatgttgaagggcatctaggttttccattttggggctatttcaagtaaagctggtataaactgcatgttcaagttgttacgtgaagctccaggagtgtaactgtaaggtcatatggtatggtagttgcatgtttcttgtcttttttgttttttggcttcttagttttttaagaagctgccggctaggcacagtggctcacacctgtaatcccagcactttgggaggccgaggcaggcagaacacttgaggttaggtgttcgagaccagcttggccaacatggtgaaaccctgtctctactaaaaatacaaaaattagctgggcgtgatttgcgcctgtaatcccagctgcttgggaggctgaggcacaagaatcgcttgaacctcggaggtggcggttgcagtgagccaagatcgcacaccacactccagcctggacgacagagtgagactcagtttaaaaaaaaaaaagaagccgccaaactgtcttccagagtgactatgctatattacattcccaccagcagtgtatgagtgatccagtttctctgcagcctcatcagcatttggcgttgtcactattgttttcactttagccaccctgatcattgtgtagtgatatctcactgtggttttaatttgcttttcccaaattgcacacaatttatttgccacctgtagatcctctttgataaaatgttgcttcaagtattttacctgtgttcttgttgattttttgtttgtttgcttgtttttttactgctgagttttaaggattctttctatatttagatactagtcccttgtgggatatgtggtttgcaaacattttctcccaatctgtagcttttcttttcatcttttcaactgggtcttatgtaggacaaaagttttaaattttggtgaagtccaatttatagtttttcctcttatggatcatgctttttgtatcaagtctaagaactatcctgcttagccttagcttcctaagattttctcctgtcttttcattttttttgttttgagacggagtctcgctctgtctcccaggctggagtgcagtggggagatcttggctcactgcaagctccgcctcccgggttcacgccattctcctgcctcagcctcctgagtagctgggactacaggcttccgccaccatgcccggctaattttttgtatttttagtagagactgggtttcaccttgttagccaggatggtctcgatctcctgaccttgtgatccgcccacctcagcctcccaaagtgctgggattacaggcgtgagccaccgcgcctggccttctcctgtcttttctaaaagttttacagttttgtgttttacgtgtaagtctgtgatccatttgtagttaattattttatcagatgtgtgacataagtcaaggttaactttttgcccatgaatgtccaattgcttcagcaccatttgttgaaaggctgtcatccaccattgaattacttttgcacctttgtctttttaaaaaatacatttatttatttatttatttatttatttactagtgacatctccatgtgaatacttttgagcctttgtcaaaaatcatttgggcatgtttatataggtttattgctattgttatgattttaaaagcatttagcaagctaacttaaaggaatacaaaataaacattagatcaggttatccacctttcctttgtgtattgctagttgagatgtttatcaattcacaacctaatctttttttcttttttattttttttgagacagagtcttactctttcgcccaggctggagtgcagtggcgcgatcttggctcactgcaacctccatctcccaggttcaagcaattctcctgcctcagcctcccaagtagctgggattacaggcgcacaccaccacgcttggctaatttttgtatctttttaaagtagagacggggtttcaccatgttggccaggctggtctcaaactcctgacctcaggtgatccacccgcctccgcctcccaaagtgctgggattatagatgtgagccaccgcaccaggccacaaagggatttaagttggtagaggaacataaaatctacagttcacatcgtataatatattgtataatagctttgttttgagtgcgcaatgttgacttattgaagcaaagtttccaactttgaaaagtcctctgcattttgcctggcactcaactcagtgaaagtttatttaattaatatgtgaaaaatatatattttaatgttggatacttatagggtcctttgtagaagggatttgaaattgtgaggattacagccacttgatctaccctggaatgtagacaccttccacataccttctggtatcttctaacagtgcatcctgagaaattctttctccatattggacacatcatttactctatcttggttccagtccctcctttgttacttgagagtaatcctgaatttgagtcaggcaccaatcttaaaccttggtaaatgaaactgagatccaaatagctggctttatacttaactccaaagcaataaattccttaagagttacaaggatagcatttgcctatatatatatacgtgatgtatgtctacaagcggctgagctttaaacttcatctgtaaattgaacattttctgtagcttccatatgaattttagattattaagtactcatgaattgaatacaactgttaattcttctagtttataattagcaaattataattaatgctctaaaataatccgtctcaaatcctcacatagaaagtaaaattcaaataatttactcacagtttcttccatagacttctcaacagggtaataacattattcttggttatttattttccaggccatgtaaatgttaatattcttatttgtaaaaagtaaaatcatatcttaagagatgcatgcgcacattctagtactctctattctgcctgaaacagctctgtgataagggagtattaagaataacaaattcacacgagcacaagatagagtgggaattaggttcttagatgactggatatctctgtgggaacaactggtttagaaagaagtaggtgttttatccagggaaaacaaagaagttataatcaagagagaagcagtttcaaaggtgaaggtgaagagttgccagtctcagcgaaggctttgtaactagagaatgaatctttagggtagagttaacggtagattttaaactgttttaataattaaaattattattgcactttgaagggggtgtctgaactcagttgtaaaatgtttgacatttgtgaattcctttaatgttatatttgaaactgttttggtgcatgcacaaggtgcccaactatgactctacattttattgttaaacctcatgtgacccgtctttctggagaagtatgtgtgcgaagtacaggttcagcctgctacacaggcaacatgtatttgtttttgagaaatctcaaactgtgtttatgagagaattaaccctctcagggaaacagctctaccaacgactgccccatgggagaggatgtgtggggacacctgcatcctgctatttggagaaaaattgagctgctggtgagacattgaaccaacagccttggactgagaagtgaaaaatagagaacacctgcctcccctctactctgatgccaatccaagcaattccgaaggcatcttggaagccctagaaaagaaaacctcagtgactcgatttagaaccttggaaactagagtggtaactttgtgcttggcacataataggtacttgatagaaatttattgaaagaaagaaagagaagaaggaaagaaagaaaaagaaagaaagaacagagaagaaggaaagaaagaaaaagaaagaaagaaagaaaagtaaaaaaagtaacaaactttgtagcattctgaagcactaagtggcatacccaaaaggttgggctatttcatcgctagaggtcattaataacacaaccacttttcttttcttctcttttttttttttgagacagggtctcactatgtcatccaggctgcagtctggaactcctgggctcaagtgatcctcccgcctcagcctcccaagtagctaggactacaggcatgcaccaccactcctggctaaatttttttttattttttgtagagatgggagtttcactgtgttgcccaggctggtcttgaacccctggtgtcaagcaatccttccacttcaacctcccaaagtgctgggattacaggcgtgagccaccgcgcccagcgcaatgattttactttttacaaataagagtatgaacatttacatggcctggaaaataaacaaaaagcaagtaactgctaatctaagcagatgctgatatcttcctcagcacgtaggttgtacactgttggcttgaccctgcaatcctttctgaaaatttaaagggtagtagatgtgaaaagctttgctaagaatttcccaggaacaaagtaaatataatctcacagaatgtgaaaatgttgatagtatttgtgctacttactgatacattttcaaatgtgctgacgttaatcattctcaaatagttttttttttcttcttctttttttttttttgggacggagtcttaatctgtcatccaggctggcgtgcaatggcatgatctcagctcactgcaacctccacctcccaggttcaagcagttctcgtgtcttggcctcctgagtagctgggattacagacacgcgccaccatgcctggctaatttttgtacttttagtagagacggggtttcaccatgttgcccaggctggtcttgaactactgtcctcaggtgatccacccacctcggcctcccaaagtgctgggattacaggtgtaagccaccacacctggcctcaagtaggttttaacagtgctttttgctcttaaaatcctaagtgaggtccaaatgccacgtttcagtaacacctctgagaggagagaacacagttgattgaaagggaaggggagtgccatgcggtggtgaagcgtggaccctgaaagcagatgccagttggacttcctgctcttccaactcctggctgtgaaacctgaagcacacaatttaatttctccgggcctactcctccccctcctgccaatggtaaaatgagaataatactatctatcccatggggttattgtaaagattattatgtaaagtgcattgaacagtgcctggtacagagtaagaattctaatgtttcctaaatagtcaaaatttaagtcaaaatgggggaaatgtgtataaattcctaaaactaagcattttgcaaatatactgtttcttaagagataaactccagagaaattggccttcgtgtagtcctttaaataaaaataattaattcagaaaacaggcccagtgtggtggttcacacctataatcccagcactttgagaggccaaggcaggaggatcgcttgagctcaggagttcaacactagcctgggcaacacagcgagaccttgtctcaaaaaaagaaaaagaaaaaaaattaattcagaaaacaaatttgatggtgagtaactaacctatggttcccagggtaccattcgattcatgcaattcattaggcatgaaacatcctagtgctgaactactgcttacaccctttctacaaaattgtactaaatctgagtatgagatatttatctggaatttggtgtgaatattccgaaagtttcttccttctttctttcttttttttttttgacagaatcttgctctgtcgactaggatggagtgcagaggcacagtcatagctcactgcagcctcgaattcctgggctgaagtcatccttctaccccagcgtccccagcctcctgagtagctaggactacaggtgcaccactgcgcctggctaatttttttattttttgtagagacaaggtctcgctatgttaaccaggctggtttcttcattcttaatggagattcaaagtatttgtgaaaactggggcactcggttgctagttacaactggaataaattttgtctttcagccccaaagccttaatgctttgcgccaagcaatccagctacaaatttaatttagttcaaatacttattgattggctgccatgctcatgtaatacatattatattcaagggtcggaaatgaaaggatgcaagccacttgtgctggtattatttaaagtcttcatcttttgagaaaggctgacggcaaaggaacagatctatgctgtcatgtgtcggcatcgcgcggagcagaggtggcctggatgggtaacttccagcacaggccctcaaagaaggacgggcacatttccggtaacagcctcatttccccccgttccccgggggaaggggggcggctagcactgctgatggcatcgcctgacatcacttgttccggaggataggagagcgtgggcctgcgtggcccacctcatccgtggcctgactgcgttaacctctcggttccctgctcttgccacgtgaggtgcccaaatatggtcggactcaggaggagccagggagcgcttgcctttctcctgctaatggggaggaggctggaacaaatgtttggagttaaacacaatctgcaggaaagcaaatggggactcggactcgctcctgggcgagctgaaagtcggctgcagcagaagctcctgccttgggtgatccatcatttaataaaccccagagaatccagtgtccccggcaggctttttgctcccctgctctcttgccttctgaggccctgggtcgtccccgcagctctagtcgccctgttagaaacgggaggcgcccgagggccgggtgggcggctgcctggacctgggctggcgcgtcgcagcgcctctggtcccggcagcctgggggcagatgctgctgcagggcgtgtctggggctgtgctcatgtgatgaagcgagggaaaaaccggggggaggggggcggaggctaagaggtggcctttttttttttttccttttcttttaaggagtttgccgcgagcgcgtctccttcattcgcaggctgggcgcgttcgcagtcggctggcggcgaaggaaggcgctctcgggacctcgcgggcgcgcgtcttttggctcttgcccctgtccctgcggcttggggaaggcgtaacccggcggctaggcgcgggagaagtgcggaggagccatgggcgccgggagctccaccgagcagcgcagcccggagcagccgcccgaggggagctccacgccggctgagcccgagcccagcggcggcggcccctcggccgaggcggcgccagacaccaccgcggaccccgccatcgctgcctcggaccccgccaccaaggtacgggcgtgccgggccacctgcgccgggaggcgcgggtctttgggggtgggggtgggggtgggggggtccctccgatttccgccgagagaacttcccagcccatccagccgcatctgcaaactcaggagtgcgaacccctctttggaggcttttcagggtctttcgcgccggggcggggccagagcagcggcgagcgcggcggggggcttgcatctttgtcgcgggtctccaggggaggcgactgcgccatgcgcaataataaaacccgcgccctgcccacggcggctgagcctttctgcgcactcttccggtgggagccatgcagcccgaggcggaggagctgcgcggagggggatccgtggagaatggaccccgggccgggcctccggagctccgagatgcggaaagtcagctgtgaggccaggactcgtggtggagcccgccggggagcccagccaccctcgggttccccgtcgcgtaccgccctggatgccagcggtgcctggagcgagcgggtttggtacccagtcctcctgcggcagcggcccgagcaggcaccgccttcccgaggcagagaaagcctggggtgtagctcgctcagagccaggaaaaacctgggcaggcgctgcgtttccagaaggaatgacaggtttcgcaaaccagccagcgccctcgcgttcgctcagcgctttgcctgcagactcagttggccaaacacacgctagagtggctagaagttctcaaaggatggggtcagtgtaacgagcattccgggtactcttccctggacgcagtgctgaaacgactgcattttatcggcttcagtcttcaaggctggaatatttcttgtgggccaggacagccgccaagactgtggcttgttctggtcgtggtattttagatctattttccagcgcatgtgttcattagcaaggcttcactctactgattttgtgatacccttgtatcacaaaggtacccttgtgataccttgtagaaagatgtggataaccatgtttaatagttaaatttgcggtatgtcaaatttgaggatagagtacgtgagttatcgcaggaggtgtagatgtttacaatatgcaaaaaaaaaaaaaaaaaggaacctacaaccatgacctaattgccttgacctccttagctgccctagtctcttttgggctgagagactgctgttaataatatagtttttaccgccagtctttgattcataactacttgtaaaatccatggtccctagatattaagtactaactgtgtctctgtgctatgtaggtttttctaagagatgcttaagcttctggcctgaggaatgtactgtccttttgagattcaagtcgcattttaatacttactgtatgcacataatgttttgatgccagctactgtcaaagtggctctgtaaccagtggtcagagtctagcgatgaaaataattttaaggtataattgctaaaaacttgcagttgggtgacattccccccaccgccccggcttttatactccttcagatcttactaactgttcaccctgaaatatgggatttaatcccttcccagtaaacttgaatttgtttatttaaaaatattccttccattctctttttccgtcttccataaccttatccttttcctctttccaagttgccaaccgtcttgaagcaaccaaacaacctccttttaaaaaatcacttaaatgacatccagaatatcattgaacttgttggcataatgcccagttatcaatttggagacaaatcagtgcacttacatgtatccttggaatgtatttagttttcatttgaactagccaaatttatcactcaggctttgaacacaaatgtcttttcaaaaggactccccaattaagaatgactcagcaccatggcccttgcctcccctcttcttgttaagctccaattcctgacctccaagtaatcccatctcccactctaggctccgtggcaccatggacccgtcccagcagttttcacatgtgtgggtttagtgttcttgctgttgtgaatacttcgcaggggcagggaacacgcctggttgtgccgaccaacggtgttccttcatgcgtgccatgttgcctggcacagaggcagctctcaggaatacttgtggaaagaggaaggggtgatattggctccttggttttgattggaaaatatcaagttggagaataccttgacctatctgattttactacaatttaacccttgatcatttcattatcacgtgagactgattatgatagtgactaaggcaagtcagtctgttcggttattaatagatcaagtgaatagtttgaccaaaaacttcagatttgggggctttggattctgtttctctagatatagagtgacttgttagcattgcaatttcaaattgcgttttatcttaaatagacaaatatatgaagtgcatatggctcaaatgagtccatttcataccctgagttacttaggattacatcttgaacttccttgatgtgtctgtggacggttggggaggtttaggctaatacatcatttttccctccttggatagaatgtggtcattaattaaaggttgtaggcagatctttttctatctaatagctgacatttatatcacatgcatgctatctatttagcaattggatttactttcctttttttctgctagttttagttaccagttattcactaagtgcccttatctgaacagacattacactggttgaattatcacttgtattaggtcaaatggagagttaaacaagcttttgattactcaggcttaacgtttagatgcactaaagcagaagtcttggttttatctatggttcatttctgtaaaatggaaggagtctttatcttctattcaatcttttgtaatctttattttttccgttagatccagagatagactggaaatcttttacagtctttatatgtaagatccaggcgggggcagggggaatggcttggtctgttatctgccagggtttaattttgagacatggccgtttcacaactgcagggtgcgggaagattagatgacctgaatgctggtggtaagtaaagcctcacacttcacattattccttaattgtctgtttttaaaaatttgtcttaaaaaaatattaaggtggcaacatattcaggtggcaacagagggtggggtgaccagtgacaaactgacttccatgtctctggctaatcttgatttctggagccaggctccagactaagtctggacaatcaattaattagcctttctatatgtattgcctgatgaatgatttcaatgctggacattgaacaatggtctgttgcaacagggtgaggccattgtctctggcaggtggggagatgggggctcttgttagctccatttgattacaagagccttgaatcaccaaaacataaagatgtactcgaatagaagagtccgttgtctgactggtaaatttaaggatgtgtttgaccctcgtgcattaaaacagacaattggccgggtgcggtggctcacgcctgtaatcccagcactttgggaggctgaggcaggcagatcacaaagtcaggagatccagaccatcctggctaacacggtgaaaccccatctctactaaaaatacaaaaaattagccaggcgtggtggcgggcgcctgtagtcccagccactcgggaggctgggacaggagaatggcgtgaactcgggaagcggagtttgcaatgagccgagttggcgccactgcactccaatctgggcaacagagcgagactctgtctcaaagaaacaaacaaacaaacaaacaaaaccagacaattgaggcggccagctgcatttcataattcctcccataagcttcctcctatttgccacttgtttagcaatggaaatggagaacgaagatggcctcaaagtgactacatcaccagtgttacaaaaatgggccagaatttaaggcaagaattatatgtttcttaatagagggatgtttctctgtgtgtggctacttgtattcctgtggatttttaccagattataagagctgctaatttctgatcagaacagagaccaaaaattggagatatggatgtggggatgattcttttgggtaccgatagactgcaggaatcgcagggcttcctttaaatccattacagcttataggctagtggatgaataagataagtggagattttctcttgaaatatttccttctatgaagaaaaggccttgaaatgtgcatcctctttgggttgactaatttctatgcctttacagctttaagctgacattataagattattctagtttggatcttgtaagataattaacaaaatggaaataaaatgttttgtttttaaaaatgctaataaattatttattttcctttgtcttagttagttttaatacatattcagtgcttaaagaacaccagtgcaggaaaactcaaactaaatggcatcatcccccatctctataattctatatgcagtagccattcatgcgaagttagaaattagaatttatagcactaagcattctaagaaaaattaagccagtacgtttatctcttgaaaaaaaaaaaagcaactaaatttccttgaaccgaattcttttttttggctcactgcaacctttgcctcccaggttcaagcgattctcctgcctcagctttccgagtcgctgggattacaggcacccaccaccacgcccagctaagtttctgtatttttagtagagatggggtttcaccatgttggccaggctggtctcaaactcctgacctcgtgatccacccggctaaggcaggagaatggcgtgaacccgggaggtggagcttgcagggagccgagatggcaccactgcagtcaccactgcagtccagcctgggcgacagagagagactccgtctcaaaaaaaaaaaaaaaaaaaatcaaaagcatgtgtttacccttattaatgatttttatttaaagtcattgcatagcaatattcatttaatgtttattttttaaaaaaattaatgattgagaacttaaatttataagtagggtaaattactcacaaatttaagtaaaatttgaagccaatatgatggcttcttacatattctttcgaaaacttcatgcacatgaaagtagataaaaatggcacagtcttttccatttaagaaaaagatcatatcacatatagatttaggttttggatgtcttttcatatcaggacataaataactgcccccattcttattaatttgggtgcataaatttcccttttgtgggttgaagccctgtaacgatttaaccaattccttgggtttatatttagattgtcctcgtccataagtgtaattgctgaattgcaagctttatatgcatttaaaaatttaacccggcaaggtgcggtggctcacgcctgtaatcccagcactttgggaggccgaggcaggtgaatcacaaggtcaggagttcgagaccagcctggccaacatggcgaaacctcgtctctactaaaaacacaaaaaattagctgggtgtggtggcaggtgcctgtaatcccagctacttgggaagctgaggcaggagaatctcttgaacctgggagggggaggttgcagtgagctgagatctcaccactgcattccagcctgggtgacagtgcaagactccgtctcaaaaacaaaaacaaaaacaaaaacaaaaaatttaacccttcctaaattgactttccaaagaggttctaccactttgcagttccaccgtggagatcagcactcgttttcccatgctttgccttcatgggtatcagattttccaatacttgccaatgtgctaggtgaagaatggtacctcagtttccttggtgcatttttaactgtgaagttgaatgcctcatcatgtttctctgccatgtgcttgccatctgatcatgcactggtctggctgtcagagcatgaaaggctatggtttgtttcactgttaattaattttcattttcattttcatttaactttaattttatttatttattgtttttgagataggctctcattctgttgcccagtgtggaatgcagtggtgcaatcttggtttactgcagcctcgacctcctgggctcaaatgaccctcctacttcagcctcctgagtagctgggactacaggcacacaccaccaggtagctgggactacaagtgcacaccaccatgcctggctaattttgtttatttttggtagagacaaggtctcactgtgttgcccaggctggtctggacctcctggactgaagtgatcctcccacctctgcctcccaaagtgctgagattacaggtgtgagcccccatgccctgcccaattaatttttaaagatttttttttctagccaggtgtgggggctcacacctgtaatctcagcactttgagaggccaagaagggaggatcacttgagagaaagttcaagagtggcctgggcaacatagcaagaccccatctctacaaaaaataaaaaatttagctgggtgcggtgacgtgtacctgtagtcctagctacttggaaggctgaggtgagaggattgcttccacccaggagtatgaggctgcagtgagctatgatcatgctactgcactacagcctgggtggcagagcaagaccctatctctatttaaaaaaacaaaacaaaacaaaaaaacaaaaaaactttttccccagaaattaatcaaattggaaaaaagcaagttcaagaataaaaacgcagctgaggtagagcagtcttactctcctttgctccttttcctttccaaattaatgaaccatctttaaatttatttgcttggaggatgacctacttctttagctatcacttttaaaatttcttctcttggaacaatctaaaatcatttagttgccagaaattactttgtggtcatgatccgtgaaatgttgagatcagggattggaagcagcagaaatccacctcttgggaaaacaatagagtgaaggcttacccgggatcctctcccgttctcacggcaaacagcctggctctgttaactggatggtatacatggattttctgagaaaaatgtaggtgttcaaagcacaggaaaccatctgggacaccgggacaccattaggcacctcttaatacaagtattcatttcaggttcaaagctttttgtcttccctgtgatttctctgtgatgttttttaaatgggggaaaccctgtagtttctctctgcctaatcttaatcccagttgtagtagcatgtcagtttcatgtttgatttcaaaacgaaataaaccaaaatttaagaaggagagattactgcagtttattggctgaccatctatttgttatatgcaaatactgcaaactgggagtattgaaggattaaatttttcctaattcccaaacctggtggtgctattgaatcacctagagagcttttcaaagacacccctacacctcatcctggatttattgaattagaatcccaggcaatctcagggtctgggattctgtgatttttttttttttttttgagagacagggtctcactgtgtttcccaggctagtcttgaactcccggactcaggccatcctttggcctcagcctcctgagtaactgagactaccagctcctgccactgtgctgggattctgtagtcttaaaatgctcatcagatattctaatgtgtggggtgtgggctccattaccttaagggaggggaaggagtaggcgtaagagctgaataagggccagggagaggttcaggtctaggtgacactgggtgatagcatgtgcagatttcactgagattggaacttgtgtgggtgagagggacggtttcacatgatgaaagagtagcattttccttcacacatctggaggataaaataaaggaaaatatttcttccacataatttcattcctttgtttgactatattaaaaagtgggttgctggccgggcatggtggctcacgcctgtaatcccagcactttgggaggccgaggcgggcggatcacgaggtcagcagttcaagaccagcctggccaacatggtgaaaccccatctctattaaaaatacaaaaattagccagtatggtggtgtgtacctgtaatcccagctactcgggaggctgaggcaggagaatcgcttgaacctaggaggtggaggttgcagtgagccgagaccgcatcattgcactccagcctgggcgacagagcaagactctgtctcaaaaaaaaaaaagtggattgctaacggaggctttttaaaatagattgtgccattcaaggtaagtaggtgttcagtgaaatgcccgtatccctactgagccagaagctgtgacttttcggtgttccccttccatctcattgcctcctaagccctcttcccttatttatcattttaaaacttcccttgtgctgaataagtagacagtagctaagggcttagtttatggcatttgactggtccaaaaatctgtaaagaaattttaaaacctaccaagttgttgaagaatagagttctggctttctcagccacttactattcaatcttgatttcataaatatttctgttttaatttcttccatttattttttaatataatagagacaaggtctcactgtgttgccaaggctggtctcgaactcctgagctcaagtgatcctcttgccttggcctcccaaagtgctgggttacagggtgagccacctacgcctggccatttcataaatacttctttactagcttctgtactccaggaactgtgctaggaactggggaaacagaagttcagttctaaaaaagttaaagttctctctttcatatatttagatctttattccactagctactgatgatgtctagaaggagaaatcttaaattcatttttatatgggttacctattgctccagtaccattgattaaaaagttacctcttgttaaaactcaagtttccatatatgcataaacctgtttattgatttccttttacttttaaattttttctgctgtgtctatttgtgcaataaactgaaagcattgtgggagtggctaaacatctgatcaattataatagcaagcccatggtttaaaatagttttatattctacatctcaagtgttacccttgtctctttcatggctatggtgagttcatacatacataaataccaacatgtggctcgtgggcatggtggctcacacctggtgggcatggtggctcatgcctataatcccagcacttcgggaggtgagggtgggaggatcacttgagcctaggagttcaagatcagcctaggcagcatagtgagaccccactgctacaaaaaatttaaaaattagccgggtgtggtggcacatgcctgtaattccagctagttgggaggctgaggtgggaagatcactagagcccgggaagttgaagctgcagagaccctgtctcaaaaaaataaataaataggctgggcgttgtggctcacgcgtgtaatcccagcatttgggaggctgaggcaggtggatcatttgaggtcaggagtttgagaccagtctgaccaacatggtgaaactccgctttactaaaaatacaaaaaagttagccgggtgtggtggcgcctgcctgtagtcccagctactctagaggctgaggcaggagaatcgcttgaacacgggaggcggagcttgcagtgaagccgagattgcaccactgcactccagcctgggtgacagagtgagactccatcttaaaataaataaataaataaataaaataagaaaatgggaatcgtgtgttcttttaagcttagcttgttttcttggtatgtaatagcattcattaaaaatggtcagatattttcctttttttttttgagacggagtctcgctctgttgcccaggctggagtgcagtggcgcgatctcggctcactgcaaactccgcctcccgggttcacgccattctcctgcctcagcctcccgagtagctgggactacaggcgcccgccaccacgcccggctaattttttgtatttttagtagagatgggggtttcaccgtgttagccaggatggtctcaatctcctgacctcgtgatccacccgcctcggcctcccaaagtgctgggattacaggcgtgagccactgcgcccggccaaaaatggtcagatattttctaaccacatacttatgttctagatgctttgggagataaagaaataaaaacattacccttgaacacctcataattgagatgaggtaaggcctttctagatgaaatattcaacagcaaagattccaataagttggctaggtaatagaagaattgccattagtactactgtaaaaaaaagaatttttgggaaagtgttctaggcagataagaggccattagtcaggaggccttctggtacaagacgtattgagttggtagttcttaaggaaacaatgaaagaggataagttgcagcccgtcgatgttaagagctgcagaggcaatagagagccactgccggcttttgacaatgaacaaaacaaagtttcagaaataccaggtgagtgcgtcgtgaacccctgggagaccctcttgtataaggcagagataacatccgcacagtaaagtggtgggaagtgtgactagaaagggtgacttcagggagattatgttggcaagcattttcacagtgtggtagtgacatctcagatatcagtggggcagtgagatttggcacagggtagaggcttggcatgggggtaagtcacaaacaatgagattttaagagttggaagatggagtacctctatttctccaatagtctgacaagaacatctactccatgatgttggtttcagttatctactggtgtgtaacaaaccatgccaaaaaatttatactaagggtacctttagaacagagaacatcacttgataataacaacttgggactttaaagtaatgcagaggtttggccgggcacagtggcgcacgcctgtaatcccaatactttgggaggccgaggcgggcagatcccctgaagtcaggagttcaagattagcctggccaacatggtgaaaccctgtctttactaaaaatacaaaaattagccaggcatggtggcacgcgcctgtagtcccacctacctgggaagctgaggcacgagaaacccttgaacccgggaggcggaggctgcattgagttgagatcgctctgctgcacttcagcccgggcaacagcgtgagtgagactctgcctcaataaacaaataaataaataaatagaagtaaagcagaggtttgaggcagactctctagataatgacagagggcttccgtgaactcaaagcatttctctaatagtggtctgcgtcacagcagagaccactggcattggaggccatcgaggcttttggagtattgggcaagggaggcacagctgaaggtcaagtttctttctttttttttttttttctgagatggagtctcgctctgtcactcaggctggagtgcagcagcgcgatctcagcttactgcacccccgcctcccgggttcaagattctcatgcctcagcctctcgagtagctgggactacaggtgcaggccaccatgcctggctaatttttctatttttagtaaagacagagtttcagtatgttggccaggctggtctcaaaatcctgacctcaggtgatccacctgttttggcctcccaaagtgctgggattacaggcatgagccaccgtgcctggccagaaagtcaagttttttaggaaaagagatgatcaacactgaaggccccgatagtggctatggagaagtgcaggtggaaccaaagtgagtcttagtagaagagaggactagaggtgagcatggtggctcatggtggacctggtattcccagtactttgggaggccaaggtgggaagatcatttgactacaggcatttgagaccagcctggacaagataccaagacccctgtctctgggaaaaaaaaaaaaaaaaaaaaaagatgagaaaacgagataaaagagatgccgccggatgagcagttggcagatcgtgatggcatcatgccacagtgactgttctatcccagcatggctgggtgcacctaaaaaatgaaagagcctggtcattgactgtattccttccatttgtaggcaaagaaatgaggttgcttggggaatgcgtgtctttccctccagagaagacattttcgctttgtaatttttccatccccagtgtctgccctttggtttgttgttcagaaaacaatttatgatttatttttctttgtgtctgagcctatgatttttttattgaattgagccattacaggccctgggttttacctgccacaatgatgaatttctattgtcactccctgatattgaccacttttagtgaagacatgcttcattggctcctagttttcttcactctgtaaagtatattttgttgtgatacgtaagacaagattgttgatgcatttcacagtttttaacctctttatgttttcagttcttggtgataatttttcacaaagttataggaaattactcaaagaatatgtctttagaaactttcgtttgaaattgtttttcatttggatacatatgtaaaagtcttttgttcgttttaatttttttttcttttaaaataaaaagagacaggtcttgctgtgttgcccaggctggtctcgaattcttgggctgaaaggatagtcccacctgggcctcctgaaattaaaattacaggcatgagccactgcacccggccaaaacagtcttattcaacatcaataatatattgaatcctatagaaacttcaaccttaggtggcctatctactttgaacttacacttgatatgcactgcagtacaaactgggagggagagggggaataggattgtagtctacaagagattgctaagaattagccaattttgctatgatgatttttttcacaaatgacttttttttttgaggcagagtcctgctctgttacccaggctggagagtgcagtggtgctcactgtgacctctgcctcctgggttcaaacaattctcttgcctcagcctcttgagtagctggaattacaggtgtgagccaccacacctggctaatttttttgtatttttagtagagacggggttttaccatgttggcctggctggtctccaactcctgacctcaggtaatctgcctccctgggcctcccaaagtgctgggactacaggtgtgaaccactgtgcccggccagaaatgacgtatttatccaatacttagacatgagttcctgattcctatattgttaacctaaatatttaaatggaaatttttgttcttgttctgctctgttttacatgaaataagctattgaaaagcagtggaacatgtcactacaaaagtttactaaattagtcttgaccattacaatctttgtattccactgacaaaagcagtggaataaaatttaaacaaaaaatagttgaccttaatgtgggcaaaaacccagttgattggttttatagctgatttattttctttgtaaaaccttcaggaactaaagtttagtctgaactcagtttgatggcagttttagattagtcttttttgtttgagacggagtttcactctgttgcccaggctggagtgcagttgtgtgatctctgcttactgcaacctccgcctcccaggttcaagagattctcctgcctcagtcttgcaagtagctgggattacaggcatgcgccaccacactcggctaattttgtatttttagtagagaccgggtttcgccaagttggtcagactgatgtcgaactcttgatccacccacctcggccttccaaagtgctgggatcaaaggtgtgaaccactgcgcctggccttagatcagtcttcattttgttgataatacagaaagctcatttagccttgattaagacaacgatcggttattcgtttgatattcgttaaagacttactgaggtttttgaatttttgtcctaaactgagaatctggtgactgaagagggcttacaattttatcttgaatcgcaacaatgacagagatttcaagtcacttctggaactgtgcctgataaacaatctctgcatgacagggaggaatgcaaagaatgcttaagtattcagggaagtaggtcatgttaaagtattacatttgtcagagaaagtttctcaagcagtccctgtgatcttcagaacccagcttgttcttcgcccagaatgctttagttgtaggcaaatttgggggctgaattaacttcccagccgctaggagggctggactgaaagtcacagattcagcacatgtgcctgcacccttgtcaacaaaaatgaagttacagttataggcaggtgactggaaaaacagtagatgggattgataaatgtttttgttttttttttgagacggagtttcgctcttgttgcccaggctggagtgcagtggcacgatctcggctcacggcaacctctgcctcccgggttcaagcagttctcctgcctcagcctcctgagtagctgggattacaggcatgcaccaccacgccggctgattttgtatttttagtagagacgaggcttctccatgttgagggtggtctcgaactcctgacatcaggtgatccacctgcctcggcttcccaaagtgctgggattacaggcgtgagccaccgcgcctggctgggattgataaatgttgtttctttattgtgggatcctggaataaaaattgtttagagtcaggcgtagtggctcatgcctgtaatcccagtgctttgagaagccgaggcaggagggtcactcaagcccaggagttaaacaccagcctggccaacatactgggaccctgcctctacaagaaattagccaagcatggtggcatgtgcctatagtcccagctactcaggaggctgaggtgggaggattgcttgagccagggaggtctgggctacagtgagtcgtggttgaaccactgcactccagcctggatgacaggttatccaaaaacaaaacaaaaaaattatttaaagagcaaaaagcaagcgctaatggacaattgatgtgtaaataaatttaggaagaagggaaaaccagagagagccttttaactgaacttgaacttggggtctttctttgctgccagtgttcagcactgcaggggacccagctgagcatgtacccagccatttgtggacttaaacatgctcatgtaccaggttttgccctgaattgcatccaagtgctggacaagaggcaccaatccgacagtgctcagagatactgagtaccaggaaaggtggcatagagaaatttgtgctgagtctttgcagaatggagatgcacgagagaaagaaccactgaataatgaggcaggaaggaacctcagcctgttggaagaaatactgattgaaaaatagtctaggaaaagttgagttaaagcttggattttccagactgcagaactttccagaacccttaatatgttaatattattaattattaatcttcaaaaggggaaatggaatgtgcatctttacccaaatacagtttggaaaggccaggctagagaagagagcacaattagaatagcaattcagaaggctttagtagtattttgtggctctgctgtggagaattttgaacagtagggtgtgacttctgcatttattatgatctgcaatataaagccaataattacctaactttatattctaatctgggactgagaaaataatcttaagatattaaagaaaattttctcttctttaggaaggggaaagggtggaatttcattttcttcctataaagatgattgtattttttatatatgtgtgtgtgtgtatatacacatgtataaattttattttattttattttttatttcttttttagatgaagtctcactctgtcacccagcctggagtgcagtgacgcgatctcggctcactgcaacctccacctcccaggttcaagagattctcctgcctcatcctttcaagtatctggaactacaggcgtgtgccaccatgcctgcctaatttttgtatttttagtagagacgggttttaccatattggccaggctcgtctcaaactcctgacttcaggtgatctgcctgcctcggcctcccaacgtgttgggattacaggcgtgagccaccgcgcccggcctatatatatatataaactttaaattaaccaaatatagagagattcttattctttaatctttggttaaatggaaagatatgaaatatgccacaactttttaaaaaataatttcgcttttattttagattcaggggatgcatgtgcaggtttgttagctaggtatatagtgtggtgctgaggtttggggtacaattgatcccatcccccaggtgctgagcgtagtacctaataggtagtttttcaactcttgccccctccctctctcccttgtctagtagttcccagtgtctactgttgccatctttctgtccacgagcacttaatgtttagctcctatttatttattcatttatttgtattttatttttgagacagtcttgctctgtcgcccaggctggagtgcagcggcgtgatctcaactcactgaaacctctgcctcccaggttcaagcgattctcctgcctcagcctcctgagtagctgggattacagttgtgcaccaccacgcctggctaatttttgtatttttagtagagacagggtttcactatgttggccagactggtcttgaactcctgacctcaagcgatccacccaccccagcttcccaaaatgctgagattataggcgtgagccactgcacccagcctagctcccacttacaagtgataacatgcagtatttgtttttctgttcctggcttaattcgcataggataatggcctccagctgcatccatgttgctgcaaaggacatgattttattcttttttatggctgcatgtcacaacttttaaatttacagtatgtgggaagtgccttagattatcctgatgaaagatttcatatttttaatctccttattaagttacatctgtctagacttgctgatactttggggattgggtggaagagaaagaggagtagaaaatgaggataagtaaaatttttttgcattgagcacactttggatggatttcattgttcaaataattctgataatttgcattagatttagtttttattttttggtctccagtaacaactgtttgtagaactaatttctatggcacgtaattgcatgtggagctaaccctcctggggcaagccacttatgcctacaaactctcccttaaccatattttctggggccagagacaattggactactgtggagtgaaaagctgtagattattgtgtcctcaaactctctgccgctcctgcaatgaatactggaggtattgtaactgtatgtgaacttgaacgaagatcaggggaaggtcacacagagccttcttgaatggagttgcaaattcttcctctggcaaatacaagtaaagggaaatgtcacgagtttgttgctttttatggtcatgaagagggaaaaatccccaaagcttgtgattcctttgctgtgagctgaccagctggcttttttcagcattggagaagaacttgagaaggacactgatttattttttccttgagtctgatcactgacagtctcatagaaaagcaaataactatattctgagactgtaactaaactaaacttttaagaaggttgtttctttgtaaaacctaaaaatcaacatagggctattcttgtaagattacttttggccacataaagaggaagagctcattctactgattcctgcttcttaataaatatctactaaactatatgtattttattttattaatttatttatttgagacagggtcttgctctgttgcccaggctggagtgcagtggcactatcttggctcctgggttcaagtgatcctcctgcctcaacctcctgagtagctgggcttacaggtgtgtgctgctacaccagctaatttttgtatttttagtagagacagggtttcaccatgttagtcaggctggtcttgaactcctgacctcaagtgatctgcccacctcagcctccccaagtgctgaattataggtatgagccactgtgcccagcctgtgtgtgtgtgtgtgtgtgtgtttatatacacactatatatatatgtatatatacacataatgtatctatatatgtgtgtgtgtatatatatatatttatacaaaataaatatatgtgtgtatatatatatattggagacggagtcttgctctgtcacccaggctggagtgcagtggcacaatcttggctcactgcaacctccacctcctgggttcaagcaattcttgtgcctcagcttcccaagtagctgggattacaggcgcctgccaccacgccccgttaattttttgaatttttagtagagatggggtttcaccatgttggctgggctgatctcaaattcctgacctcaggtaatccacccaccttggccttccaaagtgctgggattacaggtgtgagccacggcgcccggcctatattttttaaaataacatattttcctaggtactccttcttttaaaaaatagcatatatatttatatatgtatatatatatgtgtgtgtatatatgtgtatatatatacacacatatatacatgtatatatatatatacacacacatatacatgtatatatatatacacacacacacacacacacacacacacacacacgtttaatatgcccacttattggccctttttttccttttttttttttttttgagattggagtctcactctgttgcccaggctggagtgcagtggcactgtcaagactcattgcaacctccacctgccaggttcaagctattcttgtgcctcatcctcgagttcctgggactacagttgcatgccaccatgcccagctaatttttgtttttttagtagacatggggtttcagcatgttgcccaggctggtcttgaactcctggcctcaagtgatccacctgcctcagcctcccaaagcgccgggattacaggcatgagccactgcacccagccgacccttttcttcaatgtaactttctctttttttttttccttgcacaaagcattaacaatgtgaatgaaggacatgggattggatgagccaatttggggcattccacctgtgtctgagggttcctaacacagttgttttactgtgtatttttgtgttaattacaaggttgaaacttgtagagaatcaactaataaagaatcaggtgcatatagaaatataaacatacagtctcttttcttactgtcagttcgctaacgtttattgggtttgagtgcttattaggtaccaagcagttgtttttgggcacttacacatgctattccctatgttaccaacagtttatgacttttgtgaggtgactggtatcattcccgtttttaaaatgagccagtagagtggaaatttaactaggagttggagcttttgattcgatcgctcttgagttcaatgctagaggtctcactcctgtttgggcagctctcagacttggagctcatgggtatgatgagatcactgcagtgtgacaggggccttggctatgctgccgaataggagatgtctctcattattaacttctgggatgtcagacagctcctaagatccctgtgcactctgccttcctaggtatttcaggatgtattactaagatctgctgtcaagtaaatggtgaatgatgatctaataaggccagccccttgtttcagaccctgtcctcacttctcccagcccgtcatggtttagaggtggctaatgccaggctgtaagagctctttgagtttggatgcagatcgtacgtctgaaacgagaattgatactgcacatttttctctttattttgggtgcagtgactcatgcctgtaatcccagcactttgggaggcccccagtgggcggatcacctgaggtcaggagttcgagaccaacctagccaatatgtgaaacctgtctctactaaaaatacaaaaattagctgagtgtggtggtgcgcacctgtagtcccagctgctcgggaggctgacacaggagaatcgcttgaaccggggaggtggaggttgcagtgagccgagatcgtgccactgcaccctggagccctgtgactcaggaccctctgtttatattcctccatacttttcctaaactctttttcttccagcatgcacctgtgcattcccttatccttcactcctcaggttgcatcttgagggttggcatctaaaaaccaatggtttggccggcttcagtggctcatgcttgtaatcccagcactctgggagaccagcgtgggtgggtcacctgaggtcaggagttcgaggccagcctggttaacatggcgaaaccccatctctactaaaaattagctgggcgtggtggtgggcgcctgcaatctcaggaggctgaggcaggagaatcgtttgaaccgggaggcagaggttgcagtgatccgagattgtgccactgcactacagcctggatgacagaatgagactccatctaaaaaaaaacccataaaataaaataaaaaccaatggtttggctgggcacagtggctcactcctgtaatcccagcactttgggaggcagaggcgggtggatcaactgaggtcgggagttcgagaccacgcaaaaatacaacccgtctctaaaaaatacaaaccccgtctttaaaatacaaaaattagccgagcattatggcgggtgcctgtaagcccagctgcttaggaggctgagtcaggagaatcacttgaacccgggaggtggaggttgcagtgagccgtgatcatgccattgcactccagcctgtcgacagagccagactccatctcaaaaacaaacaagaacaacagtggtttttattattttatttatttatttatttatttatttatttatttatttatgagatggagtttcactcttgttccccagggtggagtgcaatggcgtgagctcggctcactgcaacctcctgttaagatagcaatttagcctgttaagataataatttaaaaaactcacatgggagcaaagtaatagcaaatgaatgactagtgaataaattaatgcaagtgggtggctgagttgttatttttaaaaattttttttgatacagagactcactctgtcagccaggctggagtggaatggcgagatcttgaaccgcctcccaggttcaagagattctccttcctcagcctcccgagtagctgggattataggcatgtgccaccatgcccggctaattttttgtatttttagtagagatggggtttctccatgttggtcacactggtctcaggtgatccacccgcctcaggtgatccacccgcctcggcctcccaaagtgctgggataacaggcatgagccactgcgcccggcccaaaacaatggtttttagatgttttcttgctggtctgctacacgttcttcttctgttcagtcagtgcatgtagtaataaataaaagctctgctcattgcttttgtttattttaagtactttttcacgtagtgcggtgtcatggcctcagataaatgtctacataatgcagtcaactttcccacaccttgggtgtcctctaagaaatgcagactacagaatcttgatcatatttatatatgattgtcctttggctctaaatttatcccattatcaggttggcttttattttgggaattctgtctgcatcagaaacatggctaaatgacttcaacttcaagttcaaacacttgaagttcaaaaacttcaagttcaaacacttcatttgttggcattttcatttttagcaagtgaatatctggcatgaattaactaaagtttagaagatctttgtttttcttcttccctccccacccccaaaaagaagaaaattcctaaagctttttgtaatttttatcacaaaataatagacttagtacagggagcatcatgctgaagccttccttaggactgtttcaccagtgaagaccatctcacaggcctgcttggtccctcctgctgttcttttttcaaagctaagagagacattctacaacttcaaatctaaggttttctgggtctcaattcccttatactccagagttcaagcacattttctttgcctgcatgtaaaaggtagttgattagctgaagttaagttaacctttggatttctttccttttcgggggttattttgttttttatagatgggtgtcactcttgcccaggctggagtgcagtagtgcaatcctagcttactgcagcctcaatctcctgatctcaagcaatcctcccacctcagcctcctgagtagctgggactatgggcatgtaccaccatgcctggctaatttatacattttttgagagatagggtcttgctatgttgcccaggctggcctccaactcttgggctcaagcaatccccctgccttggcctcccaaaatgctgggattacaggcatgagtcaccacttctgggccttaatttttctctttgactctcactatgattttgtgagagtctaggtaacttagtggcaggagaattaccacttaacttcctgaaagctttgcttttccactaactcagaactcttcctctaactctgtatccatgcaaaactggttgttgaaacatccattcaacagataataataaattccttcttcagttcacattcttcatttttactcactatactctcttgagagattttcttttcttttcttttttatttttatttttttgagtttcactctgttgcccaggctggagtgcaatggcgtgatctctgctcactgcaacttccgcctcctgggttcaagcaattttcctgtctcagcctcctgagtaactgtgattacaggcatccgcacccacacctggctaatttttgtatttttagtagagacagggtttcaccatgttggccaggctagtctcgaactcctgacctcaggtgatcctcctgcctcagcctcccaaagtgctgggattacaggcatgagccaacacgcccagctcttgagagatcttaccgatgttcttggcttccattacatctatgtgctgatgaatcccaaacctctgcatctctccacctaggatgcctctacttcattgtcttgcccctttaagctgagcccacccagctcaaatctacactgtctgttctcatccctgtcaatgcactctccagcttggggcaggtggagggggcactgtttcatgaggaaagctaatggtatgcagaagggattgaataaaagaaaggaagagaatggagaacatccgcttggctggggctcaatatccaagcatgccaagatgaaagtggagcagggtgcggccttgggaaggagacgtgaatgaactgctgacattccttgaggacaagaggccaaagcctgctggctctaaaactagtatgtttaaagcaaattattagttttgctcaaagtgccactgacatcataaaagaataagatatacctggccaagaccccacctcttaaaaaaaaaaaaaaaaaaaagcttgggcatagtggctcacacctgtaatcccagcactttgggaggccgaggtgggtggatcacctgaggtcaggagtttgagaccagcttgaccaacatggagaaaccccgtctctactaaaaatagaaaaattagccaggtgtggtggcaggcatctgtaatcccagctactcaggaggctgaggcaggagaatcgcttgaacccgggaggcagaggttgcagtgagccaagatcgtatcactgaactccagcctgggtgagagtgtgagacttcatctcaaaaaaaaaaaaaaagaattaaagataaatagtatgatgtaaaaattcatattagaggtacatttttaggtaatatatctgtaatgtttttgacaaaaataaattaatttagcttcaaacatctcattcatttgcaaaggatgattttgttgaaagcttaaatctgtgggaaaataatttttgtctaaaagtttatgttggccgggcgcagtggctctcgcttgtaatcccagcactttcggaggctgaggtgggcagatcacctgaggtcaggagttcaagagcagcctgaccaactggtgaaaccctttcttgacaaaaagacaaaaaattagccgggcatgatggtgggtgcctataatcccagctactcgagaggctgagacgggagaattgcttgaacccaggaggtggaggttgcagtgagccaagatcacgccattgcactccagcctgggcaacagagcgagactccgtctcaaaaaaaaaaaaaaagtttatatcttagggacaaagttaaatttatacatgtaaatcaagcctcttttttttttttttgcaatagctttactgagatactgtaactcacataccatatagtttacccctttaaagtgtacaggtcagtgggttttagtaatcaaagcattcttagttgaaaagtgttattgaacaactggaagcagatatttgttaactggtctgacttatgttcatatgactgcttaaaacttttcctttgcaggaattcagctagcccattctaaaaatggtccaaaaatcagaatgtaggaagggaactgctattgctctttgaactttaaatagtcactgtagggatatagtgacccaggaaatcaattagctaaactgacttcaatccagtagatttaaaacataacagaagaaaaccaacttgaaaaaagaaaataaacatacagtattatacctttagggaaaaaggaccacttagtttaaattcaatattttaaaagtcaagaataataatgcttgttaaaaatctaacagtacatgcaaaggtatataaaagctgctctttgtcctttcccatccatccctcatcagtctgtcaccagaggaaccatagttaatgatgattataataaccttcctgggcttcagtggattactcaacaactgtgtgagaaaagaaattggtgatcgttaggagtcagtgtgggttcactaaggatgagcccaacaatgacatttatgtaatattcttttcgttcttcctttagttggtctttttgttgttgttttcaggttcctggactccaggatttgggggactggactgatgatggtgattctgcatttcaccaaagtgatttgacaaaattgagtcattcagcagctctgtctaaatgtgggctgatcaaaatatctggaataaatgtaattgatcatcctggtcagagctgtctgctgtaaaactctccttggccttgccagggttaattctttatcaacttgcatgagaagtgaagacggacatctcaaagtgacaaatgatttaaaaagttaaaagttaggatagatagctgatgctggatcacatatttttctcttctttcttttttaaattttttgatctttacttcaattatcttctgtcattgcttatttctttcactactcctatttaaatatttttcaaacttagatatggtgccagcattttggtataaagaggaaagacagtgttagctctcagtgcagcagagcagtcagacttgaagatggcgtaaggaggaaggcactggatctgtggaaggacagaggagggaggagtctaggtagaatagaagaaaaacaccctgatgaaatgcatcaattcctgtgcattttagaagatcgaattataaagcaatttggcaacatgtctcaccatataagtgttcatatcctttgctccagtgctgctaattctggaaattcaacaaataaataacacaggggaaggaaaactgtattccataaaatgtttgttacaaatgtttgccatagccttgtcgaagatgttgaaagatcagttcagtgaatcatgtatggtacatatacctgatcattgtcattcaggggcacaggagaaattttagctactaggagaaatgtttatggctgtgaaatgggaaaatatgcaaaactgtattccacaatagtaattgtatttaaaaaacgcatgtatgtggctgaaggttgaaaggagatactcaggaggctgaggcaggagaatggcgtgaacccgggaggtggagcctgccgtgagccgagatcgcgccactgcaccagcctggcggacagagcgagactccatctcaaaaaaaaaaaaaaaaaaaaaaaaaaggagaacatgaaaatcacaaagtgttggaatgatagggttttagattgtttcatcttttcaaaactttcatttctctttcttgagattttgtaaaaaaaaaccagcagacagatcaacgggaaggaattgaggatgagggagaatatagcttataagtaggggagaaggttaaaaattagctgggagtttaattgattttatattcactgtaatctcaactgtgagaaggtggttaatatagagcattttgaatagactcttatgccatattaatagaaataacaccatactgttgtttgcaccagtcagcatctatttggactattgtacttaattgacatagtcacattttaatgtcaggcattgctgcattaaagtcagacatgtagattttggaccttaaaagactcattcagttttcagctgtttgagagacagttgtcaaagcatcagtagacacatcacagtgtggaagagtccacagaatgccaaaccctggccaacagagagagggtggggtgtggagtagggctattgggtggttttcagagcaccaatccatttcctctgacgatttttgcaaagacagtcatagatatgtagaacaaacaacaagattttgtgtctatagttattatttaccatttctgatccctgttttcaggacctattacatttctagaatgtagccataaaaagacaccatcgctatgtatcactatggttaatgaaggcttttcataggcaaaaaatagcagggataatggcaggaagttacagtgtgaaaggttccatggaaggtggatgtggtttcttcaccggatttttccattgccgggagacagacatcgttcctcaggcacccaaacctgtctctctcggcgtttgctgatagagtgggctgaatggtcatcgtccttgtgccctcttcagttgccctgactcctatgcatgctccttgagtgtcaccttcctacctgacagatgccatacccttccatccccaactcccattttatcttttccttctaagctggatctaggaaccctcacgggacccacaagtaaccgttattaaaacagtgtgactgctgggtggggtggctcatgcctgtaatcccagcacttcgggaagcgaaggcaggcggatcacctgaggtcgggagttcgagaccagcctgaccaacatggagatgtatttttgtatttctactagaaatacaaaattagccaggcgtggtggcacgtgcctgtaatcccagctacttgggaggctgaggcagaagaattgcttgaacccgggaggcagaggttgcggtgagctgagatcacgccattgcactccagcctgagcaacaagagtgaaactccgtctcaaaacaaacaaacaaaaaaatagtgtgactatatgttctcaaatatatgtatttaaggcaaaaataacacttggcagctatataaaactagatttagcatgaatctgttctttttgcttacaagggaagataagacttctaaccaaatacccatattatatggaaacttccaattctatgtaacgtttccattttggaaaagacttgtggttttttgtttgtttgagtttttttaaattctttaagacagattctcactgtgtcacccacactggagtgcagcagcctgatctcagttcactgcaacctctgcctcctgggttcaagtgattctcctgcctcagcctcctgagttagttgggactacaggcatgtgccaccatgcccagctaatttttgtattttttgtagagacggggtttcaccatgatggccaggctgatctgggactcctgtcctcaagcgatccacccgccttggcttcccaaatttctgggattacaggcatgagccaccgtgctcggcctgttttttttttttttttttttttttttttttttttaatcaacatctaaacccttactttaatattacagagggaaagttgaaaattgggcttaaaccaggtgtgagaaacatttaatatctaatgattaaatctcatggtcaagatgaaagatgttcagtcttaggtgaaatctttctcacaaaagttttctgtggacagttgaatgtagacagtacaagtggcttttttaaaattttgaggcaggtctttttgaagacagctgtagcccattagtaacggtcccattcaaggatggatgataatcccaaaatgtcagtggcattttcagtttttttgtgtgtatttcaattttatatttttttctaaaattttttattattcagtgcagaatttttctcaatagcattttagacttgtttgtcatcctgtttgtcttctccaaatttagtggaaaaggaacttctttctttcatagaacttgccaagacatctggggaggatttcataattaaagaatgtattttatttcctttaggaatcaacagcacttgaatctgatttgccatgacacttcagtgttgctcaactcaagaggcattgtagttccattgtagttcttgtttatgattaataggaaatgaatactctggagcagatacatttaccccaggaagatatctctggatcactttgcctccgagcactcttcctctgagatattttcctagtctcaattgctggaaaagtattaattcttccaggtttttcagataactttgttaagataataattcacgtactgtacaattcaccatttaaagagtacaactcagtggtttttagcatgtttacagagttgcataactgtcatgatcttcgaacattttcactccccaaagaaaccccatacccagtagccgtcactctgcatttcccactcccctcattcccagtaaccacagagccaaatctgtctctctatggatttgcctattttggacattttgtatcaatggaatcatacaatatgtggccttttgtgtctggctttcatttattatggtgtttgcaagattcatccatgttatagcgtacatcagtacttcctgttttgttgttgttgttgtttgagacagtctcgctcttgttgcccaggctggagtgcagtggcgagatcttggctcactgcaacctccgcctcctgggttcaagtgattctcctgcctcagcctcccgagtagctgggattacaggcatgcaccaccacgctgggctaattttttgtatttttagtagagatggaatttctccatgttggtcaggctggtcttgaactcgcaacctcaggtgatctgcccgcctcggcctcccaaagtgctgggattacaggcgtgagcctctgagcccagctggttttttaaactgctgtataatattccgttgtatggatatatcctacgttttatttatccatgcagcagttgatagacattggcattggggttgcttccaccttttggctgtcatgaataatattgctatgaacactaatgtacaattctttgcctgaacgtaaatgttttcatttctcttgggtatttatctagaaatgaaattgctgtatgttaaccctttgtttaacctcttgaggaactggcagacttttccaaagcagctgcaccattttaaattctaaccagcagtgtttgagggttccaatttctctatatccttggtaacacttgttatctgcccttttggttagagacatcctagtgagtgtgaagtggcatctcactgtggttttgatgtgcatttccctgatagctaattgtgtggatcccttttgcttttagtgaatgaaatatctggtagtctcgtatgccaaactaaagctaaaaattaaaaatgacttctgaaatgaatgtgtatatgacagacatcatgatgaatccaagtgagcattatgcactcgtagcaatcgaagcagacttctctggcttctgaataacagttcttagagttctaatttagtatttggatagagttactgcttctagtttggggagttagttgctaaaataataaaatgtctccatggtagggaggggtgatggtgaggaggtttgctggtggttggttaagtatgtttcccaccaaatatgccgaagcagtttcttctgttagttacaggtcagaatctttttgccatctttgctttctttctcctgtttgcatcctttttgttgttgctgaacttttttagagtaagttttagatatcagacacttcactcccagatagttcagcatcgtctcctgggaatatatccctacattcttctgcttacccccagtgccattatcacaacgaagaaacttttttttttttttttgagaggttctcattctgtcgcccaggctacagtaaaatggaatgatctcagctcactgcagcctctgcctgccagtctcatgtgatcctcccacctcagcctccggagtagctgggactacaggcctgtgccaccaagtccagctaatttttgtattttttgtagagatggggtctcactatattgcccagactggtcttgaactcctgaggtcaagcaatccgcccacctcggcctcccaaagtgctgggattacatgtgcgagccactacacgcccccagcccacaactgaaaaactttaacattaattgattttatttatttgtgtatttttgagacagagtctcagctctgtcgcccaggctggagtgcagtggtgcgatttcggctcactgcaacctctgcctcccgggttcaagtgattctcatgtctcagcctcctgagtagctgtgattacaggcgcttgccaccacgcccagctaatttttgtatttttagtagagacggggttttaccatgttggccaggttggtctcgaactcctgactgcaaatgatccacccacctcggcctcccaaagtgctggggttacaggcgtgagccaccacacccagcccaacgttaatttaatgatatcatctaagatagagttcgtattcaaacttcctctgttaaccttaaatatattttatacctgctttaaaaattgggtcctggccaggcatggtggctcatgctgtaatccctgcgctgtgggaggctgaggtgggatgatcacttgaggtgaggagtccaagactagcctgggcaacgtaatgagacttcagctctataaaaataaaatacaagaaattagcccagtgtggtggtgcaggcctgtagtcctagctacttaggaggactaggtggaaggatcccttgagccaaggagtttgaagctgcagtgagctatgattgcatcactgcactccagcctgagtgacacagtgagaccctgtttcaaaaaaaaaaaaaaacaaaaaaaacagtggggtccagcatataaccaaattgcatttggtcatgtttcttttctagtttcttaaactagaatactccctttgcctttctgtttttcgtactccctttgccttcctgtttttcatgagatgatagatagatagatagatagatagatagatagatagatagatagagatggagtctcactctgtctcccaggctggagtgcagttgtatgatctcggctcactgcaacctcggctcactgcaacctctgcctcctgggtttgagtgattttcctgcctcagcctccccagtagctgggattacaggcatgtgctgccacgccctgttcatttttgtatttttagtagagacagggttttaccatgccaggctggtctcaaactcctggcctcaagtgatccacccgccttggcctcccaaagtgctgggattacaggtgtaaggcaccgcacccaacccatgagatttatttttataaagagcccaggccagttgtcttatgtagtggatttgtcagatttatctatgattagattcaggctggacattgttttatttttgagacagagtcttgctctggctggagtgcagtggtgcaatctcaactcactgcaagctccgcttcccgggttcacaccattcttctgcctcagcctcctgagtagctgggactataggcgcctgccaccacacctggctaattttttgtatttttagtagagatggggtttcaccgtggtagccaggatggtctggatctcctgaccttgtgatccgcctgcctcggcctcccaaagtgctgagattataggcgtgagccaccgcgccccgcccaggctggacattcttagcaagaataccacttaggtgatgctgtcgtgatggtgcggtgatagtgagtctttactgttgtatcacaccagcaatcacagacaatgcctgtccctcctgttattgctgatactgagtttgactgttagatgctagtaagggctgagtttccctgtggggtactatggtagtttcataccggtgattccattgccagtatattcacatccagtgatgactctcgcgtaaatcactgtgaaatggtgactttctcatctgttattcttttctatatttctccatctggcattcttccatataggtgagctttttccttttaccctcatctctccctttgttttcccttaaaagttaaacatcttttttccaacaatgaagttattgaacgtatttccaacttttatgtcaaacttaaggaaagagacctccagcaggccagttcaaagactcttttggtagacatatttaatggaaaaagaatggctaggtggttacttttagactagttaaaagaatgaggccagttgggcgcagtggctcacgcctgtaatcccagcactttgggaggctgaggcgggtggatcatgaggtcaggagttcaagaccagcctgaccaacatggtgaaaactccgtctctactaaaaatatgaaaattagccgggtatggtggcgtgcgcctgtaatcccagctactcgggaaactgaggcaggagactcgcatgaacccaggaggtggaggttgcagtgagccgagattgcaccactgcactccagcctgggcgacagagcaagactctgtctcaaaaacaaaaacaaaaaagaatgaggtcaaaatggtttccctcagttctttttttttttttgagacaggatcttgctcttttgcccagggtggagggcagtggcgcaatctcggctcactgcaacctctgcctcttgggcttaggcaatcctgtcacctcagcctcccaagtagctgggactacaggggcaggggcatgccactacgccctgctgatttttgtattctttttgtagagatgggttctaccattttgcccatgctggtctggaactcctgggctcaagcaatccacctgccttggtcttccaaagtgctgggactacaggcgtgagccactgcacccggcctaccttcagttcttgaagatcacctgggggtgtggtgatggtggaggaggtgggggggttgggtagtagggaagtggtttaaaattatagatcatgatttcgttaaagtgtatcagaaacattttgttgggaatgttttcctgaagaaagtcatgaattaaatcatgcaaaaaagttctgtccttgagaaggtagggatctttaagcattgtaagtatggaaattagaaattatagaaagatttaaaaatataacaaaaaatagaagttcctatttaacacaaccattatcacttttgtgtgttcttagaaaaaaggagtgtttgtgagttgggggcatctcacaattttataggcagtttctaacttcaaaggcatttttgagaaaacctcaaggtcatagaaacagtagtataaaaatggaggtaagaatttctaattgtcactgggctaggtaactcattcctgtaatcccagcactttgggaggccgaggcagatggatcacttgagctgaggagttggagaccagcctcggcaacatgggtgaaaccccacctctacaaaaaatataaaaattaaccaggcctgatggcacattcctgaagtcccagctacttgggaggctgaggcgggaggatcgattgagcctgggaggtcgaggctgcagtgagccgtgatcgcgccactgcacttcagcctgggtgacagagcaagaccctgtctcaaaaaaaaaatttttttttaattgtaatttttctcacaaacatgtttgacccatatgtgataacgtggtgacactggttgtactccccaaccactgtttctgttccccagcaaggggatctaaaccgtttttcttcccagctcttgcttgctgtgtctggaaaacacatttgaaaggcgagaggtttgcattcgagagaggctggggcttgatggtgtccctggagtttaaaaggctgaggtttccaatgctatttgctttcgggatgttgagccctcagagtaacagatgccctaaaattgtacattttccatctagaaaaggggaaaaaaaatctgtagaagaatggattatgaaaaacaaatctaccctccaagaaggtggtcaacaaaacagcgtgactgagaccttcactcagaaattccacgatagcagacgtcacctttctcatgttcgtattttgttgtagaagacatttgggtgaatcattgacagtctttttttatcagaatactttaatacattttacattgatttaggaatttggatgttaaaaatgagaaatcttttacgatggcatgatcactggaaggagtaaggttttttgggattattttcctaccatctgttgtcagcaggaccacctgcgtatcattttccttccatcaaatgtatgacttagccgccaagtggtgcctttgtattttccactccagtgtgggattgcagaaaggctgtttttatgcttatttttgttgaatggttttatgctgatgaaatcaattgaatacctcgttgatctggaaagttgttcttatcatctggacatccagactggttccatttaattggttagcatttatctttgcagaaagaaaatcgctggtaaataaaaattagactgaacataattattaatagatgtcaccactaagcatttgtttgccttggtctaacagttgttggttaacacattgatcagattggagttttgtgtgtaaacatacttttggtgtagttttgagcctaaggagaccttgaaatgcaattttcagtgtagaacaaaaaatcttgtacttaaataaaaaatctttccatgttcctgaacaccctttaaaaaaaaatcttgaataaaatttaaatgtagcaaagctaaaattgtgtaaaagttcattttaatagcaaggtgtcctggtggttatagtcactgattgcaagtgcttgctaatagagccaggaatgagtggcaaatttagattccttcctccaggaatttgcttcatgtttgaaagtgattaagacattttcatagctgccagtacattcagttgcatcagacatttgctctacccatcaaaacatgtctgtagtttttgcttagggctgtaatggaattgagaaaggatggctaattagagtaactttgcttagtcaacggtctggctgttgaagggatttggttcctccagtgctgaccagccttgcagtcactgcagagcaatctcccagtggacggagcctccctgagcctcgcacaaagagaagccagcgcagctgggagtggctccaggagcacaaaacactaggggatccaagacttgaagaaacttatgtatttattatttatttatttgcctgttccccctagcaagtcactgattgtgctttatcacgatcgtatgcttttatgaatgctttagatcacccattgatgcctctgtccctttttcttgatttatctgtttagtagtaagaatacaaggggacttgtcctctaagtctatcttttatggaatggtatggaaggattgagtttttcttggcagtttgaggtggaattctttgtgtatgcatctccacgggcacataatcaattgaagcaatttaagtcaaatcttgctcttggtcatttagttaacaagaaaacaaacaaacctaaaaacaaatacaacaacctgtgcaatcttgaagataccgaagaaaatgaataggaatccatcctttcctaggtgtcattacttctgcagctgtttaaaggtgggtttctacacactggggctccagatgtccaccgtagcagatggagagattgagcaaatgtctgaaaatggctattaattaatgaggttgcaagatacttttgtcagttatgaatgtcacgtagactgggatgctttagtaagcaatatgtatgctcttgatttaaaagacagcctggattttatcttttgggggagaggagtactcgtatgataaccacacctatagacaaaaatcctggttcctgtctctactcctctttaagaagtgttttttaagtgcaaaatggatggtaaggcgtattgtttctaaacatctagatgtttccaataggagaactttgtagaactgaaataatttgaaacaatacatgctaaattcctttacctcaaaatttggtgcttggtaaatgatagatgtttaatagatatttattgaatgagttaactattagggcttacaaaatgatcaggtttaaacctgcaagcagactcttgcctcctattttgtattttctttggtaatcttttattttaacaggaatataaatcccattttttatttagttttttcttttgttcttcaacaaatataaaagacactttcaatgtgaataagaatataatcaggaacaaattttaagagtaatatgtggattttgtaaggatttactcttcaactgtattggttcttctggtgctgatgtttttcctaatgttaaatacagcattaatcattgaaatacgtaagacatgttacgtcttcccttttcagatccttaggcaatagctaataggtttatgtgtgtgtgtgtgtgtgtgtgtgtgtgtctgtctgtttatttttttctacctttgtcttactattgtggaagggaaataatagaatttgtcctcttttatattttatttaaaatctacaatgatgaaaatgtatcacttaaggtagtaggtaaaaagtttatggattaattttgtattaactttctttgaggtctataatttattaatgtggatggatttacaatgaaggggaattcagatgttgtgttttttttggttttttgtttgtttgttttgttttgttttttgagacggagtctcactctgtcactcaggttggagtaaagtggtgcgatctcggctcactgcaggcttcgcctcctgggttcaagcgattatcctgccttagcctcccaagtagctgggattgcaggcgcccaccaccatgcccagctaatttttgtgtctttagtagagacagggttttgccatgttggccagactggtctcgaactccttacctcaggtgatcctccctccttggcctaccaaagggctgggattacaggcttgagccaccgcacctggctgtgtcatgtgtttttatcaaagaagaatcatagcatcgtaaatccagttggaggtcagtttctgggaagttctgttctttgactactgttgtattggagatcactttctctctgagatgatgttattggtactgcaattaatgaacggtagtgtctagttttttttttttgagacagagtctcgctctgtcacccaggctggagtgcagtggcgcgatctccgctcactgcaagctctgcctcccgggttcacgccattctcctgcctcagcctcccgagtagctgggagtacaggcacctgccaccatgcccggctaattttttgtatttttagtagagacagggtttcaccgtgttagccaggatggtctcgatctcctgaccttgtgatccgcctgccccggcctcccaaagtgctgggattacaggcatgagccaccgcgcccggcggtagtatctagttcttaacttagcatagaacaatggtttttaaagtgttcttcattaaaacttacttcatttctgttttctaaaattcctaaaataaattgttcaataagcagttatagtggatttgaaatagagaacacacctggagtgtcattactgcctacactgcttgagtggcctggagggctcacacccagaacctgagtcggacttacttaggaagacattctctgttgttttagtgttttaaaagattgtattccctggtctcatcaaaatgttatctttttttaagaaagtagggatagagaaggaatttctctggcatggtttctaatcctaacaaggtctgtgatgcttggcaagtaacattctttcaggatttggttctcgtcagtgtcatggaagggactgttttaggtgatcttgaagaacagctcttcaggttttaaatttttgtgtgtgtgtgattaacttaagaatggtgagtgtatttatatacaactctccttgacttaggaaaaaatgtacagcagtttttaatatgtatgcaagaagaaacgagaaatatacgataaaggataaaggtgggaaaaatctgaccatggagaaggcattctataacattttaaaaatttactttctctctgtttcttttaaaattgacccttaacactgctcggtgaggcatttaaataatagaaacgggctggagacaataagcaagcaaaagccggcgaggtggcaggcgcctgtagtcctagctactggggggaggctgaagtgggaggattgcttgagcccaggaggttgagtctgcagtgagctaacgattgcaccactgcactccatcctgggtgatggagtgagacctggtctctttaaaaaagtaaataaataagcaagtgaaatcaaacttgaaaaaattttaaataaatatctttttttaagcataaaagtggtatattgtcattgtgcaaatgccaccatataagaaaaaagttccttcattccctcttgtcttctgagatttttcttacatacacaaacaaacatatcctttcggttgttgttttttttttttaaatatgcatatagataatactgttgcgtaacttgcctttttcactcaataggaaatcataagcaccttttggttcagtatacacagatctggctcactgcttaatggctatatgttcagtgacatggatatactctatatttttaaccagtctctttactgattgacatttaagttgattctgatgatctcctattacaagtaatgctgaaatgaacatcctttcatatataatataattttgatatataaaatgaaaattatgtataatatacatattcatttatgcttgtgcaaatatttctataggactaattcctggatgaaagggaatgccccacccttccacccttttctatatgataaatttctgacacatttacttgttaaccaaggaatgacttaagtttcaaaatatgcttaatgcattcagctttcaatagctcacagcacacactgtatataaaaatatggaacgctttacaaatttgggtctcatctttgagtaggggccatgtatcgtttccattttagtgtctgtgctgccaaaccaaacgagcgctcttttcttttctttctttttctttttcattttctttttttttttttttttgagaaaggaccttcctcttgttgcccaggctggagggacacaatcacacctcactgtaaccccaaagtctgggctcaagcgaccctcccacttcagccccccgagtagctaggactacagttgtaggccatcacgcccagctcttttctttttgaaaatattgtaatattagatactttacggaatactcacaatgccccattttggcaatcatatttcacaaacctttgacttttgactgagttgcagttagcttgaaacactcgcgttttgctttcacttagagaattaccatttcttatgtgtaattctaaagatatatacagttaacaaggtcatgtttaaatttaccagtaaacacattggcagcttctttccattctgcaggaagtggctgtgtttctgtgctttcatcctgttatttccttagggtaaacatctaggcttcatgcaaagtagaaggggcatgtgcgtggtgttcaggatgtggatttgaatccccaactcagccacttacattagataagtgacttaacttgcgagcctccctctacaaactggatgaaggttgctaaagaatatgtttttacaagttgtgctaattttaatgctactgagaacaaatgagtgctcagatttggccacgtcagtgatattggtagtgttactttgacaggtgaaggatggtgttttaagtttgccttgacttttgcatttctgtaacgtatgggaagagataactgtaattctgtaggtctatgtattggttcgctattttaatttcaggttatgagcagatttagtgcccactttatcttttgaggtcttcttatatgcttcagatctcatggttgatacttcacatttgcaagaatttctcctacacatagggaatagcctcccaaatcctaactcaacccattgtattttgatgatgctatatagaattttaagtcttggaattggggcattctatgtgaggctaggacccaatttcctgcggcttcattcttttctccacacacgtttgttttatttatttgtttattgagacaaggtcttgctctgtcacccaggctggagtgcagtggtgctcactgcagccttgacttcctgggctcaggagatcttcctgcctcagccttctgagtagctaggaatacaggcctacaccataccctcccttccccaacacccagctaattttaaattttgatgtagggatgaggtctccctgtgttgcccaagcttgtcaaacacctggcttcaagagatcctcccaccttggcctcccaaagcactgggtttataggcgtgacccaccaagtgcagtctggcatgacctcccatgccagaatgtgtgatgcaggagcgggctgtcctcttccccctcctgttcccgctctcagctgcccatacatctatttttattttttctgagatggagtcttgctctgtcgcccaggctggaatgcagtggtgctatctcggctcactgcaccctccgcctcccaggttcgagcgggaggcagaggttgcagtgagccgagtagtagctgcctcagcctcctgaatagctgggactacaggcgcgtgccaccacgcccagctaatttttgtatttttagtagagacagggttttgccatgttggccaggctggtcttgatttcctgacctcaggtgatccacccacctcggcctcccaaagtgctgggattacaggtgtgagccaccgtgcccagcctgcccatacatcttaagggacctccagctcacgcatgggggttttccagcccacatgcccaaccttcaccaaaacaaatgtgctgtagccctttggtctagaggtgcccagggaagaggcttgcataggttctgagaattccaaatcttgggcccccaggacaggtggatgttaatttcaggaaggtttgcccttttggttgctgcgggggaaggatgtagccagaggagggccagaatggggctctccgcagtgaggggctctgcctgggtctgatggtgttactgctcacagggattctttgaagcagctgctgattccccgacttctcttgtctattggttgaataatgttttccctgctgtctacctatcaggttattcattcctgattactgtcaatgttcaggctggtcaaacttgaaatcattaactatataaagtgtattatgtataaagtgctagatttgtaagaaagttgctatcttcatcttcatggagtttagtttttatcttggctaagctcttgctaatttcccacagtatagcctgcactcatgttatgaaaaaatttagatgactgttgaagagtattcaggatttctttcttacttctcggcccaggactgagcctttatgaaagtgggtagcaggagattttagaaaagtggaggcccttgtataaggaggctgggctccatttaatgacggtgaggaggcacactttaggaactaaaggagaccagcatgacagattgagcgttaaggtagaactaaacaagaggcactcaaaggcagggagatcagctcttaggatattgcattaaatcaaccatgaaatgctaaagcttgaactagggcagaaatcaagcaatgggtacagacagcattgaacacaaaagaaatggtaggatttgagggagcatgaggatgaccaagatgcagaaaagcccaagatggtctccaggtttctaggcttttccaacgaggatgctaattctttgcctgaaaaagagtattatcaagtaaagacatggtctcactgttgacccagaaaatagagggacagggtaacaaaagcagtgatttgttttctgtaatactaatggctgacactgactagtgcttactgtgtcaggtgctgtctgtcctacgcgcttggtacacttgtgatagacacttataaatccccattgtaccaatgaggaagcaggcacctagaggtgaaggaaccttacaggtagggcctcttctcaaggcgaggcattctgatcagagaatgcctaagagagggagagacagagacagaattcagtataaagacagaaagcccactgttaaaagcaatgtcaggtgtttttctgagagctcagaagctgtcactgacataaccaaacctcaaatccgggagtcattctttttccgttggcaagtcccgcaggcctcatctccaaagacatttcacatcgacccattctgtccacagggccttccctggcttcatttctcccctgaatggacacagcagcagccttcctgcctccagcttgctctccttcagctcctctctgcaggcagattgctggtttgggggtttttagggtttgtctgtggtcaatttatatctgataaagcgagcaagtcttaagcgtatagcttggtgagttcttacaaggtgaacgcacgagtaaccctctcccaggtcaggttggagaacctcgccagtgccccagaagcctcccttgcatctcctcctggttattgctccattacattctgacttctgtctgcacagatcagtgtcacacatcgttcaccaggtatgcagtgatctttgaaacctgcacgttgagtcatgtcgttaccagaactcctggcatcacttccacattgcactctttgccattgcctgacatgagataaataagaatgcatggctgggtgtggtggctaacacctgtaatcccggcactttgggaagccgaggtggaaggatcgcttgagcccaggagtttgagaccagcctgggcaacatggcgaaaccctgtctctacaaaaaatacaaaaaaattagctgggtgtggcagtgtgcgcctgtagtcccagctacttggggggctgaggctggagtattgcttgagcctgagaggtcagagctgcagtgagccataactgagctactgcactccagtctgggcaacagagcaagaccctgtctcaaacaaaaccgaaaccaaaaacaaagaatgaacacatgtcgatgtcttatttctctcttccctgccattggtactttttgcctattcagatccagctcaaaactcaactttttctggtacactttctcttatcaacagaactgaaagagacccctccctgttagtactatgtgtcttagtactctgtctttgatgtgtggcacttccttttgacttgacgcatccagatgacataggaacccatcacagggattaatcaaatgttgactaacgcatggggacccagggtggaaccaaagcttttgcaaaatgatgaacattcagaggctttggagagtgaacttggaggtcaacaaagagaatgaaatgcaagatgcagtatgagcatgtggtgggtctggactgcaagattcaggcactttattttaggaatagttaatgtgaagaacatgatttatgaacgacagagtggggagtgtattgagaccaagtaagactaatgctccattgtgaaaacttacatatcaaagcaaatatattgtcccctctgtccccagaagcaataactggaaacagttttagaggacataacctaattggtataaaaacttttcactctcagaactatttttcccattgtcataggagtggataccaaataatgttttcctgtcttggcagtgattcacattactgagtttgctattgaactattttttccttgccaggaagtacacatcagagagctgcatttcactgtgtgtgtgtgtgtgtgtgtgtgtgtgtgtgtgtatctatttcaatctactgattaccaaagagcttataattcttaatggagagtttgtggaaaagatgaaaaaaggatttttttaaagaacaataaccagaaagtttgagacaattgagtattatagcaaagtcctttcttgcggtgacttctctggttgtaatgtcttgggttaaaaaaaaaaatcaatttcatgcaaaaaaggggggaggattatgtaaacaaaaacaaaaaaatttaaagtatcacagtctatcatttgggtgagttgtggaggggaaaagaagtcatttgtacagtttgatgaagaaataaatgtattttctagtttctaagataatctgtgtatgctctaaacttaaagcacatcatttcctgtaagtcagtatttggttcaaaagtgcaaaggctttatgattgatcatctacatctatcacatgattatcttctggaggtgataatttttttttttttttgagacggaattttgcgcttatcacccaggctggagtgaaatggcgcaatctccgttctctgcaaccttcgcctcctgagttcaagcgattcttctgcctcagcctcccaagtagctgagattacaggggcaccaccatgcctgggtaatttttttgtatttttagtagggacgaggtttcaccatgttggccaggctggtcttgaactcctggcctcaggtgatccacctgctttggcctcccaaagtgctgggattacagccatggaggtgataatttttttaaaagattaaggcaacagcaatttgagagtgagtcattgatgggacacttgtttagggaaagccctttttcctgcagaagcaaacttgcttcaggaatggcatcaggctgaaagcattttctttgcatttcaaataaagttggcaagaaagctggcacctgtctgctccatttctgtgctgttactacacacatacgttctactttgcttgctgtcaaggttcaagatcagtaacagcagggagggggcatttcccagaagcccacacgacttcatgaggaagcgccaaccctcgctggatggggcgtcggcttgcattcttcggaaacagaaaacaaaacaaagaaactctccctttctagtcactcacatgtgaatattggagactgtttcactagcagttatagtctatacttcttgaaatcatttagtttgcttacagatcttgaaccaagtggttaaggaatgaatcctttccattgaggtatccgttatctattattatttatttaagcgcatatgaaccaaacgagccactttgtactctgtctttccaggcgtcaaagcagggtaagttgcccctcttgactgagtcccgaatgtggtctgagtcagagaaggttagagctcagagctcgagagagttcaggtcttttacaaaacaaaacaagtcaggtgagaaccaaagctactgctgttgacttgaccaaggtcccacagttgttggggtggcagcgatggggtaagcatattttctttttctttctttttttttttttgagacggagtctcgctctgttgcccaggctggagtgcagtggcgtgatctcggctcactgctcacctctgcctcccgggttcacaccattctcctgcctcagcctcccgagaagctgggactacaggcgcccgccaccatgcccggctaattttttatatttttagtagagatggggtttcaccgtgttatccaggatggtctcgatctcctgaccttgtgatccacccgcctcggcctcccagagtgctgggattacaggtgtgaaccaccacgcccggtctattttcttttttttattttgatttcattttatttttctgagacggggtgttgctctgttgcccaggctggagtacagtggcacaatcatggctcactgtggcctcaacttccttggtctcaggtgatcctcccaccttagcctcctgagtagctgggaccacagacacaagtcagcacgcccagccaatttttgcattttttgtagagttgggatttcaccatgttgctcaggctagtgtctaactcttggactccagcgatctgcccacctcggccttggaaagtgctaggattacaggcgtgagccatcaggcccggccatgtttacttattaatattttaaagaattatgaggaatgcttttacaccgttggtcggagtataaattagtcaaccattgtggaagacagtgtggcgattcctcaaggatctagaaccagaaataccatttgatccagcaatcctgttactgggtatatacccaaaggattataaatcattctactataaagacacatgcatacgtatgtttattgcagcactgttcacaatagcaaagacttggaaccaacccaaatgcccatcaatgatagactggataaaggaaatgtggcacatatacaccacggaatactatgcagccataagaaaggacgagttcatgtcctttgcagggacatggataaagctggaaaccatcattctcagcaaactaacacaggaacagaaaaccaaacaccacatgttctcactcatacgtaggagttgaacaaggagaacacctggacacagggaggggaacatcacacaccggggcctgttggggagtggggggctaggggagggatggcattaggagaaatacctaatgtagttgacgggttgatgggtgcagcaaatcaccatggcacgtgtatacctctctaacaaacctgcgtgttctggacatgtatcccagaacttaaagtatttaaaaaaaaaaaaagaattatggctgggtgcagtggcccatgctggtaatcccaacactttggaaagccgaggtgggtggatcacttgaggtcaggagtttgaaaccagcctggacaacatggagaaaccctgactctacgaaaaatacaaaaaaattagctgggcatggtggcaggcacctgtaattttagctactcaggaggctgagaggcaggttgaaccccgggaggcggaggctacagtgagctgagatcgcgccgctgtactccagcctgggggacagagcaagacatcgtctcaaaagaaagaaagaaagaaaaagagtcacgagcacattggttaaatggactttccaaacaataggtgctaaaataaaattgatagagttatagtgaaggattacagagagcccctgaagtatttaattaatattttgtgggatttggggtacagctgaactgcctgtcactcttcccactcccaccctacccccgttcagaagtcacaactcatgcttttggaggacagagtgaatttctcccaaattactgtcttctgcctcctaaatcaggaccacatttttcaggtgtgcttatttggggaacgaggcctggtctgtgttccgctgtattgctgatgaagctaaaaattaagggattaatggcatcgctagatgcgccctgtagcggctggcagctctaaaagctcttctgacagctataacttatgatttataaatgaggttaatggattcctgttagaatggaaaatgcacttgtgtaagatcacttattcaagccgtaatcagtacctactgcaagtgctttctcctgaggcttgtattttttgctggaggatttttgtttttagtagatattgctggacataggtttttcttttctttttaaaatttgcaacaaatcccaaatcaccagaattgctgaaaacatgctgtgagagatgaatgtcaagttcacagtcactgcccttctccgacagaaccaacaccagccagccctcgagcgcagacggggaaattcaaactgatactctccacccctaatgttgagagagatggttatgcagcttcaaggtcctctgcaaattcaccatacttggatagactgtgaatgtatttttaattaggcactgatttttagagcattgggttatgtagtagtgaatattctgaccagcctgcatgtttcagaagcagaagtatgaaaaaatagatttggtagcaaacaccaaccagccaaacaaaaaagcaaaaagccaaaaacccatcttgtggttgatgtggtttccatagggctttgcctctcgtacatagtcacttcttaagaaacactctccctttttttctcagtagagtaaggtcttgataagaaggttgcaagatgtgcaatataactgttttattgagtaattttgttaaaccaggaaaataagaaagaaaagaaactagagctgttatttgtctttcttagaatgtcttgatcaatacattctaggctggcctgtaagaaaaagaagcacagggattttgaatagagacactgtcaccaggttaactttgtaaagggagggtggtgggctttcccagatgtactttcccttgtgaggttttagcttggctcttagctcattcaaagcaaagactgagagatgtttaatttgcaaatccttcaggtgtggaacttggattgtaattctttcctccttgggtaacatgatgactagcatggttatggctggcattttgcttttgttgtgttttgatacactttcgtgtttagaaggtaacgcatccgatgggacgaggcatctgaacaagatggtttggaagcttccttttgagactggagaaatgtgtggactaacacaaatgtgttcttagaatagtcatcatttctttgtgggaaacattattctggcacctattaatgcttatagggactagaattgttgaattccttctccactgaattcaggtagcttgattggggccattttggaggataggaaaactgggcagtgtctggaaaggccaacatcttcactgcacaccctacagggagggtgggtggaagttcccacagtggcatcagttggacaccatgacgagctcagtcccaggtgactgagacagacagaatggagaagcactcaccgttatctcattctcctagcacatccctcacccaactacagtctttctccacttagacatccatgccactgggtgttaccccaaaaatctgaagccaagcagattgacccctgacaatgaggccctgaagttcagttacgactccttgaagacctcttacctctcacaggccagcttcctctcccatccccctcactgatggttcccagccttcaccagattcttttttttttttttgagatggagtttcactcttgttgcccaggctggagtgcagtggcatgatcttggctcactgcaacctctgcctcccaggttcaagcgattcttctgcctcagtctcccgagtagctgggattacaggcatgcgccaccatgccaggctaattttgtattttatttttagtagagacggggtttctccatgttggtcaggctggtcttgaactcctgacctcagatgatccgcccgcctcggcctaccgaagtgctgggattacaggcgtgagccaccttgcccagcctggattcttgtttttccttctcaccctctcccctactaaatccccttctcttcctcagaagttagtccttctaggttctccctgtaaccttacctgcatagaaactccccctctctgcacataaacggagctgctttctgatttactttccttttgagagctggtctccagttgctgcagatcacctcatccagtgtccccttcaccacctgtcaggttcccttggtcagtatcatgcctctgagacagcagctgcccattggaatcacctgggggagccttggaaactactaatatgtgggtcctttcccagagattctgacttaattgggttaggatataaccacaacaacagccccacaaaagtattacccctcgttctataggctcagagggtgagaaatttgcccacatgtctcacagctgatgagtggcttagctgagatttcctttcatgggtgagcttgcagattgtgctctttctgttgactgtcctgggctatgccagatccagagaagcacggcaggatcattaccagctaagaaggggtcttaccattgcctgccccttaggaatcagttgccctaggcgaagtccctgttttcctccaagcagactgataaacactggctgtgctcaagcagcagcagggctggattcgcgtcacttactttggtatgcaggaggctgcttgtattccgtggcgcagggagctaagcacacacgtcagagaaagccatttcaatttatcattttaattttgctattaagcatccacggaccctaaatggattctccacaatggcatctgcaagtccattatcagctaaatgtttaatgagttttttaagtaaccgatggatgccacagtgtataggaaactttcttgagtttttttcacatataaggaggcatttctcgaagtcacttgggatggcttaacatagctcatccctgccagctgacttgtggcctctttcccttccttccatgtgcagtgccttctatcttgaatgctgcagccagcagaggttctggcagtggaaccctctgcctagtgggcttcagaaaggagcctgtgaggcagagacatttcaattgaaaagcagtttagaattcagcctccatttgctaattcccatagatgctcgtcagcaaacacaggacagttgtttgtggatttgaaatttgctactttttcattctgtatcttacattttggtgattgtgctacaaatatttggagttgaacataataggataatcactgttgattcttggctaaatcacattatcttaggccatctttgcaaatcaagtgcattctactgaaaaggagacaagcaattttgcttgttctttttctctttcagtcgaatggagcatggacttagaattgaagttgcaatggggtgggcaatacattctaactgggtttttagttaaaaatcagcaatcagtttaagcaatctggttcaaaggcagtatagctacaaatttgcagacagtgtgtagtacagttgtccttcagtatcttagacgaattggttccaggaccctcccacccctgttggtaccaaaatacaaggatgctcaagtcccacagtttgccctctggatccaggggttcccaacctcagattcaaccaaccaaggattgaaaagatagtttttgccggatgaggaactgcagatacggaaggctgactgtatttcatttcaacaggggtctcgattatcctcctcattgaatggtaatatgttacctgttttggcaaagtttggagtaaacttctgtctccacctccctgtattgcagctgtcagcatggtgaagagcctgcaaggcgtgttgatgtgtgctgcctagggctgcctaacacaaaccaaacaaacatcccttctcaggatgggagaagagctttttatgagaccttcttctgtcttcctcttgcccgtctctgcctttgcccccataagcaagtgacagttgtgtagtgtttagccactacgtatttctcatatctgtcttcatggtggagcttctgatactcctatcttagggacacacctttgattagaagaagtaatattagcctctaaaattttttgaactttaaaatcaagaccttacttgggataacgctggtttcctcctctgttgaaattgtttatctcttggactcagaaactatttagcctttctgtggcacacagtggatttcaaaacatttggtattatcagatttctaagcaaggatgtgatgtaattattttactaccaaatgaggattcttttgagagaagcagccacttaacgtgagagtaattgcttgaatatgaagtggtgtgtaggaattgagtgagaactgagatcttgacttgcacgtatgctgtagataaaacctactatgaatttgctggtgcagggccacagaaaaaactagtcatgagaattgccagaattgtcagaaatgtgttttgagatgatttatattcattattctaactcttcacaataacattttgcttattttgcaattggaatttgtggaggtccaagaagtcaagatggtaattaatttgcccaggacagctggtaggtgcatcagctcagagcagcgggtggtggggaacttgtcttagacattcacgatgcaggtcatgacactggactataaagctgtagctctaggggtctgtattctgtgctctgtaacttgacatgatctgggacccaaagttaaataactaatcaagagaagtcaggtgcttttttgttaaacacggaactccagtattcctctgaagcttaaggagagagtaagtaacatggtattgggcttgttccctgtccttaacacaagaattcttggaattgccggattacatattcttctcccctgagaggacacccagtgcaagcatggctcacatgcctaaggtctgtgttagatagatcatatcatggatccagcataattaagtagagatgcattttcttggtttaagttaccttaggggaaaaaaagaataaaattcttcaggttcaaccttggagttcttcttctttttttttttttgaggcgaggtcttgctctgttgccgggctggagcacaggggcgcaatctcgactcaccgcaacctcctcctcccaggttcaagcaattctcctgcctcagcctcccgagtagctgggactacaggcgagtgccaccatgcccagctaatttttgtatttttagtagagacggggtttcaccatgttggccaggatggtctggagctcttgacctcatgatccacccgcctcggcctcccaaagtgctgggattacaggcgtgagccaccatgttcagcctggagttctttcctgattctatgaggctgtgagtagtggttcttaaccaggaatgttatcaccaccacctcaggggaggtgcacatttcttgatatggggggtcggggttgggggcaccagggatgccccatgtcctgtaattactgtccacagtgtccacacaggaagataccggttgtatcagagacttggtctaggattcacaggtttttcttccagttggatttaatgagcttctctctgtcctaagacccaaatgctgtggggtttgccaacattacaaggtaggcatttcacagaacggaattctggcaggccatcttcatgcagtgaattgctgtcattggtaggtggtgctttttattgcccccatctccagcagagatcttataaattccctttgcctgaaatcagcatggttgatctcccacctaaccagatttagagtgctttgttttctttaacatactttcccagagaactcgggagttttaatacttttaaaaacaactataactttttataaagtagggaatacttgactgaagtgttgtgtgttaaaacatactgcatgcatccgtggtgtctttagttatggggaatgttagtagatgtgactcagagagggttccttgaggaactcattttagaaaatgcagtgatttcctccttagtggttcagaatgcacattaaagagtctttaaattctaagtaaatctgcttaactctgtctgcgtcagagtttcccaagctaacctggagcacagaacacttctgagataatgcgtggtatgttggtgttgatacacgcagtatactcatgctctcagagaccggtttgataaatgccgatctttgagaatttagaggcctaatttgtagacaacattcctgataaaatgagttcacctgtagtggccagtcctttggggtttccataagcaatgtgagatacattattttctaataagacatccaacaatttgaatattaatgttcaatggaattaattttgcatgctaaaagccaactgatgattttagtggatctctcttaacaatcattctttctcatgtctaaagatgagtttgggttatttctcctgaaattatggttaactaactttcatgaattttactgaaaatgatgagaaacagaaaaatctgggatttgtagacagtggcgagaaactctctgtctagtatttatacccctcaccaagcagcactcctgggccctcaagctctgctgctgtgcagaaaccgttccagccgccttccttaaatagcaagcactgccatttcaaacacaagataaaattaatattggcattctggaaattagcatttttgcactaggattaaattaaattagttaaacgaatgtgacagcatgacaaagctggtctaaccaagccaatcaggtattgaaagtggataaatgttgctgttgggtgaatagctcctactcggcagttggtgggatgatgtagcgtaggctgtaaaccccatcttggaataaagacctgcaggataaagtgcagtaggacacgtggggttcagacagctgggccctgttttcgtcctgtggagctggagggaaggggccacagggactctgggtgatggtgaggagatgttcacccccttttctgagtccttcagatgaactcagtcgagcttaaagtgatgtcaccaagcagtaagggaacttttttggcttgttggttttgtttgctgaatatatggatggaaagaaatatcatgaaatttataacgagcagtggctttatttaaagatcagagacttcatagcatctgtaggttaagacctgggacctgctgccaccctcaagaggatctgctgcctcttccctgaggaaaactggcagcaggaagagagctctggaggccaatttctcagagataagggcttcttatttttagagatcactacaatcatgcccaccccgggatgcatcctcttctcaatttcatgtggttggagagagcttttgactctatgctttgataatagctctgaaacccgataagcagttcattttctctcttttaaaaaccttgctagttaaaaggcctcctcatatttttcttttgcagattgccttaaatctttttttaaattcatggaatataaatgtatactcctgattgccttagcagtgcttactatatatcttgagataattaaaaatcacatcagccaggtgcggtggctcatgcctgaaatcccaacaccttaggaggctgaggtgggcggatcacctgaggtcaggagcttgagactagcctggccaatgtggcgaaaccacatctttactaaaaatacaaaaattagccgagtgtggtggcacatgcctgtaatcccagctactcaggaggctgaaacgggagaatctctggaccccgggaggtggaggttgcagtgagccgagatcacgccactgcactctagcctgcactctagcctgcagctgagatgcagcatcctcaggctgaacttcttggaaagcatgactgtcggggaaggaatggagagactaaagaatttgatccagttccctcacaaaaattagggctattgttcatctaaacttctcataaatctggatcaccagtggaataatccatttctgcatttagcctccgtcttattttcagcctacttctagaaatttaaatatacattggaaaatatattgtatgcctaggttgaaataaaagggtttttttttttttttttgccagtctggattgctgtttgaagtattcaattttagagtgaatacaccaagagctacagctattgacttgtatgaaataaatcatcagtcttaatgatagctctttgagttacattgatgggtgggctcactgatacacaccacacaactctgggtgtatgtgtatgtgtgtgtgtgttgtgggggcaggatcacttgccctcgcaacctgaggatctgaaccaaccaggaacctcaggaaaaaaagggctgctatgggctgggcgcagtggctcacacctgtaatcccagcactttgggaggccgaggcgggtggatcacgaggtcaggagtttgagaccagcctgaccaacatgatgaaaccgtctctactaaaaatacaaaaattagccgggtgtggtggtgcgcacctgtaatcccagctactcaggaggctgaggcaggagaatcgcttgaacccaggagatggaagttgcagtgagccaagatcgtgccactgtactccagcctggaggacagagcatgagttcgtctcaaaaaaaaaaaaaaaaaaggctactgtgtcttcttttctcttcctgtgtgcaagtctgtgatttcaaggctatggccatgttacgtgtagccgtacccatgtcttgaggtgcagccccgtgtgaatgtgtgtcctgggatgtagtgagatgtgtcgcctctaccgagctgtttctaattttgttggattcccttttcatttcacatctcagactcaagccaaatgctgcctcctttgaaaccctccttaacagaaacatgaggaccatttataaaaggtgaccgtagtgtgagataaggggtggaaagtactgggatagcacgtggaccttgatttgatcaaatggaccaagtctcataaaatggctgctgagtgcttttctatttagaaagagaatttcccccaatacggtttcatttgaatctcacacaatccaaaaacagagatagtattagtctcagtttgtaactgggaagatgagctcagagtaaagttccatagctgagaggagcttggactctaaccaagacgttgtatgtgctgtgctgtcttctgtttcccccatgctttctatagtttaaaaaagaaaagaaaagaaaaatcacaggcggccctcgtccatttagatctttatataaaccacctttacccgctttgtcctgcccagtcctagaaaatcagaaggattagatgcctttgccatttgccaggtgttattgttgagtgcagagcaggaaggacacaggtaataactcccagagctttcattttagagaagaacgcaggcatggaacaagtaattcccaagaccacaattattgagaacaaatagtataacaaagacagctaaaatttatgttaatagttgacttattaagaacttaatatgttcctggtgatgtttccaatattctttgaggtatataaaaatgaattcttggccaggcgaggtggctcacacctgtaatcccaacactttgggaagccaatgcgggtggatcacttaaggtcaggagttcgagaccaacctgaccaacatggtgaaaccccgtctctactaaaaatacaaaaaaattagccaggcgtggtggcacttgactgtgatcccaactacttgggaggctgaggcaggagaatcacttgaacccaggaggcggaggttgcagtgagccgagatggcaccactatgctgcagcctgggcaacagagtgagactccatctcaaaaaaaaaaaacaagagagaaaaatgaaaaaatttttttctttttaaaagccagtcaagtttagcagtgtagggttgtataccgactttagtaacactgatgttaatttctgataacccactaccatcggaccagcctaaaaatgaattcttaactccattttacagagaatggggaagatatgagggaggtaagaaatgtgctcaaggtcgtgaaagtaacttccttaaggcggaagcaaatgtatatgaaacacacttgtgaaatgggtacataatgcataggatacatgtgttctctgtcaggagcctgtagtggcctgctgtagaactgtgatatgcttggctccgtcccgttcaatgtttttgatgaatggcttagctgaggacattaatatgttatttacatttggagatgatataaacagaggagttaaagctccagcagtgtggcctgttggcctagatgatcttaaaagatttatgaaccctggcaagcaaggttattaacatgcttgaagcctaagaatctatgagttttagggttcaatgtattttcacttctacagtgataaagtgagtaaaaaggaaaccgtgtctgttctcccaatttccctctaagaggataaaaccaaacaacaacaatgccatagaggtaaccattattaaagatttggtacatattgttccagactttaaaaaaaatgcttacacaaacattgactccttttctctctcccttttcctcttcctctccctctttgtcagtgggttatttttgtttagtttggttttaaacacataaaagaatcattctcagcaacttgcttcttttcccccttaagccagggacatcttcacacatgagtgtgtctaaatctacctcatagcttttgatgttgtctattgcatgaacatttcataatttaactactcccctctactgatagacatttaagggttttttttttttttgctattatgaagtatttattacttatttatttttcctttgtagagactgggtttcagtttgttgcccaggctggtctcaaactcctggcttaaagccatcctcctgcctcagcctcccaaagtgctggaattataggcatgaggcaccacgcccaaccctattataagttattatgtgttgcacctcataaatatgtaatgccatatctattagaatggcatggtgtagctaatgggtttgcgtatttaaaattctatccctatttccaaattgccttccagggatattgtttactgatttgtactctggtttttattttttttgtttgacatttttaaagatttactttcaaaacactttctattagaatgaaggagaaaacacaatgaagaggtttctttacaagttttgtcgtgggatttaaaattccttccagataatctttaagtctgatgatttgatcatttgtgggtgtgtcctggttatattggcttctggttccttcccacgaaggccacttacaggtttgcttcttggtcatactgcccggggtgggacgaattgcccctttggagcctcgtctactgtgtgaactgcaggagtgctgggccacttgcacccggtcgtccaatgaggatgtagatctgggagtatcacttctgcagtgaaaagggttgctttggttggcttacctcctctgcccctggcatcctgacagctgtcaagggctcatcatttcacaacttcattaaacagcctggtactcctgtttcttactctgcaaaggaggtccctagcacgttgtggactcctgtggagaaggaagtggatggagaagtctcctagtttttctgtggtgccttggctaccacttggacattcttggttgttgttcttacagaaatgagaggaaaacactgttgctggaaacatttgaggtttttagggtcttttttttttttaacagcttgtttagttgtaatgtggtaatacttcatgggaataaactctggctgacccactcaaaggatataagcttgaaaacatttagggttttgatttgttcaaaggaggcatttgtgctttttgaagcacaaatccagtgggaaaataggttttctggtgcttaccatgtttaagtgtaaggagcgtgtctttcaagtctagttctcatctcaaaagaaataactatttataaaactaagttcagggtggagggataaagctatgcgaggaagcttcggagtggaaaaagtgaaatatacatttcctccttctttcttgtttggtaacagttaagtcccagtattactttcctccctgaaatgggtggtcctcgaatcccatctggctccaatgaatcccatctggttccaccgcctcctgtcccatgtgccactatgttgtgtctgcatctttcagggtctctctgggcagagctgtgtgtaaatcctgtcttctgtggccatttgagttgcagacaggagagactgattgaagttaagcaaggtgcgtgtttattaataaagaaatgtacccacaatgtatgaaaccatcaggtcataaaataacacgtgttccccattattttttaagtgaatgcttgtgcctgtatatatacacacgtagaaaacacagaaaagacttaaatgaatgtaggtttgatttcctctatttgaggtgactttaacttattgataactctcagaagtccgtgaatttttaacaacggtatgacttatttagacggtttggggatggaagaaaaaacaaaaacacttttgatttggagtgaaataaagggaattatccatctttaacaacacgtgggatttgcaaaagtgtggacatgtctgaatgtgacaatctgactaggaatgaagtcccattttgtgcggatgttggtgcctcataggctctgaaagctcacctgagacatcacccttgaggtcaaagcttgggtaccctggcgggacgcaagctattcacatagtaaaatagactcaaaactcaggttcagtaacgtcactgtcataaatcgttttctaccgaagttaataatgtatctacggcctttctcaagtagggacagttaccctgtggttactgaaaattagtatctcataatgtattcattatcatacttaggatgtaaggatgtgtagcatttgacctcagtttttaagggtccttctttttatcatctaatgtactttgctatgtgtgtgtaacatctcttttttttttctttttttttttttaagagacggagtctccctctgttgcccaggctggagtgcgtgatctcagctcgctgcaacctccgcctcccaggttcaagtgattctcctgcctcagcttccctagtagctgggattataggcgcacaccaccacacttggctaattttttgcatttttagtagagacggggtttcaccatgttagccaggatggtctcgatctcctgccctcatgatctgcctgcctcggcctcccaaagtgctgggattaaaggcatgagccactgcgcctggtgtaacatctcttttttaaatgatgtttttatttggagacgagggtctctctatgttgtccaggctggcctcaaacttttgggctcaagcaatcctcctgcctcagtctcctaagtgctgggactacagcgcacgtcacagtgcccggctcagtaacatttctaaaagagtagacggaaatttgtgcctgtgtgctatagtcttcatgtttaaagagactcagtttggctccaactaaagataccttggattgggcaattcacagaggattataagaattttttcaataattttaggtacttggtagaaccctaaactctatagaacttcagagttctggttcctaaataagaggcacaattgaccgaagtttattgcattgaaattgaggtattaagatggcttttttatgttccctgtttagtttgccatatcatgaaactgtgtatgtcaacagtttctaggtttaagattcactgggttaccatgtagcccacgataatatgtgattcctgctttcctcccccaacttttcttcctgttactaatcaaatctaagtcctgtgtacatactcaatgatatttagttagaatactctgacatttggctgggcgcagtggctcatgcctgtaatcccagcactttgggaggctgaggcgggcggatcagctgagatcaggagttggagaccagcctggccaacacgaaatcccgtctctactaaaaatacaaaaattagctgggcgcagtggcaggcacctgtaatcccagctactcgggaggctgaggcagaagaatcacttgaacccaaaaggcggatgttgcagtgagccaagatcatgccattggactacctgggggacaagagcgaaaatccatctcaaaaataaaaataaaaaaaagaaatactctgacatttttgcagatgggctttgtggagacacactgcccccttctccattccctaccccctgcttttgtctttaggtttcatttaaaatgcccatctttcatattttggtaagagaagactttaagtggaaatgtaatctgagtattctgtttaataaatggactcagcatgggcattttgaagccaacaatcccatctgtagtgtaagtattaaactacagtggtattatttcaggaggaagctcatgcagttgaaggacagccttgctgggagccgagaacagccaggtgaaatcaatttagcacaacttaaggcttctggattgcgtgtcttgaacccactgtcccttcagcgttcagggtctaagtcagtggtgagtccagagtcattcattggcctggaagcaggatggaatgatgtcagatggagtgcagagttgagattgctttgtagcatgcaggtctgtaccagaccttttccagaccggttccagacctggaataccctttaagtcattttataattgtgtgtagtaacaggaccttcaaagcatggcacgtatctttgtaattgtgtgtagtaacaggaccttcaaaacatggcacctatctttataattgtgtgtagtaacaggaccttcaaaacatggcacctatctttatgttgagagcctcaaacagaaaaacgctggaaatagttggtggcaagagttggcttcgggccatgatgcccccattcctgagctgtgtgacctggggcaagacaaccccaccccaccagaattgctttgagtcccggtgtcattattataaaatggaaataatagcagctgcctatgttggttttaagataaatgagatatctgtatatataacattgctgtatattacattgttgaaacatttaggttcctaatggttattgtttctattggcttaaaatttttttacctatattctcaggattaaaaatacgaccaagagcaagccgggcacagtggctcacacctgtaatcctagcactttgggaggcagaggtgggtggatcacttgaggtcaggagtctgagaccagcctggccaacatggcaaaccacgtctctactaaaaatacaaaaattagccaggcatggtggtgcacgcctgtaatccctgctatgtgggaggctgaggcaggaagatcacttgaacctgggaactggaggttgcagtgaaccgagatcacgccactgcacttcagcctgggtgaaacagtgacactccatctcaaaaaaaaaaaaaaaaaaaaaaaaaaaaaaaggattatatgaccaagggcatgcctacatgcctgctgattttgtgggttttttcatttttgttttttgtttttctcgctccgtcacccaggctggagtgctgtggctcaatctctgctcgctgtaacctccacctcccacatccacctccaggttcaagtgattctccttctgcagcctcccaggtagctgggactacaggcatgcaccaccatgcctggctaatttttttgtattattagtagagacggggtttcactatgttggccaggctggtcttgaactcctcgtgatctgcccgcctcggcctcccaaagtgctgggattacaaacatgagccaccacgcccggccatgcctgctgattttgaaactgatgccatcagttgcacagggcatcctatggggaggattgcaaatgaccattgtagtaatatttttaaggaaaaaacaatgacccaaatggacatgttatatgtgtcttgtttgcttgctgggctctgggagcactggccttcgcgccaagcggcctcccttctctgcaccccgtttatccttttcttacacagcccttgcctgtggaaatgagatctcagctttaccattgcttcctcagagaagtcctggacacccccagcctcagtcagggctgtttttttttttttttttaaaacctacttgattcattctcaagggctctgtttattgttatttgttctatgtatgcctccttcatgacagtttccacagctgcagtttagtaattatttgtttaaaagtctgccttctgacttgttcagtcaattatgcttaacctgcatctaatcacaaggaaacattatttattattttaaagtaaaaaagaggtttttaagtctgccttccatagtaatttgtaagctcaaagctctgggaaacacatctgattttttcatggttatatttgaaataggtctggaaaggtgaatgtatgtatctggtgttccaatgaatgaattaatgagtggatgaatggctgatgggcacacttacccagatacaaggccctatctgcttgtaaggtagctggatctttcagacaaatataagacttaactcttcattgtttttgaacttccttttctctgtatttcttctttcactggtttgtattctggaagttaatgccttgtttctgacttggtcatgaggactgaaattaagtttctatggctttgtcttttccatagctcctacagaagaatggtcagctgtccaccatcaatggcgtagctgagcaagatgagctcagcctccaggagggtgacctaaatggccagaaaggagccctgaacggtcaaggagccctaaacagccaggaggaagaagaagtcattgtcacagagggtaagccgcccctccaggaactggaaggcacacagcacttgcaacaaactttggactcagcagaaaatactctgtcatactgcctggtggtggattggtgttaacagcaaaaacaatcaattggttacaaaaggaagtatttatctgaccatttggataccccctatacttagaccttgaagttatgtttcctttttcttatctggaacttgatgctttttaaattattgttgctttgtcccaactgcttgtctggagttgaatgtgaattcttgttggaaacagaagtcatggttgctttaaaagagtcattatctctccctctagagaggagcctgctatacttgtacaactctttctgataggcgcattgcaaggcacgtacccctctttgcttaaactatgatgtgctgcgtgttttatagctcttgagcctagagatcttcgaggaatggttattgaagagtgaccgtttggacacagtattgggatttgatttttacccatatagggggtgaggaaccgtatcttgaggtcagaattgagagcatgtggcccagtaagtctcttgtgaaaagcgaaaggctgcatgttgaagaaggaccttgagctcgttgttccatttaattataaataaagggataaccaataactgctatcaaatatatgtaaaatgatgattcggcatacggtaaattgattcgtgtaatatgaataagagagacaaatgaagggaaaagtcctttcacaggagattcaacatcgcctcacttagatgagattcttcaaacatgtggaacctgtttttcttcttgtttgatgcccccacagagctgcttcaagcagggagctgcttttgaagttggtgggaatacttatctgtatatagcaccacaggcacaatataaagttagaaatatacacagtctcacaggcggagtatttgcatgacctagtgtgagagtttcaaataattttcacccaaatgattggaatggacccaactcaaattcccaagtccaaagctttgtctttcccatgttaacttttgaatcaagtcaagcaccagcaacatgtgagcttactatgaccaagtctgtaaggttaagacaaggcaacttggtgactaccaaatgaattgtgcaagggatgagagctgcagggttcaggtggagcagtcacttgaggtgagaggggagattagggggaggctggatttagatgtgtgtaaacaaggaatgtcagcaaaagtgaggagaataataacagccaacactttatgtgcttttattatagggcccagagaggtgccttttgtgcgttatcacctttaatagttacagcaaccctatgaagtaggtgatattgttcccaagatgcaaatccagatcagcagattccaaaaccacttaaccactgtgctctcactgtgccgggcaggttcggaggctggtgtgttggaacagcctagcccctgcaaagagtttttattgaagggtgtagaatgaaagcccagaagggaaaaggggccagataacagggccctgaaagcagagtggagtttagaaagtatttagtggacaacgtgtgatcactgaactatgccaccaaaggggtgccggaggcttcttgtctgacttaggtgatctgtaggatgtataagaggagggagggatggggcagggacacagtttttttcatagaatcccaaatagcctggaaattcttttttaatctgtggcatgtttactggaggtcttaaggttatcttaccatagtccagatgtgatttcttttacatttcagccacgtgggtaaacactgattttcacagtgagtgattcagtccctcccctgtgactattccatcgtctccctgaggtgacctaggcttctgaccatggcctcggaggtctgagcaaatatcaaatcccccatgcaggaagggtggtgatttttattttttattttttgagatggtgtctcagtctcactctgtcgcccaggctggagtgcagtggcttgagctcggcttactgcaacatctgcctccccgcgcacatcccccgcctccggctccagtgattctcctgcctcagcctcctgagtagctgggacgtgccaccacacctggctaatttttgtatttttagtagaaatggggtttcaccatgttggccaggctggtttcgaacttctgacctcaagtgatatgcctgcctcagtcccccaaagtggtgggattacaggtgtgagccgccacgcccagctgtggaagagtggtaattactatacattttttgttattgttgttgtttgtttattttgagacagggtcttgctgtatcacccaggctagagtgcagtggcatgatttcggctcactgcaacctctgtcttccaggttcaagtgattctcctgcctcagactcctgagtagctgggactacaggtgcctgccatcatgcccagctaacttttgtattttcagtagagacaaggtttcaccatgttggccagtatggtcttgaactcctgacctcaagtgatccgcccgcctcagcctcccagagtgctggaattacagacgtgagccaccgtgaccagccaattaatataccttgtccttcccaagatcttgaaaaggccttgacctctaggaaaaaagaactagatgtgcctccataccatagcccagggctacagaggctacccaccagaggtgtttctggaggccttacttttggggtgagcttttgctgttttaggtccaactgctattctcttggtttattaggttctctgtggcaacttggcatactccttctgtttttttctttctctatttttttctgcctggcagatgataattaatagcctgacaatgtaaatacagacagaatcttcgtgttaacttattaaacagcatttttccgtgcttttgacatcagtgacagctcatggttaggtttttgtttagttttgttttgagacggagtcttgctctgtcacccaagctggagtacagtggcgtgatcttggctcactgcagtttccatctcccgggttcaagcaattgtcctgccttagcctctcaggtatctgggattacaggcatgcaccaccacgcctggctaatttttgtatttttagtagagatggggtttcaccatgctggccaggctggtctcgaactcctgacctcaggtgatccgcctgcctcggcctcccaaagtgctgggattacaggcttgagtcaccgtgcccggctcgctcatgattaggctttatggttgcttccagaaatcagaattctatatgacagtttgctgtaggatagacaaaggcataatttggcatgtgacactgacctgtaggatttgggacacctttgtttctaccactgtccacttaaataagaagagaactgacccattttggtccctgggaggactggcccacagtggaatttggtcctgctgtagataaaatagcaagatcaactgatgggagaaaataatgaacaagggccattcctactggagggtttttactttacagtggcagacaaagctagaggtgaaattttttttcccattttgattcacttgctctttctaaaactggaaatactggtagttcagaaccaaccctcctcctataatgaaaacagaattctgcttctttgtaaactttcttaaatgttagaaagaaggaaccgcatataaatattgtctaaactctacagcagggtctgatatatgtagatttggggagggggcttgattatgtcatttggtggacttctataagagcatacacaatgaggcatggacacaaacatttatttataatgaaaataaacacaactaattaccttagccttggcgagcagtccctttcttctgagctttgggattttcagtttatacaaacagcttatatagaaatgcaactgggcttcctctccctaactaaaaagtgctgtcatgctgtgctgttcccagcattcacagagactgcacaagtgccattggtttggggcaaatctgcttctaccgaaaagatgaaaaaaaaaaaaagaaaaagaaaagctccctttccgcaacccaaattatcaatcgttttatagtctatggcttgtacggtcttctctttgttaaaaacccaaacaagagcctgggtgcagtggctcacacctgtaatcccagcactttggggggccgaggcgagtggatcacctcaggccaggaggtccagaccagcctggccaacatggtgaaaccccgtctctactaaaaatacaaaaaattagctgggcgtggatggcagatgcctgatatcccagctactcatgaggctgaggcaggagaatcgcttgaacccggaggcggagggtgcagtgagctgagatcacgccactgcactccagcctgggcaacaagagcgaaactccatctcaaaaaaaaaacaaaaacaaaacagaaacccaaacaggaatgatttttaaaacattgtatcttgggctgagaccaattttagatttaaaagttttgcaggctgggggcggtggctcacgcctgtaatcacagcccttggggaggtcgaggctggggtccaggattttgagatcagccaacgtggcgaaaccctgtctctatattttttttaacttttggtaattagaacaactttgaaatttaaacgtgaaattcaatcttagtatctgttaggcagatgatttttttttccccgaacagttgaggaaaatcagttactcaaaaagcaacaccttatttattttgataatagcatatttgattttgaaataaagtgtctgcaaaactcattgccatatacaagtaatccagtgattatctcaggtcttcatccatttgaattaatcacttacaatgcagttatttgttttctttttgagatttgcgtctctgcagagtacgtacagcaaacattttaaagcatgtgaaaaccagcttttctccaaccttcacaggtcacatttgtttctgtgagcaaacagacaatggcaatcttttccttagctttagaaagttttttttttaaagaggcccttgctctgtcacccaggtcagagtgcagtagtgcaatcatggttcgacgtagcctcaaacttctgggcacatgtgatcctcctggctcagccttcccagtagttaagactagaggcatgtgccactgcgccagatagttctttaaaatgcttttgtagaaacaggttcttgccatgttgcccaggctggtctcaaattcttggcttcaagcttccttccacgtcagcctcccaaagtcttgggactacagaagtgagccaccacagccagccttaagtaatttctgttcacacctcttgtgtacccagagttgaggatatttacaccagcagcaatggagcaggaagcagctgggtgctctgaccttggcatttgccactctggggctagctgctttaaaactgtcagccagtgaccagatgaaccaggccttgttacactaatcagataacggtatagaggcggctcccggtgtgtgcacgtggaccgccactgtgacaccagctgtgatcacaccccccacccccggggaaaaatgagaaacaaaaaccctcaaaatgctgtcacttaaagcagaagtctttgaggggatgtatttcttaacgttttacaggattccacttttctacatctgagtattttcccccagatatagtaacaaatacaacactttagagaatttcatttttctaatggcgcttaatgtcatcgtctgcttttattaaatttgccatttgaacccaccagctcctggtgtacagttcctctgggaaacagaaaggccgaaagattaccgccagataatcccagccctccctaaagatcttgttaccttacagaaaatccattctgagttaaaagtcgttcttctttgctttgaacatttaataactttatctgtatagtaggcaccctaagacctgctctgagcctcttcaaagatgactcccccaccccatacctgtttcctctgcaagaggctgctttctctgcccagaaggaatatttttatgatttgattccttttctatttcagttttcaaattgtgacatcattggtatcttgttagaagtgcctgtcacccacattacagccctccactcctcctttccttttctctacaccagttgttaacatctggcatttgacatctgtctctcacccacactttggctaaaatataagaatcaagcccaggtgcggtgacttacaacggtaatcccagcactttgggaggccgaggagggcggatcacttgagcccaggagttcgagaccaatctgggaagcatagtgagacccttgtctctacgaacgtttaaaaaaattagctggacgtggtggtgcacgcctgtattcctagttgcttgggaggctaaggtgggaggatcgcttgacttgagcccaggagtttgaggctgcagtgagccatgattgcaccactgtaccagcctgggcaacagattgagaccctgtctcaaaaaataaaataaaatataagaatcatgaggacggccgggcacggtggctcacgcctgtaatccccacactttgggaggccgaggtgggcggatcacgaggtcaggagatccagaccatccaggctaacacggtgaaactccgtctctactaaaaatacaaaaaaattagccgggcgtggtggcgggcgcctgtagtcccagccacttgggaggctgaagcaggagaatcgcttgaatccgggagctggaggttgtagtaagccgagatcgtgccactgcactccagcctaggctacaagagggagactctgtctccaaaaaaaaaaaaaaaaaagaatcatgagggcagagttttcttgggatggggattcggagggtggtccatggcaggagatggggtgaggggggctgtttagttcagtgctgaatcctctgagcctggaccagtagctggaacagaggtagcgctcagcaaatatatgaataaatgaagacacagttttcagttggagttcacagtattacatttataatcatctaggtgaggaggagctgttggctttaactctgtatcaattcatttcctgcttaaagactgcggctttgtacattttatccaaggctctctttcctttgttgcatcagcactgacaaagccagaccctttccaggatcgcaccatgctgggttctcacaggtgcttgctgttggttagccaggtgttgcctggaaacatgaaataggaccctgacctgcacgtgattaaatgtggattcctagtaacgctatcaaacacaagtgcccaatagataaagagaggggtccccttgcacacactttggtatttcaaatacaatattattgcatgacattttctcaagctgtatcctgttttgtaatgttttgaagactggagggaacacacacaaaataggccttgaacttaggtaaaagtactatgctatgcgatttctgggaactggttttaattcattctcctgctctgcagcaattgtttttagtgtggctgcactgaaattacttatgtcattgacaaatttctggtccaaatatttcactgccttcatccttaaagaaacagagatttattttcctgtaatcagcagtcaagatgtttttctctgaactatattcaagtctgacagtgcagtgaactttttttccttctgacttaacaaaaggagtgaggaagaaggacagcaagacttctgttcaccctttctccccttcgtaaatcaactaattctagggcgctagacacggctaagactgctttaattactactttttgcgtgatcttgatttgaatacatttctttatctcattgcaagtcagttttcatctatgaaatgagcatccccacccatctccgaaattctgtggctaatatcaatatgactagttatatgggtactaaaaatgaaatagtggattagctaatgaagacacccaagcgacctgaagcaggcagcaatccacttggtaattccgttatgcctttttataaaaatacttttatggcttttctaatttttttttttttttcggagacagagtctccgaactctcccaggctgaagtacagtggtgcagtctcagctcactgcaacctctgcctcctgggttcaagcaattctcatgcctcaggctcctgagtagctggaattacaggcgtgcaccaccacgcccagctaatttttgtattttagtagagatggggttttgccatgttgaccatggctggtctcaaactcgtaacctcaagtcatccacccacttcagcctcccaagtgctgggattacaggcatgagccaccgcacccggcctctaatctgatcttaaaagccattttctatatttgaagttttaatttaattaaacaaaaagttcaaggggggaattttattcaaaaatatcttgaaacataatcctcttggtgtcaaagaataagataaatcccttcacaaatgtggccactaaacgtcatcctctcatccccccatatgtgttctgctgaatgactggcggtcaggactatgtaatagggattggttatagccagggatgggggaaagaagttggtaaatgccatagctgcttgccctaaagattttcagtcagccttggagatgttacctataaatctctatagttcggaggccactcaagtccactttcaaattgggtccatgttctggcccatttgagaaggagccaggcaagtcagcctgtaggcttgcccaagtaacagtctaagaattaggcccttttctgctgggcacagtggctcacgcctgtaatcccagcactttgggaggctgaggtgggtggatcacaaggtcaggagttcgagaccagcctgggcaacatagtgaaaccccgtcctactaaaaatacaaaaattagcccggcatggtggcatgcagctgtagtcccagctattcgggaggctgaggcaggagaatcgcttgaacccggtaggcgagggttgcaatgagccgagatcacaccattgcactccaccctgggcaacagagtgagactctgtctcaagaaaaaaaaaaaaaaagatttaggcccttttccttgaagggactgaggtggtccacaaggagtggctctctgattgtaactaagccactaatggagacatgcaattattttagctgtgtcttagtccgttcaggctgttgtaacaaaataccttagaccaggtaatttataagcaacagaaatttattacttatagttctggaggctgggaagtcccagatcaaggcaccaacagaatcagagtcttgtgaggtcccactttctctggatggtgccacctatgtgttctcatgtggcagaagggcagaggggacaaacaaacacccttaagcctcttatatgagggcactaatcccattcatgagtgctccatcctgaggctgatcacctcccaaaggccccaccctctaatatcatcaccttggtgattaggtttcaacatatgaaattttttgtggggagggacacaaacattcagactgtagtggctgttttatttatggaatgaaaatcttttaggcattttctcaaggactgactcaccttgagtgtaaaacaatttcagtgtcacctaatttatagtaacttttacatgattaaggcaatgatatagtctagagcatgatgtccctgtattatagtgtattggtccattctcacactgttataaagaactgcccaagactgggtagtttataaaggaaagaggtttaattgactcacagttctgcaggggcggggaggcctcaggaaacttaacaataatggcggaaggggaagcaaacacatccttcttcacatggcagcaggaaggagaagtggcgagcaaaagggggaagaaccccttataaaaccaccagatctcatgagaactcactcactatcatgagaacagcatgagggtaactgcccccatgattaaatttcctcccactgagttcctcccattaaacatggggattatgggaactacaagtcaagatgagatttgggtggggacacagacaaaccatatcatatagaaaaggatgctttgataatgtctgaagatatattctctgggcttaaaattcaacaactgtttagcctgttaatcaagatttattcctgcatatcatgcttcgaattgttttcaaattgctctttacttcaagtatcagtatagcctgatatcaggtagttttcctccgacctctagtgttaaccagtgcatgcattagtcattcaggtgaaaagtgctatgtgctagattgaattaattgagtgaactggttgctttcatgtgtcttaacatggacgtgcaatatttagaccaaccgcaggcataaggtcattatccccctgtattaatttgctaaggttgtcatgacaaaatactcgactggtggttcaaacaacagaaatttattttctcacagttctggaggctggaggtccgagatcttggtgttgcaggtttggttcctcctgaggcctctctcttttgctcgcagacggccgccttctcactgtatcgtcacatggtctttcctctgtgcacatgcacattcctggtctcttggtgtgtccaaatttcctgttcttataatttttttgagacacggtatcgctctgtcacccaggctggagtgcagtggcgcgatctcggctcgctgcaacctccacctctgggtttcaagcaattctcctgcctcagcctcctgagtagctgggattacaggcttgcaccaccacacctggctaatttttgtatttttagtagagacggggttctactcttcaccatgttggccaggatggtctcgaactcctgacctcaagtgatcagcccgccttggcctctcaaagtgctgggattacaggcgtgagccaccacacccggccaggactcctgttcttattagggcccaggctaatggcctcattttaacttagtcacttcgttaaaggccctgtctccaaatgcagtaactttctcaagtactgggagttaggacttcaaatgtgaattttgtgggggacacagttcagctcataacaccgcctccatgagtgatccactggaaattcacatttgggaacagagaaatgttagtagaagggagctttgaggctctgaaccaggagcctacccctgtgcaggaggctcttctgcttaaccacttgaaggtttgcggagttttctccataaaaggaagccatttattcctctggagctaaaatatgcctccctccaactgctcttctctgttcccagggctgccttgtggaactacagagaataaactcacctcctttttccacatggcagccctctaagtatttgaaaacatttatcatgtctttcctttaatcttttcttctctaggcaaaacatctcccgagaaaataacctgtctcacattaaaagaaaaactccagggcttatatatatttcagacaggaatgtgcttgatggaagcttgccaaacatcactgggtttcaatttcagtatccccagttttaagaaccatttctttctcagactctttaaaacatgagaacaacttagtttgctttaagccaaatattatatactgaaagaattgactggaggacatgagtcattgatactgaagtatgtgactgctggtataagggaatcccttacctcaaggatgttgcaaaatgagctgaagtcaaataaagtgaagaaaacatcaatatatgttgacatggattcctaaccctggaatgatcagtcacccttctggtacttcactcaacaagatgattagcatacagccttacacaaagcagtagctagagattagagcaagagaattcctgctttccagataactgttagctgtaaataaagtggcagattgatagtgtccaaccaaatagtcagggagcagagccaaggtttgctctcaagcagcctcctgccaagccctgtgacctcaccgtgtaagcttagcattatggactgaaggtttgtgtccccctaaacgtacatgtcgaaatcctaactctaaggtgatgtggtatttggagggaaagcctttgtgaggtacttaggtcatgagggtggagccctcatgaatgggattagtgtccttccctttcaccatgtgaggttacagggagcagtctgcagtccagaagaatccaggactaccagatcccaaccacactggcctcctgatctctgactttcagcctgcaggattgtggaaaataaaagtgttccttgtttataagccacctggtttatatggtgcttttatagcagcccaaatggactaggacaatgaacaaaaagtatgatgtcttctcatgcttgtcaaaatcctggtcctaagtattcccctaatcaagtccatttctgttgagtatgttcaaataccttaggattctttgtcagtgttatcttgatagatgtctggccattggaatctgatgctgtttcgagtcttcatcccttatgtagctcatggactccttttggtcttcagttttctgaatatcttgtaatgaggactctccacgtgaatccgtttccattcaatgtgcggggttctttgagctctttcggtctagaaactcatacacttggctggatgcagtggctcatgcctgtaattccagtgctctgggaggccaaggtgggaggatcacttgagcccaggggtttgagactagcctgggcaacacagcaagaccccgtctctacaaaaaaataaaaataaaaaaattatctaggtgtggtgttgcatgcctgtagttccagctactccagaggctcaggcaggagaatcgcttgagcccaggaggttgaggttacaatgaatctcaccatttacactgtagcctgggtgacagagtgagaccctgtctctaagaaaagaaaagaaaaattcatgtacctcatttctgggaaatttttttacatatatctataccttttcatttggtctatttcatagagttgcctaggtaaagaaataaatatatgtggactcaaggagagaaataatatttattctacatcacttttattatttgagtttttaatgtttattttcccgttgctttttaaagtgattttaaaattctcttttagtgtttctgttgtatcataacaattcctttgaggaactattcttcagagtatttatcttggattttgaatagcaataaccatgtctatacaaacatgtccagttcaactggaccataaaactcaattagttgatatttatctatgtgcatagcatgcagcagagagcctgcccatcctgtagataacctgacagtgtcatttagattcagggtgtgtatagatagatagatacagacagatatctatctatacacaccctgaatctaaaagacaggtgtctgtctatctatctatctatctatctatctatctatctatctatctactatctataactatctagatatagatatatctctatatagatatatatatatagatatagatatatatatctatatagagatatatctcctcttttacagttatccaatttggagctgtatttcactcaactttaaattatcttggagcatttcaaaggaataacaggaggtgaggtcaccccactgattgccagggttgacttggctgatcgggctggctaggcgggtgtccccttcctccctcaccactccatgggcgtccctcccgaagctgcacacttggttgaagaggatgaccatccctgatagaggaggactggtcttcggtcaagggtgtacaagtagctgcgctcccctgctagaacctccaaacacgcgctcaaggtccatttaaaggaataacagtggcatcgattctctgttctatttcatctgtccttttccagcaagaagaaaagagaccctactggtttttggcttcttttcctccaagggcgatgccaggttaaagagaaaatgagaggagaggaggccagggagggttgaatttagtgtgcaagtccattcttccattccgtgacactcatatttgggttaaatacctaagcatccttggaggaagttggagagcctaatattggttttaattctgagtgtagtggtccctgtcccctccctttcaggaaaaatagaggaaagtagcctgctttattgcagccatctgtccactggtcccgcctccagactgcccactccgaggcctctcccgttctcttcctgtgtcactgcttggttttttgtttttgttttttatagagatgggatcttgctgtgttgcccaggctggtctcgcactcctggcctcaagcaatcctcccatctcggcctccccaagtgctgggattacaggcatgagccacctcgcccggcctgtgtcactactttgtgctgtcacactgtggaccactgtttccatgttttaatcctctccacatgtggctttgctgccactttctccctcattgcccctaatccctgtccattcccagggtcctttttcagattcctcttcctcagggttccaggccattcttatttcatggacatcattccgttcgggtgatcccacagattcgcactgcatctttcatcttgtgggcaccgtgactttggactcctccctcaccttcgtcactactgcatccatctgttttgttgcttcagtctcttcctcccgtcatcacagcctggttgccttttctaaatcacagtcaaattcggtgccaccatcccctgcctcaagcctccaatggctccctatagtcttcagaaccagcagcacaaagttcttttttaaagaaacaaaccagcttttgtgagctgtaattcacatactatgcagttgacccatttaaagtacacagttcagtggtttttgctatattcacagagttgtataaccacccccacaatcaactgtgggacattttcttttctttctttcttttttttttttgagagggagtcttgctctgttgcccaggctggagtgcaatgacgcgatctcagctcactgcaaccttcacctcctgggttcaagtgattctcatgcctcagcctcccgagtagctgggattacaggcgtgcgccacaatgtctggctaaattttgtatttttaatagagatgggatttcaccatgttgaccaggctggtcttgaactcctgacctcaagtgatctgcccgcctcggcctcccaaagtgttgggattataggtgtgagccaccacacctggccaggacattttcattacctcataaagaaactccatcctggttagctgtcactccctctcccgccaaaacccccagtcttaggtaaccactaactactttatgtctatggattcgcctcttgtagacatttcaaataaatggaattaaaccgtgtatgctctttggtgactagcttctttcacttaaagttttttcaatattcatctatgttatggcatgtttcagtactttatttcttattactttttattactaacccatttccattaaacaagctcaattttatttatccctgcatgagctgatagatatttaggttgcttccacttttggctactaggaatattatgctgtaatgaacattgatggacaagtttttctgtgggtgtgtatttccattgctcttggttatatgtctaggagaattgctgggtcatataataaatttatgtttaacattctgaggaactaccagcctattttccaaagtggctgtaccattttaccttcccaatagcgatgtgtgagggttccaccttctccattccttgttattgtggtcttccttgccccccgccacctgcccctgttttttaaaccaggcacatcagctttatgtttttttttttttttttttttttttgacacagtctcactttgtcgcccaggctggagtgcagtggtgcgataccatcttactgcaacctccacccctctgggttcaagcaattcttgtgcttcagcctcctgagtagctgggattacaggcgcccgccaccacgcccggctaatttttgtatttttagtagagacggggtttcatcatgttggccaggctggtctcgaactcctgatctcgtgatctgcccacctcagcctcccaaagtgctgggatcacaggtgtgagccaccgcgcccaacctgttgtcttttttcttttttattatagtcatcctagtgggtgtgaggtggttttgatttgcatttttctaagggctaataacgttggacgtattttcatgtgctcattggtcatttgtatattttctttagagaaatggctactcagattctttgctcacttttaatggataatttgttacaaagtctttaacatgtcattcaagaccctttataaatatttttagtttcatctccagtgttgtcttccccgccaagcccccaactcccggacctccctaagtaaactccgaacctcatagctgtgaggaacccactcatgattgcccaaatgtcctgctcttggcatctctgcctctgcccatgctcgtctgtccctatggaccgccttcctttgtgccccaggtagggagtgtcccctcatcccttcagagaccagctccaaggctacctcagaggtgagccaaactagagctgcccactcccgccactgggcgtgtccaccacccactcccgccactgggcgtgtccaccacccactcctgccactgggtgtgtgcaccatccatgactgagctcccgaggccagggatagtatctcatttagatccctgggtgttttgcgtaataaatatggagcaacaacttggtaaatatttgttgagtgaaccattctgatttgggaaaacacgttttctatcatccatctatgtattatacagcaaaatgtttcctataattcttgctttgggtggtgatgtcttcctctaaaaatcctaatttaacaaaaacagagaatggaaatgataaaagaaagtctcctgcattggacagtgaccttaggtctcatctttactcctgcttttatcctaattgatgacttttctttgtaaatgcagacacacagaggctcgctgggcagctgggccgtgcaccctgtccttgatcattcttagaggtagagatcaaaggagacccattggctgagagagtctacaacttgccacatgatctattgctctgccttgtgattttaattgcctctttaagaatatcaaatcaggccggacgcagtggctcatgcctgtagtcccagcgctttgggaggccgaggcgggtggatcacctgaggtcaggagttcaagaccagcctggccaacacggtgaaaccccgtctccactaaaaatacaaaaattagccgagcatggtggcatgcgcctgtaatcccagctacttttgggaggctgaggcaggagaatcacttgaacccgggggtcagaggttgcaatgagccgagatcgcgtcattgcaccccagcctgggtgacaagagcgagactccatctcaaaaaaaaaaaaaatcaaatcagatgtgttagcgtcttcatgaatgtcataaaaagaaatgtttcagtgccaaaactgaacagcagtacagtgacctttgaaaatgttgtttagggtattaaatgtgtaactagtgacattttgtgtgtttttctttttcttcctatccagctcagtggaatagctgttgcttgtcccagtgttagaatttggactgatagaaaggagaggagctggagattcattctgctctgcaagggcagactcgatttcagaagtggcaccagatgatagccttgtgttgtccccaaccactggtgctgagaaatgatgcagaaccaagccctcagatcccagatcacccacggctcctgggacatctctggggaagggacttattaatgtagaccctgatgcaacatcccaagtcgtctttatccatgatttgcacagccaggacactctggggctgggattgggaggagaggaatggccaagttgccctgcccccttggctctgtggactccagaaggatggtcagtaccagcagcatttcacacacaccagcctcattattaaaattggagcaatttgtgaaatagagttgagacttctctagagaaaaaaggttgggaagcagctcagtggctgggtctgggagtcagcttccaggcaatatctcactgagtcaggacaaggcccatcattccctgttcccgccaggccgggtatttgccaggatgtgaaacggaagccaggcttttggagaggctgaagctgatttttgtaacaaggtctggttaccagcaaggaagcggttttcacgttgctcactctgggcccgagtgtggtgcatcgcgccccctggtgcccaaaaagtgcaactacgtgccatgccagccagctctcctggacttccatttttccctgattctcctgttcctcgcccacccttctctttgctgtgcccactgtggtctacgccgaggctcccctccctcctccctgccccaagcaataatgaacaagatcttcattctctgaagagaagtgcaatagtaaaactttcctttttgtttgtgtaggggaagagctggtgttaatgggtcaggcaggcaaggcatgaagtgataaatagggaaaggatgaaagaagggaacaaacccaggggacctaacggacccaccctaacaaaaaattggagtacaaaaaaagtgtattaaaattgtgagaccacaccaactcattcgtcactcgtgtctttacaaagaacaaacctgaagcttcaatgagaaagaattgaagtattctagggctgcctgaaatcttctgaacttttaacataggctttgatttccgagttgtgtgcttgcatgttagagatatgatagtgtctaaaaattggaacatggcatagtttgatctaaaaagttagctaacttctgccatttagaaaaagaccccatgctcaagtctgcttttgaaaagttgccttggtcaagtgttgaagacagcacttgttagaaggaacaagttcacttctgagagcccttctcaaagagtttaggaaacagcactactgagagttgccagtcttcagagcagtgcaacgtgtgtgtatgcgtaagacacagatggtgaaaatatcaaatgctacagatgccaagaagggaggtgttggcaccacaccaacctttaaacaaacataaggatgcagaatgcagtctttaaaatggagggagaatttactgtctgtgtggctatttccttgaaatgacttaaaaagctgagatacagaagtattagtaaatcggtgccaggaatgaagtaaccgtttagatccaatgcgccggctccagcatcgaactcatgcccagcaccctttaaaccctcccgggactctgcagaacccgctgaccactcacagagcccagctcgggggagggctttaaggtgaagcacgtgaccccctgcttgtgcggcccgggcggggaagtttgcgctcccgaagtcctggagctcagcaagggaggggccagcgccagcccgcgtgtgggtggctgggtgggggcgtgggtgggggtccgcctataattatctggggaaatgcatccgcgctctgcttttcgctgcggcagctccgagggcacctccggttctcccccatcctccgggagtgtctgggcgctcagtccgctctgatcccgccgaaaccacctgcggttggcaggcaggagactaggcgtctgccggggagggcagggacccgctaagctgatctcctgtacagtagtgctacttaaaatatgctggggaccatcaccatcacaggtaaggcacaagccaggtcgcttttgtcctccctggacggcaggcacggggcacgaaaaggggctttcttccgttgaatgagcgtttggtggggagcccgggaggtcagtggcgggaccgttattggcatttatttctctccgtgtactgagtttttcttcagaagaacattctcccttgggctcagcaagaatcagacaacctcagtgtttcatttttggctgagctggaatcttcttgactgtgcctatgggagacctttagtatattttgttcggggttgtacccttccccttagggagagagggatgtggagaggaacaacagcagccgactgaatagaaatatgtcagatttgtgtgaatttgaaaataagctgtgaaagcttaatctcttgccgtagtcatagacagaatacattcctcttctgggcaaattacaagtgtttgcattttgacttgtttactaggaactttgaataaaggtacacttggtggtttaggggactaacatttaagctctgctttaagtggtggttttaataaagccatagttattataaaatcggtggctaggaagcaacactatttaggcaacaaatagtaaaaaaaaaaaaaaaaagaaaaaaagaaaaaagtatgtttctttagcttactttctaggaatctggccgtgagtatgaattataatatttactgcctacttctagcaaataacttacacgcatcaaacttttagaatgctcttacagctcctctaacttgacatttgatagtcttatgccattgtactgtggcctaacctgcgtattttctcttcctgtcatcaagaaaattaaattccgtttgtgaatttaactttataggaacaggacttctttattctttaaatatttgagatcattgctgccaaatctttttttttgtttgtttgttttttgtttgttttttgagatggagtcttgctctttcgccagactgaagtgcaatggtgtgatcttggcttactgcaacctccacctcctgggttcaagcgattctcctgcctcagcctcccgagtagctggggttacaggcacgtgccaccacgcccagataatttttgtatttttagtagagccggggtttcaccaagttggccaggatggtctcgatctcttgaccttgtgatctgcccgccttggtctcccaaagtgctaggattatagacgtgagccaccgcacctggcctacattttttttttttttttaatcaactgtagaatttctaggacttaaaattttctcaatgcaactgctcctgcaaagccatgcgctccagtggaatttacaagaatgtgaaagttcagcaatactaaaattatctctcacttcctatagattagcttgtttactttgagatttccttaaaattcgacccccaagttgacttggctaacctttctaccatttactcagcttgaaagtttatgccatatctcgaaactattaataaatagactgtacaaaatgaaaaaaatttaaaacacaaaaatctccattttttcccccagatcattaacttttctatgaatgaaatatgcaaatgtgtattgtagggagtcacagctggggtggtgcttctgagatcatgacttttttctgagtactttttgggtacaatatgatttttattatattcactattcaattagtcgcatactgagattcctatggtaaaaggaggtggtctaaagttttagcagtaattaaaggttaataaactgggagcacttgagggggcttgtaatagttggctcagataatcccaatggagtgataaatgaatggaaatagtgggaaggactaacttttaaggcaaaatcaggtaattggctctattgctttctaaatttacttttcttacaatgtgggtgtggaggatatggcaaaattttgcactttttcctggtaagaagaaagtgcacagaaaatcttaactccaaaaatttaccagcaagaaatcttacgtagtggaaaaagtaaaaatgaaagggagtttcagctgtcatttggtttttgctccgcaagttattctgatggggaagattcataatcatcatctttaaatagttgctcagaatcttgaaaagccatgagagctttaaaaattgacagtaacaaccgggcgcggtggctcacgcctgtaatcccaggactttgggaggccgaggtgggcggatcacgaggtcaggagatcgagaccatcctggctaacacggtgaaaccccgtctctagtaaaaatacaaaaaaattagccgggtgtggtggcgggtgcctgtagtcccagctacttgggaggctgaggcaggagaatggcgtgaactcgggaggcagagcttgcagtgagccgagatcgcgcctctgcactccagcctgggcgacagagcgagactccatctcaaaaaaaaaaaaaaaattgacagtaaggtggccgggcgcggcggctcacgcctgtgattccagcactttgggaggcggaggcgggcggatcacgaggtcaggagtacaagactagcctgaccaacatggtgaaaccccgtctctactaaaaatacaaaaattagctggacgtggtagtgtgcacctgtgatcccagctactcgggaggctgaggcaggagaattgcttgaacctgggaggcagaggttgcagtgagtcaagattgtgccactgcactccagcctgggtgacagagcaagactccgtctcaaaaaaaaaaaaaaaaattaaattgacagtaaggtttaatgaaatcttaaaggtctttgcatctttgggattattcacttaaatactatagaaggttattgtagttatctttagtactatgttattttaggaggcctgtgtttaaattttacaattcattaacaggactgatggcattttgtaggaactacttaggaacaagtttgcatttctgaaagtaaggaaaagctgtcacttaatactattatccccctcccccctgccacacacacaacccagtttacacaaaccactaaaatgaatgcagtggaaattgaattatgaaatgattgcttattcacattacatactgttgccattcttggggtctctttctctcacatctcatttgcaataagttagctttgagacaagaaataagtgatgtgacacgatgatcatccccttccccactcaactgtaaatggcgtgccagcataaaaatgcctttttttttgagatgaagtctcactctgtcacccaggctggagtgcagtggcgcgatctcagctcactgcaacctccacctcccgggttcaagcagttctccctgcctcagcctcccaagcagctgggattacaggcacctgccaccacgccccgctaatgtttgtatttttagtagagacgaggtttcgccatgttggccaggctggtcttgaactcctgacctcaggtgatccacccgcctcagcctcccaaagtggtgtgagccaccacgcccggccaaaaaaatgctttttgaattaagcaagtatcttttcgcttttctctaacacccacattactgaaactgataatattgatacattgcaaactgtgaagtatcatgagaaacagggacattattctttaaagtagaaactggggaagaatcaatcctccaacgttcatgttagttctagattatttataatgcactttccgatgcaaataatttttacaagagaaaaaaataccttgcacatgggtgtttcacatctgctatggagacagattccttgtcaagagactttggagacacgaaattgatactttcacaactgctggattaataactaccacttcctgagtgcctagtctggcaggtgttgttcagcactttgtggacattatcatgtattcctcacaataatcctgcaaaaagtggttctgtaaccccatttctatcataaaagtaagtttctcatgatttgataattacccaaggtttcacagctagaaagagcataactgtagagtaccttgcaaaagacctctttctcgttgtgaagatgctaatacttgtttagtgacccacattcttacatgcctgcccagatgtttaagggatcgtgaaacatcaatatcaagaccagggattgggactgggcacggtggcttatgcctgtaatcccagcactttgggaggccaaggcaggtggatcgcttgagtccaggagtttgagaccagcatggtcaacgtaggggagacctcctctctacaacaaattaaagatttagctgtgcatggtggcacatgcctgtagtcccagtcacttgggaagctgaggtaggagaatcacttgcaccactgaattccagcctgagcaacagagcaagaccctgtccctaccccaccccccaaaaaacacaccaggtccaatgatgatgtcacctatatgctccagtatgggatccttgcttttatgaatttgcatatatctccgcttggaggttttctggttaatgagctttagaacaagggagattgggtgtgtagcctataagggatggacttagaatgcagagaattcctggaaaaattccaggacaatgctacgaatcttgggggaaagataactagttccagatgttactgtaagccgtcctgatgtgcctggggatggggagcactggtgattctcagcctgaaaaatgaacatgtcgtttctgcagtatcgtacttctttttctcaaccaaaaatgatggtgctggtgtcactgaaacctgatagctaagttttggataaaaacattaatattttgtagtatataatcaacatattcctttaaagtttttttttcttttaagcctctaaaagaaaacaatttataatttatctcttaatcgctaagtatttggaaaagtgagaaaaaaaagatgatgctccaggttttgaacacacgggctgtctctacattatatggagcttgcggatggggaacacatagccagcagggaccactgtagcttagcccttcttgggatcatggagcgtttgcagctttggggacggggagattatggagattttcgaaaggaaaatgtgtatttgcacatacacgttatagacctggagactgattttataaatcgggattcacagaacatttatctggagataaacccaggttaatagcaggtaacaacacctcagtgtgaaacacttcagtaattcttggcccaagtgaggtttttgtacatgaaatgatttcaagttttgatttcttactacatcactaaagatgtaacttttcatatattttcacatttatttgactccgttaatattccataggacttttttttttaaccttgaaggggcttgttatgacaaagctgtttaaaatattaaaaagcacctagtttgttattattgaataagtgttataattttttttataatgttgtaattgagaatagtttatactcttaaaaatagggtgagaggtgttcagtccaggaagtatctcctctatttcactttccacacttattattaaggataactttcatttatcttagaaaaacataaagcaaaagcctacccaaggtctcgcttggcagtgataacttcaagttatttttccttccggaatgttgtagcatgaagtagcttcatccatatccagcctttatttttactgcatctttttaaaagttttggccgggtgcggtggctcacgcctgtaatcccagcactttgggaggccgaggtgggtagatcacgaggtaaggagatcgagaccatcctggctaacatggtgaaaccccatctctactaaaaatacaaaaaattagccgggcgtggtggcaggcacctgtagtcccagctactcgggaggctgaggcaggagaatggcatgaacctgggaggtggagctggcagtaagccaagattgcaccaacgcactccagcctggacgacagagcgagactccgtctcaaaaaaaaaaaaaaaaagttttgttttggagtactagtagcacgatcatagctcactgcagcctggaactcctgggctcaacgatcctcctgtctcagcctcccaagtagctgggaccctactgagtagcacgtccagttctgggtctgtttttttttttttttttttttgagacagtctcgctctgttgccaggctgctggagtgcagtggcatgatctcagctcactgcagcctccgcctcccaggttcaaatgattctcctgcctcagcctcctgagtagctgggattacaggcgcccgccaccacatctggctaaatttttgtatttttagtagagatggggtttcaccgtgttagccaggatggtctcgatctcctgacctcgtgatccgcccgcctcggcctcccaaagtgctgggattacagacgtgagccaccgcgcccggcccagccctgcatcttatatgcactatatccatgcagagatccctccttcttgggtatattcagaaaattaagtgaatgaaagctttctctacatcttctttaaaattatcatatcttttccaagtaatgttttcagcatattgaccctgtctcacacaagcatgtgattaggtgtctccacccagaagaagggtatagaaatatttggtttctgtagtaatattctcttgagaaacaaggcatggatgatgttgtttcactaatggttgatgtcgaaagccctgtcaatacaagactgtatcacacatgggtatgtggcctgttggaaggattagtctttttcctgcgctttgaagtgtctacagggtgggaaaagaccagtgactagcaggacagtacgaagacggaggtgcctgtgaattcgggctccagaggcttctacgggggacacaccgaccactccctttaacattttggccatctttgtgacctagtgggatgctggaattgtttctggccgaacctcagcaccagtgagtacgtgagcaccacgactgggctttctgggcatgggagagacttgggcggatagcagcgtgtttaaaaatggcggggtcattcaatcacacatgagttaaaaaactatacattgtgtggaaaagaccactccaaaatcagaggaggttttaggggcaccaaaaagtacatccacatatcagtgatcccaaatcaaagatggagctttttggttttcctctttgtagccagtcggacaaatctaaggcagatgaaaattccataggagttttgaattaaaagaagcgccctaacggaaagctgtgatgaagggtggttgtgaatggattccactgtgccaggcctgcacgggttagcactggctgcctgtcctggaagccccctccattatttttagaggcctcttatcaatcactcccttcactcccagcagtgggagtgggttgagcctctggtctgagcctctcctgcctgccgcccccacatcttttaggctattttataatgcatttaacagcctcccgctgtgttcactaagctacagtctttaactcattcacaaccagcatgcagggagcatgtaaaaatactttctcaggccgggcgcagtggctcacgcctgtaatcccagcactttgggaggccgacatgagcggatcacctgaggtcaggagtttgagaccaatctggccaacatggcgaaactctgtttctactaaaaattagctgggcatggtggcgggcgcctgtggtcccagctactcgggaggctgaggcaggaaaattgcttgaacccgggaggtggaggctgcagtcgagatcgcaccactgcactctagcctgggcaacagagcaagactgtgacttcaaaaaaaaaaaaaaaaatgaaaggtttctgctcaccacaaactagaagggaatgatggtggtcttgtttgggactctttacctgcagcaagaacctgggaaatgtgggggtgattttggtgtgtcatgtacagttgggctggggaaagcgaaaaaagtgaagaagaggaggtgaggagggggaggtcagcacaggaagaagggtcctggccacctttgacccatacttggggtaaaggacctgcatctggccaggctctgtggcttatgtctgtaatcccagcactttgggaggctgaggtgggaggatcacttgaagccaggagttcaagaccagcctgggcaacatagccagttcctccatctctacaaaaacaaacacaaaacaaaaacagaaaagggatctgcatctttacatggtgcaaataaagaaaactagaagatagggagttaacttgagacatactattatgtgctccttttctccccttgaaatgttgatgcaggaagtcagggtggtaaaaaataggcacaatgtcacattcagcttcacaagatttgaaagtgcatctcagctgggagcggtggctcacgcctgtaatcccaacactttcagaggccgaggcaggtggatcacctgaggtcaggagttcgagaccagcctggccaacatggctaaaccccatctctactaaagatagaaatatttagcggggcgtggtggtgagtgcctgtagtcccagctactcaggaggctgaggcaggagaatcgctggaaccctggaggcagaggctgcagagagctgacatcatgccactgtactccagcctgggcgacagagcaagactccgtctcaaaaaaataaaaaagagtgcatctcaactttttttttttttctttgagacggagtcttgctctgtcgcccaggctggagtgcagtggcgcgatctcggctcacggcaagctccgcctcccgggttcacgccattctcctgcctcagcctcccgagtagctgggactacaggcgcccgccaccatgttcggctgattttttgtatttttttagtagagacggggtttctccgtggtagccaggatggtcttgatctcctgacctcgtgatctgcccgcctcggcctcctagagtgctgggattacaggcgtgaaccgccgcgcccggccttcaacattttgtattggcgattttcagtgacttctggtcctgaaaatcaagagctttctggttcagcagagctgaaagctgttcaatactgccctcttctgtccaaaactcattcaggcatttggacaatgattttatactcgggaatgtttttgacaaagcgtgatggtgaaaattggacattatctaaccatggggacagaaaaacaaattgtgcagccattaggtcttagttttgaagactttattcagaaaacaacacaaatagtgattatctggatgttgtacttatgaaaaattttccctattctctgtattttaaagtcttctacaatttatactgattatgtttggaattggcaaaaagtaaaataagtcgttctattctgaagaaaacaagcaaaaatattaaagtttttgttatttttatagaaagccaactgatacttcatcctcataaccagccttagtgtcctcacctataatgtaagtgacttatgttataggtgaggacactaagaacagagattttcattttatttttatttttactgttgtttgtttgtttgtttttgagatggagactcactctgtcacctgtgcagtggcacgatctccactcattgccacctccacctcgaaagttcaagcaatcctcctgcctcagcctctcaagtagctgggattataagatgcaccaccacgcccagctaacttttgtatttttagtagagacggggtttgactgtgttgcccaaagctggtctcagactcctgaccccaaagcgatcctcctgcctcggcctcccaaagtgctgggattacagccccgtgagccactgcacctggccttatttttcgtttagattcaggggatacatatataggtttgttacctggatatattgcataatggtgaggtttgggctctagtgtacccgtcaccggagtggtgaacattgtactcaatactatttttcaactctcacttcccttccaccctccctcccttttagagtacccagtgtctattatttccatctttatgtccctgtgtactcattggttagctaccatttatgagaatatgcagcattttactttctgtttctgagttattttacttaggataatggcctccagatccttccatgttgctgcaaaggacatgatttccttctttttcatggctgcatagtattccatggtgtatatggaccacattttctttatccagtcaaactttgatggacacttgggttggttccatgactttgctagtgtgaatagtgctgcaagaaacatacaagtgcaggcatctttttgataaactgattttatctctcttgggtagatgccaaataatgggattgctgtgtggaatggtagttctgttttttgttccttgagaaatctccatattgttttctatagctctcttactaatttacattcccactggcaatgtataaatattcccttttctccacatctgtgcgaacatctgttgttttttgactttttaataatagctattttggctaggcacagtggctcacatctataatcccagcactttgggaggctgaggcaggtggatcacctgaagtcagcagttcaagaccaacatggccaacatggtgaaaccccgtctctactaaaaatataaaaattagccaggcgcggtggcatgtggctgtaatcctagctactcgggaggctgagacagaattgcttgaacccaggaggtggaggttgcagtggaactgagatcacaccactgcactccagcctgggcgacagagcgagactctgtctcaaaataaataaataataaatagccattctgactggtgcaagattgtggttttaatttgcatttctctgataattagtgatgctgagaatgtttttgtatgtttctttgccgtttgtatgtcttcttttgagaaatgtctaagaacagagattttgcccaaggacccggtgctagtaagtggtacagctaaaatttaaacaccagtctgtccccagaacttctgctctttaattttcttcccctctgcctgaattttttttctctctttggtgggggaaagttaagtcgttttcttgttgtttaatacgtagataaaatttatattatggtatgtaatgtgaagcaaatatcggatagcctcctctaaaatcaggttgggtaaatcatcactctatattttgttgttttctataatttttagtagttacctgcaattccgagtgcattcttccaagtgattttttaaaaaaaataacttcaggccaggtccggtggctcacacctgtaatcccagcactttgagaggccaaggtgggtagatcacctgaggtcaggagttcgagaccagtctctacagtttagtagagatgtggaaaccccgtctctactaaaaatacaaaaaattagccgggcgtcgcggcgggcgcctgtaatcccagctacttgggaggctaggacagaagaatcgcttgaacccaggaggcggaggttgcagtgagccgagatcgcgccattgcactccaggctgggcaataagagtttccgtctcgaaaaaaaaaaaaaaagaaagaaagaaagataactgtaaacatacagaaagttggaaaactaaaatgaatacagagaacacccataccctttactcagattcacctatcccaaatagtgggatattgtcaacattttccctcgcttgctatatttactttctttttgttgggaaaacaaaacaaacatcagtccacgggtttctgttataagtcatgtaggtatgagatatattaataaattcactggagaaggctgggcacagtggctcacacctgtaatcccagcactttgggagactgaggcggattgctttgagctcaggagttcaaggccagccatggcaaaatccctgtgtctactaaaaatacaaaaactagccaggagttggtggctcacacctgtagtcccagctactcgggaggctgaggctggagaatcgcttgagccctggaagcggaggctgcagtgagccaagatgacgccatggtactcctgcttgggcgatagagggacaccttgtctcaaaaaattagggaagcatttgaaagtaagttatatacatcatggtcctttactcctaaatatttcagtgtgtattctccaagaatagggatattccctttcataaccacagtacagttattgacagttatcaatatcatacatttacgttattacagaacttttctataatctgcttctaattttgtcagctaatctaattatgtccattttaaagcattcctctttgcattacaatatccaccctagggtcagagattttgtgttgtcgtgtctttttagcttcttttaatctggaagacttctatagcttttgtcttttagactttgatatgttcaaagtataagttccctccccgtttctactcattccttatttgatgtttcttttgcctatatcaatttaggttaggttactcattttttttttttttccccgagatggagtcttgctctgttgcccaggatggagtgtagtggcgtgatctgggtttactgcaacctccgcctcccgggtttaagcgattctcccacctcagcttcctgagtagctgggactacaggcacccaccaccacgcccggctaatttttgtgtttagagactgggtttcaccatattggccaggctggtctcgaactcctgactccaggtgatccgtctaccttgcactcccaaagtgctgggattacaggcgtgagccgctgcacccggccataggttactcattctaagccagaatcctgcagaggtgatgttgtgtccttctcagggtattgcacgcggtgtccatctgtcccttgtaggctgatgttaaggtgttttccaatttctccactgtagaattgggcttttctccctccctttcaacaataagcatgtaaatatcctctcctctcctccatttagcactttagcacccattgattcttgctttatccagctttcactttgatggatgctcgggccgatcttttgaatcactatctgtgagtgggtgggtaggatttatgcactcttttcaaaacgatgcatgactgtaactgtgaataaactctgcctttcacactgaaatagaattcaaattgctgtccacattagacataaagcagtttttccatctaagtgtaggagttgacatatcgaaatacttgttcttgccataagtggcgcttatgaactataaaaagttgtaatgatttatggaaaataagaatgtttatgctttaaaagtgtatgaaattgacttttctttcaaaaagacaaactgtgtattttgctcctttagtgccttcactctaagcactacccagccagcctttggccctcctgagataccacacacctatatgacgttggtcaagtcatatgaccgtttttaaaaagactgtttttaagagcagtttcaggttcacagcaaaattgagtggagagttcggagaattcccatgtgtcccttgccccaacgtctgcatagcctcccccaacccttatcaacattccccaccagaatgggtcatttgttacaatcaatgaacctgcactgacacatggttatcacccaaagtccatagtttacattagggctcactcttggtggtgtacattctgtggatttgggccaatacataatgatgtgtacccaccattacagtgtcatgcaaaatggcttcactgccataaaaatcatctgtgcttcatgtattcatcccttcctcccccaacccctggcagccactgctctttttactgtctccaaagttttgtctttttcagaatgtcatatagttggaatcatacattgtgtatcttcctcagagcgtcttcttttgcttagctatatacatttaagttccctccgtgtattttcatggcctgataactaatttttctttttttttttcttttttgagacagagtctcgctctgttgcccaggctggagtgcagtggcgcgatctcagctcactgcgagccccgtctcccgggttcaagcaattctctgcctcagcctcccgagtagctgggattacaggtgcccaccacaatgcccggctaatttttgtttgtttgtttgttttagtagagacggggtttcaccatcttggccaggctggtcttgaactcatgatctcatgatccacccacctcggcctcccaaagtgctgggttacagtcatgagccaccgcgcccagcggtggtttttttttttttttttagtgctgaatagtattatgttgtctggatataccatactttatccactcacttattgaaggacatctgattgcttccaagttttggcaattatgcataaagttgctgtaaacatctgtgtgcagatgttttgtgtggacataaattttcaactcatttgggtgaataccaaggagcatgattgccagatcatatggtaagagtatgttcagtatgaaaacaaaccgcagactgtcctcccaagtggctgtccatttgcgttctcacagatgactatttttgaagtcccagttggagggagcaggtgagctccaccttctagcccataaggctctgtaagtgatggctttgtgatgggaacttgactgatagcctcatgggcgaatgtgatgggaacttgactgatagcctcatgggcgaatactcaagaacttaaagctctttacaaccaagccaaacccacgagcaggttccaccatgccttggccattgccagacaaaaccccattgtgtttttgcttgattttcgtcctgtgacactgacatttcaggccaggctagttgttttgcagaacgtccttcattgtggattcatctgattgtttcctcgtgattagatgccgttaaacattttgatcagcagagctgcaaagatgaattcttgtccttctgagtgcctcacatcaggaagcgcgatgacatctgttccattatcgaggataagtctgatcacttggttaaagtggtgcctgccagatttctccattgtcgaggtcctttttgtttgtttttgtttcttttttttcttttttttttttttgacacagtcttgccctgtctcccaggctggaatgcagtggcacgatctcggctcactgcaacctccgcctccctggttcaaccgattctcctgcctcagcctcccgagtagctgggattacagacatgtgccaccacgcccggctaatttgtttgtatttttagtagagatgaggtttcaccatgttggccaggctggtctctaactcctgatctcaggtgatccgcccgctttggcctcccaaagtgctgggattacaggcgtgagccaccgcgccaggcctcgaggccctttttcttttaaattaagtgtcagggaagttcagcggcggcttggcagttggttagcaggatggttttcggcctcagcaggcttgggtttgaagagaccccactggggcggtccgcaggacccccgggggtttcctgggaggtcgagggctggcgccgggcgcggggaggctgcgtcttttgtgatgttcgcggctggcttcccgggcccaggctttcgcgagctatggcagccggcaggggcgcgctgggcctcacgggcggctgttgggctgcccctgccggcgggctgcgcgcgccatgccctggtggagtaaactctgcagtgagtagcacgtgcacccaagcggcagttcgccccgcagcgatggcggacacggaatcccgagggccaccaactgtcccttaggaccggcccgagatgggtgtgtgtgggttttccagcctccttccttcccgtcccaggcttgggaaagcctctctactggccaaggcgcgcagggacaggtcgggaagggcctgcgcccgtggcatcccagcccaggctgtagagccgcccgctgcccttgatcttgccccagcccccagccctagaaaggaaaggcctcgttctgggtcccgtgacaggtgccaaaacgctctgcgccagcagcctacctccccgaagactctggcttgaaaggggagtcggggggttggaatggacatggctgtggctgcggtcagctggggaggtgggcggcagggcaggtcgaggatgacccaggcctcaaaaagtcaccaggatttagcgaagttgccctcactgtaaggcctggaggccggcaaagtgtgggacgcagaacagaatggaacaggcctcaacacttgggctgcgccatggggagtgtgaagcccagtgatggggcaggctggaaagtacggtctaggcttcaatgcgggttccaagcccagtgggtggccacacgatcgcatgtgttttggggtcaggatctcaacagcgcgggtacagatataggtacctgccagactaggtaggttagaagactattctctaggccctaaagccattaggagtccacagcctgttgatgtgatagaagcggtattttaggaggctttgcttagcaggtaccttgtatggagtgagtagattgccccagcacagagggtacgtggaggccgaaatcaggctgaagcacaaagcatggaggcgcccgaagattgttctgacaattgtagctcttaggattacttatgttaaaagagactgcagactagttgaccagctacaacttaaaatttttctatatacattttattatgtgttcaactcataactcacttactctatataaagagagcatttgattattgttaagctgtactgaactatcaatagctgttcagtaacagctaccttagatactgatggcagtcgcccaggctggagtgcagtagtgtgatctcggctcactgcaacctccacctcccgggttcaagtgattctcctgcctcagcctcccaagtagctgagactacaggcatgcgccaccatgcacgactgatttttgtatttttagtagagatggggtttcaccactttggccagcgtggtcttgaactcctgacctcaagtaaaccgcctgcctcagcctcccaaagtgctgggattacaggtgtgagccatagtgcccggcccaatagctgttttgttctgcctgctggcagctggttcacgaacctttatctccctagttttgactataaacatgtcggccctttcagaatgaagcagaagtgtttccaatggaaacacagatttaagagtggagggaaaatagtgagggggaaatggttgtgtgacaccagctttctactcctatattagcaacatgtctctgcattttctgattccagggaggttgatgagtgtttgtttttaatcacatgcttgctggcaggatatgtaatttatgtttgtattctgtactagtgaaatcatactagaatagagtttgttactggaatttttcttttttctctagtatatttccaattattttatccaactttttcaaaaggaaagtcacatctcttaaatggcattagaagtgtttgcaaaaagttcttttgtgaccgccaggcacggtggctcacgcctgtaatcacagcactttgggaggctgaggcaggcggatcacctgaggtcaggagtttgaaaccagcctggccaacatggtgaaaccttatctgtacaaaaaatacaaaaattagccgagcgtggtggcagccacctgtaatcccagctacttgggaagctgaggcaggagaatcgcttgaacccaggaggcggaggttgcagtgagctgagatcgagccactgcactccagcgtgggtgacagagcgaagactggttcaaaaaaagaaaaaaagaaaaaagaaatagttcatggaaatacacttaaggaagcctttggatttaactataaacaaattcatcacagtgtcagtttataataggaacaaatagaaacttaaagcattttcttatttcagaatactatacatgctttaaaaaataatgggaagagtgtatatatctaaaatgtagaagtagtttaaatcgtcgatgtctggactttctctttgaatatttgcttcaaagtttaatatgagtgtttaatttttccttattgtttgttaagtctaatgttggtcacaaatgtgtattttataaagagaaaagggaaatcctttaggaatgcgcctcagatcaaaataatgagattcttgggtttttcttgaaatcttcttcgctatctgaaatgtttagttctcagaggtaaaactaaaatgttttgttttaaatgctatcttagatactgatggcagaaaaaatgagccttgctgattatcgaagctgttacagatggtgagtctatggcatcaccactgaagcaaaggcccttattgagtctctgaagaataagaggcccagataacctattcatctatgaatatccaaaaaatctagcaatatttgaaaagaaaaaaagaactttagcataacttagagaataacaaggtacaaggacaaaaaaaaactctaggtcacactcttgccctgacttggttgggtacctcaggcagttttgttgttgttgttgttgtctgttcatttgttttttgagtcagtctcgctcggtcacccaggctggagtgcaatggcatgatcttggctcactgcaacctctgcctcccatgttcaagagattctcctgcctcagcctcccgagtagctagggctacaggcacccgccactacgcctggctggtttttgtatttttagtagagacggggtttcaccatgttggccagcctgctctcaaactcctgaccttaaatgatccacctgcctggacctcccaaagtgctggcattacagggatgagccacctcgcccagcctagttttttatttaactttctggggttcagtttcaaaataaaaccaaataagtagtatgatggcaatttgtagacatagatttgtaatatttcataaataagaaaattaaattgttttcagagtaataagattatataattggaaggaatgtatggatttggggaagcattctatatttctaaatatttctgcatttcaagtatttattgctgtgttctaagtcttgttgtatgtactagttataattttttttttgggggggacagagtcttgctgtgtcacccaggctggagtgcagtggtgcgatctcagctcactgcaacctccacctcccggcttcacaccattctccttcctcagtctcctgagtagctgggattacaggcgcctgccaccacgcctggctaattttttgtatttttagtagagacggggtttcaccgtgttagccaggatggtctcgatctcctgaccttgtgatccgcccgcctcagcctcccagagtgctgggattacaggcgtgagccaccgcgcctggctagttataattattaaccttcaatttgtgcttaaaacattaagtatattttttcaggttttgttaagatctttttggtgtccattttaattgacctgtttagtacaaaaatcgatatatgtcctatatagaaaattagaggctgggggcagtggctcacacctgtaatcccagcactttgggaggctgaggtgggcggatcacctgaggccaggagttctcgagaccagcctggccaacatggtgaaaccccatctctactaaaaatacaaacatcagccaggtgtggtgacacatgccactagtcccagctactcgggaggctgaggcaggagaatcgcttgaacccgggaggtggaggttgcagtgagcccagatcacatcactgcagcctgggtgacagagtgagactctgtcttaaaaaaaaaaaaaagaaaagaaaaaagaaaattcagacaagcaaaactaaaataaatgacattcgcatcccccagagatcatatgtgaaggatgtgtgtgtatatgtgtgtgtgtgtgtgtgtgtgtgtgtgtgtgtgtgtgagagagagagagagagagagagagagagagaaaggagagacagttgtttttaagccagaatgaggtcattgtatatactgtttggtaacctgctttttgcagtcaaatctctacccttttatgtcaattaaaattcatctcatctaatcccaaatctcatactcagtattttccaagaagacccaaaaatgtccttttgctgtttttccctaacaaatatccaattcaggatcatgccaggtacctctggttgttgtgttccttaaatctcttaatttaacacaatacatctccctcctacttccccccattaaatcacattgacttgacttttcccctcagtgattttaaaattacaaacccggaaaaatatagtaaacacttatatacacttgacctattcgccatttatggaaagccacatcatccgccccaccacccactaagctatttggaagttacttgcagacaatccttttgtgtttctgctggattttcatccttctgtgacattgacatttcaggccaggctagttgttttgcagaatgcccttcgctgtggatttgtctggttgtgtcgttgtgattagataccattaaaccttttggtcaggaatgccacgtagatgaattcttgtccttctcagtgcttcacaccaggaagcgcgatggcatctgtcccattattgaggatgttaaatgtgatcacttggttaaggtggtgcctgtcagatttctccattgccaaggtcatttttttgaaattaagtaatgtgtatgttggtattctgaatgtacgtttcctgacagccttttacccgatggttttagcagtttatgatacttgactgaatgagttattacaatggtgtctgtaaattgtgattttctaaatctaaaattctaacaataatgactttgaggatcaaagtggaagttatatctatatttattgacatttcttttttccttaaagaagcgctcccttctcctcatttaccttttttagtatcactctcgattcatggattctttttttattcaatgtgttgtaacccatcaatgtcatcattctctttctttttctttttcacatcagacgagtaatgtgccatcgtggtgacaatgcacacattgcacatgaacacccaatcgtcactctcataaaatacaaaggatccattattcttttctatgcttcaaagtttgggcattgggagccccttcaagccagttcttgtgtccttttgacacctccatcagcttttgagcatctcctttctgttacaacaaaatattcttcatacgtcctctgacccagcctggaatttctccaaagagctctggtcccttttggggacctgttgaggtcggacttagttaccacatagaatgtccccttctttagatttgtgtagatacttgtttgttctttagcttgttcctcaaaccctatatttcctgttaagtgggaagttacatctaaaacttgatggattcttgtttaaaatatgggtgtgatgtgggattccatcttacattgcaacagaagatgcactacctcgttgactcactcttagaggtgccgtgactacttatgtggaactaattttttgatagttaagtttgtcaactttccctttaacaagcaacagaaagagcagataattctctttgaacctgaatttttgaaggtcattggaaagaagtagacattaatctattaagatttgcaaatctctgtaagatctcactttatccttgaattgcctcgcattaaagaaagtattaattggtcatatttttaaaatatttaattttcactgggtgcagtggctcacgcctgtaatcccagcactttgggaggccgaggtgggtggatcactagaggtcaggagctcaagaccagcctggccagcatggtgaaacccctcccatactaaaaatacaaaaattgactgggcgtgttggctcacgcctgtaatcccagcactttgggaggcagaggtgggtggatcacgaggtcagaagatcgagaccattctggctaacacggtgaaaccccgtctctatactaaaaatacaaaaaaaaaaaaattagcctccctactcgggaggctgagacaggagaatggcgtgaacccaggaggcggagcttgcagtgagccacgatcgtgcctctgcactccagcctgggtgacagagtgagactccatctcaaaaaaaacaaacaaaaaaaacaaattagctgggcatggtgacagacgcctgtaatcccagctaatcaggaggctgaggtgggagaatcacttgaacctaggacagaggttgcagtgaaccgagatcgtgccactgtgctccagcctgggcgacagagtgagactctgtctcaaaaaaaaaaaaaaaaaaagttaattttcttgggctaggcactatagctcacacttgtaatcccactgctttgagaagctgagacaggagggtcacttgagcccagcagttggagagcagcctggacaacatagtgagatctcatctctacagaaaataaaaaacttagctggacatggtggcatgtgcctgtagtcccagctactcgggatgctgaggtgggaggattccttgagcctgggaggttgaggctgcagtgagccgagaccacaccactgccctccagccggggcaagagagtgaggccctgtcggagaaaaacaattttcttgtattgtaatcaccttttctcttctccccacccccccgcccctttttgttaatagttggacagagagactctgaagatgtgagcaaaagagactccgataaagagatggctactaagtcagcggttgttcacgacatcacagatgatgggcaggaggagacacccgaaataatcgaacagattccttcttcagaaagcaatttagaagagctaacacaacccactgagtcccaggctaatgatattggatttaagaaggtgtttaagtttgttggctttaaattcactgtgaaaaaggataagacagagaagcctgacactgtccagctactcactgtgaagaaagatgaaggggagggagcagcaggggctggcgaccacaaggaccccagccttggggctggagaagcagcatccaaagaaagcgaacccaaacaatctacagagaaacccgaagagaccctgaagcgtgagcaaagccacgcagaaatttctcccccagccgaatctggccaagcagtggaggaatgcaaagaggaaggagaagagaaacaagaaaaagaacctagcaagtctgcagaatctccgactagtcccgtgaccagtgaaacaggatcaaccttcaaaaaattcttcactcaaggttgggccggctggcgcaaaaagaccagtttcaggaagccgaaggaggatgaagtggaagcttcagagaagaaaaaggaacaagagccagaaaaagtagacacagaagaagacggaaaggcagaggttgcctccgagaaactgaccgcctccgagcaagcccacccacaggagccggcagaaagtgcccacgagccccggttatcagctgaatatgagaaagttgagctgccctcagaggagcaagtcagtggctcgcagggaccttctgaagagaaacctgctccgttggcgacagaagtgtttgatgagaaaatagaagtccaccaagaagaggttgtggccgaagtccacgtcagcaccgtggaggagagaaccgaagagcagaaaacggaggtggaagaaacagcagggtctgtgccagctgaagaattggttgaaatggatgcagaacctcaggaagctgaacctgccaaggagctggtgaagctcaaagaaacgtgtgtttccggagaggaccctacacagggagctgacctcagtcctgatgagaaggtgctgtccaaaccccccgaaggcgttgtgagtgaggtggaaatgctgtcatcacaggagagaatgaaggtgcagggaagtccactaaagaagctttttaccagcactggcttaaaaaagctttctggaaagaaacagaaagggaaaagaggaggaggagacgaggaatcaggggagcacactcaggttccagccgattctccggacagccaggaggagcaaaagggcgagagctctgcctcatcccctgaggagcccgaggagatcacgtgtctggaaaagggcttagccgaggtgcagcaggatggggaagctgaagaaggagctacttccgatggagagaaaaaaagagaaggtgtcactccctgggcatcattcaaaaagatggtgacgcccaagaagcgtgttagacggccttcggaaagtgataaagaagatgagctggacaaggtcaagagcgctaccttgtcttccaccgagagcacagcctctgaaatgcaagaagaaatgaaagggagcgtggaagagccaaagccggaagaaccaaagcgcaaggtggatacctcagtatcttgggaagctttaatttgtgtgggatcatccaagaaaagagcaaggagagggtcctcttctgatgaggaagggggaccaaaagcaatgggaggagaccaccagaaagctgatgaggccggaaaagacaaagagacggggacagacgggatccttgctggttcccaagaacatgatccagggcagggaagttcctccccggagcaagctggaagccctaccgaaggggagggcgtttccacctgggagtcatttaaaaggttagtcacgccaagaaaaaaatcaaagtccaagctggaagagaaaagcgaagactccatagctgggtctggtgtagaacattccactccagacactgaacccggtaaagaagaatcctgggtctcaatcaagaagtttattcctggacgaaggaagaaaaggccagatgggaaacaagaacaagcccctgttgaagacgcagggccaacaggggccaacgaagatgactctgatgtcccggccgtggtccctctgtctgagtatgatgctgtagaaagggagaaaatggaggcacagcaagcccaaaaaagcgcagagcagcccgagcagaaggcagccactgaggtgtccaaggagctcagcgagagtcaggttcatatgatggcagcagctgtcgctgacgggacgagggcagctaccattattgaagaaaggtctccttcttggatatctgcttcagtgacagaacctcttgaacaagtagaagctgaagccgcactgttaactgaggaggtattggaaagagaagtaattgcagaagaagaaccccccacggttactgaacctctgccagagaacagagaggcccggggcgacacggtcgttagtgaggcggaattgacccccgaagctgtgacagctgcagaaactgcagggccattgggtgccgaagaaggaaccgaagcatctgctgctgaagagaccacagaaatggtgtcagcagtctcccagttaaccgactccccagacaccacagaggaggccactccggtgcaggaggtggaaggtggcgtacctgacatagaagagcaagagaggcggactcaagaggtcctccaggcagtggcagaaaaagtgaaagaggaatcccagctgcctggcaccggtgggccagaagatgtgcttcagcctgtgcagagagcagaggcagaaagaccagaagagcaggctgaagcgtcgggtctgaagaaagagacggatgtagtgttgaaagtagatgctcaggaggcaaaaactgagccttttacacaagggaaggtggtggggcagaccaccccagaaagctttgaaaaagctcctcaagtcacagagagcatagagtccagtgagcttgtaaccacttgtcaagccgaaaccttagctggggtaaaatcacaggagatggtgatggaacaggctatcccccctgactcggtggaaacccctacagacagtgagactgatggaagcacccccgtagccgactttgacgcaccaggcacaacccagaaagacgagattgtggaaatccatgaggagaatgaggtcgcatctggtacccagtcagggggcacagaagcagaggcagttcctgcacagaaagagaggcctccagcaccttccagttttgtgttccaggaagaaactaaagaacaatcaaagatggaagacactctagagcatacagataaagaggtgtcagtggaaactgtatccattctgtcaaagactgaggggactcaagaggctgaccagtatgctgatgagaaaaccaaagacgtaccatttttcgaaggacttgaggggtctatagacacaggcataacagtcagtcgggaaaaggtcactgaagttgcccttaaaggtgaagggacagaagaagctgaatgtaaaaaggatgatgctcttgaactgcagagtcacgctaagtctcctccatcccccgtggagagagagatggtagttcaagtcgaaagggagaaaacagaagcagagccaacccatgtgaatgaagagaagcttgagcacgaaacagctgttaccgtatctgaagaggtcagtaagcagctcctccagacagtgaatgtgcccatcatagatggggcaaaggaagtcagcagtttggaaggaagccctcctccctgcctaggtcaagaggaggcagtatgcaccaaaattcaagttcagagctctgaggcatcattcactctaacagcggctgcagaggaggaaaaggtcttaggagaaactgccaacattttagaaacaggtgaaacgttggagcctgcaggtgcacatttagttctggaagagaaatcctctgaaaaaaatgaagactttgccgctcatccaggggaagatgctgtgcccacagggcccgactgtcaggcaaaatcgacaccagtgatagtatctgctactaccaagaaaggcttaagttccgacctggaaggagagaaaaccacatcactgaagtggaagtcagatgaagtcgatgagcaggttgcttgccaggaggtcaaagtgagtgtagcaattgaggatttagagcctgaaaatgggattttggaacttgagaccaaaagcagtaaacttgtccaaaacatcatccagacagccgttgaccagtttgtacgtacagaagaaacagccaccgaaatgttgacgtctgagttacagacacaagctcacgtgataaaagctgacagccaggacgctggacaggaaacggagaaagaaggagaggaacctcaggcctctgcacaggatgaaacaccaattacttcagccaaagaggagtcagagtcaaccgcagtgggacaagcacattctgatatttccaaagacatgagtgaagcctcagaaaagaccatgactgttgaggtagaaggttccactgtaaatgatcagcagctggaagaggtcgtcctcccatctgaggaagagggaggtggagctggaacaaagtctgtgccagaagatgatggtcatgccttgttagcagaaagaatagagaagtcactagttgaaccgaaagaagatgaaaaaggtgatgatgttgatgaccctgaaaaccagaactcagccctggctgatactgatgcctcaggaggcttaaccaaagagtccccagatacaaatggaccaaaacaaaaagagaaggaggatgcccaggaagtagaattgcaggaaggaaaagtgcacagtgaatcagataaagcgatcacaccccaagcacaggaggagttacagaaacaagagagagaatctgcaaagtcagaacttacagaatcttaaaacatcatgcaggtaagcttccttgtcttctaagataatttttctcttttatgccaatagatggcaaatttgttacataaggaatcgggagcaaataattaatgccttcgtgtagaaccttcagttgaggaaaataactatcaactagattcaaagatctaggatagtttcatggtttttggtgattgaaatgccatttagtcttatcgatgttatgaaaagaacgacttcgttttacctcctaatgtgactgctttagaataaaataaaacggcatgtgtgtgtgcacatgtgcgtgtttgacccaaaggcataagaaatacattgtgttcactcaactatcttgttgagtttttttaaaaataactagtgctccaatggctgggcgtggtgcctcacgactccgtctcaaaaaaaaaaaacaaacaaaaaaaactagtgcccccaaatgggctaatattaaactgcctgaaatatagctgatgatagctctttcagaaaaaatggattttttttcccctagcagtagtaacaagtatttttaaaaattttccagcgcatataatgaccgaccctcactgtgttagttacttgcagttgctagtaactccccatctttgtggtttttgttttgttttgttttgttttcttgagacggagtctcgctctgtcatccaggctggaatgcagtggcgcgatctcggctcactgcaagctccgcctcccaggttcacgccattctcctgcctcagcctcccgagtagctgggactacaggtgcccgccaccatacccagctaattttttgtatttttagtagagatgggttttcaccgtgttagccaggaggtctcgatctcctgacctcgtgatccgcccgccttggcctcccaaagtgctgggattacaggtgtgagccaccacgcccagccctatctttgttttgttttttgagagagccttgctgtgtcacccaggctggaatgccgtggtgcaatcatggattgctgcaaccttgacttcctgggctaaagcaaatcgcctgcctctgcctctgtctcctgaatagctgctgggaccacaggcacatgtcattactccgagctaattgttaaatttttttgcagacaggggtcttgctatgttgcccaggctggtctcaaactcctggcctcaagaaatcctcctgcctcaccctcccaaagtgctaggattacagtcgtgagccactgtgctcaacccatcttcgttttcttttgttttgttttgtttttgagacagagtctcactctgtcaccccgactggagtgcagtggcgcaatctcagctcactgcaacctcagtctcccaggttcaagcgatcctcctgcctcagcctcctgagtagctgggattacagataacacaccaccatgcccagcttagttttgtatttttagtagagacggagtttcccccaggatggtcttgaactcctgacctcaagtgatctgcccgcctcggcctcctaaagtgctgggattacaggcatgagccaccgcacccagccctatctttgttttttgtttgtttgtttgtttttgagacagaatctcgctctgtcgccaggctggagtgcagtggcacaatctcagcttactgcaacctccacctcctgggttcaagcgattctcctgcctcagcctcccgaatagcagggactataggtgcatgccaccatgcccagcttatttttgtatttttagtggagacagggtttcaacatgttggccaggatggtctcgatctctttacctcatgatctgccctcctcagcttcacaaagtgctgggattacaggcatgaggcaccgcgcccggccccatctttgtttttttaatggagttaaactatggtattattaggtcactttgacaactatcctgttgttaataaatgagagagaaaaaggagattttatttacgctgattcttcctcctcctacagttaaactcattgtctgtttggaagaccagaatgtgaagacaagtagtagaagaaaatgaatgctgctgctgagactgaagaccagtatttcagaactttgagaattggagagcaggcacatcaactgatctcatttctagagagcccctgacaatcctgaggcttcatcaggagctagagccatttaacatttcctctttccaagaccaacctacaattttcccttgataaccatataaattctgatttaaggtcctaaattcttaacctggaactggagttggcaatacctagttctgcttctgaaactggagtatcattctttacatatttatatgtatgttttaagtagtcctcctgtatctattgtatatttttttcttaatgtttaaggaaatgtgcaggatactacatgctttttgtatcacacagtatatgatggggcatgtgccatagtgcaggcttggggagctttaagcctcagttatataacccacgaaaaacagagcctcctagatgtaacattcctgatcaaggtacaattctttaaaattcactaatgattgaggtccatatttagtggtactctgaaattggtcactttcctattacacggagtgtgctaaaactaaaaagcattttgaaacatacagaatgttctattgtcattgggaaatttttctttctaacccagtggaggttagaaagaagttatattctggtagcaaattaactttacatcctttttcctacttgttatggttgtttggaccgataagtgtgcttaatcctgaggcaaagtagtgaatatgttttatatgttatgaagaaaagaattgttgtaagtttttgattctactcttatatgctggactgcattcacacatggcatgaaataagtcaggttctttacaaatggtattttgatagatactggattgtgtttgtgccatatttgtgccattcttttaagaacaatgttgcaacacattcatttggataagttgtgatttgacgactgatttaaataaaatatttgcttcacttagatttgctggttttattagataccaggaagcctgggacatatgtgtaccacattagaattctaaagataatgattgataagctagaactttctgatgtagtcattacatgaaaccccttgtcactggtttgtgtgttcagaggaagccatggccgagatagctttcctgaaataaaccagtagcttttcagattgacgttcttgctacaattgtaccatctggtaattcctgaaaatgtcaatttttttgtgttaatatttttggtttcaaacaataacaaatgtctctagaaagaaattttaagaaagcttaattaatagtaaaaatgcctttcctgaaataatcttggaaaattttttaaatgtcaaaatgatgagtcatgctaatacattgagggtttgtttttttgtttgtttgtttgtttgtttttgagacagagtttcgctcttgttgcccaggctggagtgcaatggcacgatctcagctcaccgcaacctccacctcccggattccagcgattctcctgcctcagcctacattaagggttttgtcagacaattgtcacacgaagaatagtgtcacttatctactcttgacacacagaactggcctggcatatagctttccagattttactcaaacttggtactccagtttgaaaatttaaattttgactgctgattagctggaaagcctagttttaatggaaagaaagtttgcttttaaaactgaaagtagtttctttttgctaacaaatctaacttcatacataattggccatattagtaaaacacctcatgatagcagtgtatatatagtcttgtttgtagttggaagtcatcttttaggagttattctcaaatatatataatagctacccatgcatcattattaaaatccccaaattcaaaaaacctctgatatatatatataatttttttttttttttttttttggccaactgagattgaaatccaagtgctggtttctagttctgaacatcaactaaagagttttggaaatgacagcaatttataacaagttcatattgacttcctctctatggcaggaagacattctgtgctgttttgaacagattaaagatttgtgtagtttgtgggaaattgacgtttttgtttaaattccacccgcgtttgtcttttcctaccacctgtggccaggtgctcgctggccatcacagttgcgattccatgagtagctgctttatgactgctttttgtactatctggatgtgcccagagttacttctgtacaagctctgtatctatgtccgttgagaacattattttaacaagaagaacaccaacagtagcatgaaatataatactgttttataattctaaagctgctgttaatttatgaagtacataataatctaatgtaaactgcagaagtcagagcaagtgcctacattttgttatttttggcattactacagagccatgtacaatagaaagcaatgcaagacttgtaaactctcaccacttcttgtaatatcaaatgttccccctcaggttattttgcttatggtacccatgagttgcctctctctgtacatagataaattgttccaatattttcctttgatgtttggaactacagatagtcaagggctggaaattttagttttcaatataagcttccagcttagcaattacctctagtcgaagacaatatttgattcctagttctgtttggggcaaattttcatttatctaaataaaatgcaatctaattaaatgccatggattttctttctgtaatttcactgtgattcagtttccattgcttttctcttgtctgttgtgatattcgtcatacatttaagctctgcttttaactacttagcaccctttgttcatagagcatcatgagagtttggaatgaatgtatctaggataggcgtgagtccacaaagatctctattcatgatcataacctttttgggtcctgggctcctttaattagaatctcattaagcttctagctgacctcggactccccaatataaagttttatgtacagtttttggatagtcacacaaaccttctctgaaatgccaaccaataaccagaaccagagttagaacctctttctccaaccctgtaagaaaggaaatggacgcagtccaaggattcccagatagtagcagagctcggaaccggaacacaaaatcagtgtcacataaattcaaatctacatgactatttcttttaaacatttatttgtattttgatttcatattttgtagagatggggtctggctctgtcacacaggccggaaggcagtgatgccatcagagctcagtgtaaccttgaacccctggactcaagggatcctcccatctcctgagtagctgggactacaggcatgtgccaccatgagatggggtcttgccatgttgcccaggctggtctcaaactcctgggctaaaacaattctgtctcggccccccaaagtgtattctatttttttttgttttgaaatcctagtcaagaatagagaattatatacatccatgtttaatagagatggggttttggtatgttgcttgggctggtctcaaaatcctggactcaagcaatccacccacctcagcctcccagagtgctcagataacaggcatgcgccaccacacctggccctattcttttttaaatgaaagtcatacaaattttattaatgtgtacctgggagccttcagaatgaagacccaaaaatgcaggggaaattgtccattttaatataggttcaacaaagtatggacgtggagaaatatgactggacaaaagggatatgatctaatgctaacagactgagtggggaaacacagcaaggcctgtctgtctagattcttcttggtctctctgagcacgcattccttccttccgggcatggggcatggggcaggacgctctctggaatcagagacttgtgacttcagttaaacaacatgaccatttttttctttttctttttctcttttttttttgagacagagtctcactccatcacccaggctagagtgcagtagtgcaattgaggctcactgcaacctccgcctcccaggttcaagcaattctcatgcctcagcctcctgagtagctgggactgtaggtgcccaccactatgcccagctaatttttgcatttttagtagagacggagtttttccatgttagccaagctagtcttgaactggcatcaactgatcacccgccacagcctcccaaagtgctggaattagaggcatgagccactgtgcccggccatgactattcatttctttttttttttttttcaagacggagtcttactctgtcacccaggctggagtgcagtggtgcgatctcggctcactgcaacctccgcctaccgggttcatgccattctcctgcctcagcctcccgagtagctgggactacaggcgcctgccaccatgcctggctaatttttttatttttagtagagacggggtttcaccgtgttagccaggatgatcttgatctcctgaccttgtgatccacccgccttggcctcccagagtgctgggattacaggcgtgagccaccgtgcctggccgactattcatttctaatgagattctggaaatggatctgctggtcacagacaacctggtataactttgatacaaatgcgagcttctcctaacagattgcttattgtctccaacctatataattggaattaggaaaacaagctgagcccttcttttaatatgagaaagctgagactttgaagtgataacacaggttgggctaagctaaccaggatctgaagatagcatggtggtgaaaatcatcatgatttatttatttgagaaagggtctcactctatcacccaggctggagtgcagtcatgcaatcgtggctcactgcagcctcaacctccttggctcaagcaatcctcccacctcagcctctacaacacccacaggtgtgccccaccatgcccagataattttttatattttgtaaagacggggtctccctatgttgcttaggctagtggtctccaactcctggactctagccatcctcctgccttaggctcccaaagtgttgggattacaggtgtgagacatctttactgtagtattctacagttatgagtgaggtcttcttgcaactgtgcatattcttcttctatcacctgtcgacattaaaagttttaacaggagaagggtagtttaacatgtaaccttcaagagaggcttcactgagtataacacctatgtttagagaccagaggtagaataacaatacctaaatgatgaaatgaggacctaagtctaatgtgcccacaaaagaatattgagtactaaagcccagtgcttagtcttaaccctgtgtttttttatttgttttaataatctcaaataactaggtataattaatgaacaaagaggcaatactctaaataaggctaattttaaaaccacattgtgcttgattctacttatccctgtgaccctcaggggcttacctaattcttggaaaagtagatggaattgcctctagaatctgaaatctaaacataactagggtccttcttaaagactatagaaataatactgcagagatggccagggggccatttcaagatatgagatttatcctacaaagtcattgaaatagtttggcagggaaaagatgcaatcctcttaccgtagtgatccgcagtgttgggctagtgaaaggtcccactctccaccctggtttgtgctgccacgtgtctggttaccacaacggctaggatgttacggtatgtaatgagttacggccacagatgtttgacatcctgcatggcacagaaaaaccctgcataagacagatgtttctacctaaaatgtcagtggcatctatcttgcagagaattgaggcctggaggttgagaggaggtcagtttacatgctgttagaataatccaggcaagctgggtgtggtgggatgcagctgtagtcccaggtaggaggctgaggtgggaggatcgcttgagcctaggagttcaagatcagcctaaccaacacagggagactcctgtctcttaaaaaaaaataaaaaatacaattaataaaagtttaaaaaaagagaataatccagacaagaactgataatggcctatattaaagtaggtgcagtttggctggagatccgtgggtgagatcaagagctgttaggaggcagatcgacagggcacggtacctgattatcttctgtgggaactgtggggtgaagaatgaagtttctagattgccaacctggatgtggaggcacatactgacatgagcgtggaggcaatttgagaaacctaagagatatccaagagtcagtggagttggcagctcagtatatgggtctcacaaacaattcgggacagagagacaactcttttgcctcctctgtgtccttagaaacacatagaagacaatctacaagatgcttgcatcgcttcttaatagctcatgtgcaaacttcagcttggtgactgagaaagagttcacctgccctgtctcagccattcctcatttcagaatgtgtaactaaagactgttcttcacaagattttcccattgtgaaagtgctttataaacgaggaagcaaatgtaccgtaaagcattaatatcggtaactgcaagagaaagacagattttgataaaactttcctccagaagcaacttagtgactgctgatgactgctactgtctccctgaatattttggtagattcagaataatgggactgatcttccctaaaatggcgcaagacggccgggcgcggtggctcacgtctgtaatcccagcactttgggaggccaaggtgggtggatcacctgaggtcaggagtttgagaccagcttgaccaacatggagaaaccccatctctactaaaaatacaaaattagccgggcgtgatgacgcacgcctgtaatcccagctcctcgggaagctgaggcaggagaatcgcttgaacccgggaggcggaggtcgcagtgagccgagatcggacctttgcactccagcctgggcaacaagagcgaaactctgtctcaaaacaaacaaacaaacaaacaaacaaaaactgcacaagtctacattgtattcagacatgctcttatttagaagctaaagtctactttgtgtgtgatacacattcctttcctctccctgttgccttttgggcattgttgcctgctagcacatctccagagggagggacggagggacaagtggggaggagggactggagttgcgagagggtcaaacctgcagtctcttcccggtcactcctgtctccccaggttgtgtatgtttcagtatcttggctctctctggctggctgctttcagacctttccttgtgggtatctcttatctaactggaaagagaaaaaaattctttagtccattttcatttgttaaaaaaaaaaaagacagaaaaaaaaatagaaacggcaaaacactaggaagagtttcttacacagtgtgatggtatttttgagacagagtcttgctctgtcacccaggctggagtgcagtggcacaatctcggctcattgcaacatctgcctcccagattcaagcgattcttgtgcttcagcctcctgagtagctgggattaccggcgtgcaccaccatgcccagctaatttttgtatttttagtagagatagggtttcaccatgttagccaggctggtctcaaaaataaaataaaataaaaagttggggcaagatgatcacagcatcttcagagagttcactcatttgattctcacaatcttatgacccaaagcggttttcaacatcttcattttataagcatggaaaatgccactcaggttagagcaattgcccaaagttctgcagacgagaagacacagcaagaaaacgactccttgccaggcgcggtggctcacgcctgtaatcccagcactttgggaggctgaggcaggtggatacctgaggtcagaagttcgagaccagcctgaccaacatggtgaaaccctgtctctactaaaaaatacaaaaattagcctggcatggtggcaggcgcctgtaatcccagctactcaggaggctgaggcaggagaatctcttgaatacgggaggtggaggttgcagtgagcggagatcacgccattgcactccagcctgggcaacagagcaagactccatctcaaaaaaaaaaaaaaaaaaaaaaaaaaagagaaaacgacttctcaagcactgctccactacacatccccttcctgtatctctttgggtagacaaagacgcagagatgacatgacatcatatactcatttaattaaacgtttattcaatgaaaggatgtataaaaacttacaaatttgagaactcaactatacatgaaataggatgatgggatattcagtttttaacatatacatatactatagctattagctattctccccttctccttcagtccttacttctggctcctgttttgtcttgtgaggcccttcttttattggcctaacggaagattaatgaacaatttttactgctttcgggccaatggagaaaatttcaggcattaagaaagaagaaagaaaaaaaaacaaccaaaaacctggagaataaacatcaaaatcaagttttttcccaaacagcaattagattttttgtcctgatttctctttgccatttatttttgatgcttcaattaatgttgccagtaaactatcagcattgactttcagtcattgaagttactacatcttctggtcacaaattcccctgtaagatgagtattcctatatccttttccctgcagtacacacactgatttaaaagttagtgtaaaacaaattatcactggcagctgctagaaaatggcatgtcatgttctattcagaaaggcaatttatagaatagtacattcaaatttgatttttaaaacaaatttgtcagaaactcaaatacagcattttgttgttgctcaacttggaaagaagccagcaatgagataaggatgtgcattaattcacctgtttattagcaagtacccacacatttttctcttacaaacacacaaactcacagcttgtcatgttgtacccaaaaattaagattgccatcacattattactttttctcctttttgttttgttaaagtagatttcttaactgatgatttctcttaagtggacataatctcaaaggatgcattctgaagtaagacacctggaggatgaatactaagaacgttttcttgggtttaaagtttccccacactttctagattttgcatagtacagagcccagccgtatttctaagcagcacgctgttattttctgacattgtttttctgagaagactttttacccagggaaagtcataattttagcttaccaaattggattccagttgttttattatatacccttcattagttccaagtatgcttctgaataatctaaaacctctcaaaatttgagtttataagtataatgaccattatctttccaatatcccctgaaagaaagtcgatacattccaggtttataatgcacaaagcctttacagaggtggggctgggatgtggaaaaggggaagaggagaagagaacaaggacctgtttgtatcatgccatggagaactacagttctgaattcagggaagggagggaagatagtctttgtaaaaatgagagttttttaaaaagataagtgacattcagtctagtaagacggtttcttgttcctttttgatggaagctaacactgggtggtcaggctccgttacttccgagtccccactgcccaggagaatggatcgcccttcgtctagggcaaaaacatccgagttctggttttggcatgaatgtttaacaacctcattgggagtggagaatgttttgtcacacaagttgcatttgtagggtttgtttgtttgcaccagcatgttgtccatctgactcccttcctcaaatgtgcagagttccagagtctgtttgtccaccatggtgtaagtgtcgatgctctggttgaggcacacgtggcgggcagcctggttggccctgcaaaagcttttgtcacaagtgctgcacttgaaaggcttcccggtgtgtatgtacatgtgttccctccagtggcttttctggataaatttgcgtccacatattgtgcactcgtacttccgcctcttcacctccctctcctggtcggcctgctccaggttgtcaatgtcagcaatgtctgaggggggtggggtttccgactgctgctgcccatcgatgatgggagaatcagagatgtgctgcagctcactgtcacttatcatcccggcttcaggcacttccatggcatctttcccgaggtcagctgcattgctacagagagtcagggggacgcgactttctccctgttggctagatgtgaaaggtactcctgtgtggatctggaggtgttcacgtaagctgctccggagagtgaagcgccgtccacacaggtggcaggcatagtactttggaaagctcccattcctcttcatgatgcttggcttgacgtgggctattgtgagggacgcaggctgctcatcggaggaagatgcttccagattggtctcctccccgggaggagggggaggaacaggagtggaaacaagttctggagacagcgaggtctgcagggggtctgagggagtcatatttgtccgattcacctgggccagatttgaagtcagctgggagagctgtgaggcctcagggacctgctcctggcttatcctggaggtctgtggccgtggatctcgcccgagtttttcaggtgctgaagcaatcttggtggcttgtctcaactgatgatctgcaatctgaatgccatacaatgaagaagccagtgggaaaacttggtcagggtgagaaaaggctccctggctggcgaggctggcttcctgaatgagcgggtaggcgtgcagaaacttgatgccctgttctaatcgaaccgggtcgatgagctgaggcgccatcttcccagtgtacatcaagtgtaagagatagctgaagatgtcgggctgtatgtcagttggtttcaagcggacacactcactgaaagaaacaagtaaaaaaatacgtgagtaaatgccagtctaggtgttaacataaagcctgaagaaaaaaatgaatgcttaaaaacaaaggaaacaacatttcctatccttgatttttagtaagtttcatgaaaatgggatgaaataatcaagagacgaagttcacgttaaagaaatgtgatatcttaatccacagattcttagagcagtttttctcctagtaagttaatttttttttttttttgaggcggagtctcactctgtcacccaggctggaatgcaatggcacaatctcggctcactgcaagctccgcctcccaggttcaagtgattctcctgcctcagcctcccgagtagctgggattacaggcgctcactaccacgcccagttaatttttgtatttttaatagagacggggattcaccatgttggccagggtggtctccaattcctgacctcaagtgatcagccctccttggcctcccaaagtgctgggattataggcgtgagccaccacgcctggccaagttaaattaaatattatgtattctatttttatacagaactccaggagttccttatcaaatgccaccatcaacatcagcactgctcctgggctttacagggatgccttctcacttgattgtcattcattctcattttacaggaaaggattgaggattagagggttaataacctgctcaatatcatgtagttggtaagaggtggagctggtatttgaaacaatgtttgtctaagtccaaagccaccacagcaagatcctttagagaatcaaaacaatcctgtatggtagataaagtggatttatttagtccgatttgacagatatggaaactgaggtcccaaaaagttaagtgatttatctaaggcacctaaagccgttgaagatgctattaattttataactttagattctactccttttatcatttcagaaacatcattcctgatcaagcagtaataatgaagaggttcccaagaactcttcccagaccatcggtagtaacaaattctaaagcatcattagaaattagtgagatctatatccacatatcacaaggtatatattatattccactgagtggatattctatagacaatgcatttcaaattcaaagacagcttccttgaatgcttttagaatttataattttcttttattatactttttgtattgtaatcttctttggcccttttagcaatcatgttcatttgattaacaaatattttcttttcttttctttttttgagacggagtcttgctctgtcacccaggctggactgcagtggtgcgatctcggctcactgcaagctccgcctcccgggttcacaccattctcctgcctcagcctccagagtagctgggactacaggtgtccgccaccacacccggctaatttctttttgtatttttagtagagacggggtttcaccatgttagccaggatggtcttgatctgctgaactcgtgatctgcccgcctcggcctcccaaagtgctgggattacaggtgtgagccaccgcgcctggcaactttgttgttttttgttttgttttgagacagagtctcactctgtcaccaggctggagtgcagtggcacaatctcagctcactgcaccctccatcccctcgtccaagtgattctccttcctcagcctcccgagtagctgggattacaggcgtgtgccaccagtcccggctagtttttgtgtatttagtagggatggggttttgccatgttggccaggctggtctcgaactcctgacctcaggtgatctgcccacctcggcctcccaaagtgatgggattacaggcgtgagctactgcgcctggtcatttttctttctttttttttttaattttgagacgaagtcttgctctgctgcccaggctggagtgcagtggcatgattttggctcactgcaatctccgcctcccaggttcaagtgattcttctgcttcgcctcccaagttgggattacaggtgcccgccaccaggcccagctaatttttgtattttttttagtagagacaggatttcactgtgttggccaggctggtcttgaactcctgacctcaagtgatctgcccatctcggcctcccaaagtgctaggattacaggcatgaaccaccgcgcctggctgactttggtgtaaattttgtaattcttttctcattcattgttggataggctgtcttatctatcacttatgaatggtgactcaacggtaagcctctcaaatttgaaagaactatgtacagtctcagatggcaaaaaagggacacagctggggacaccttggcccacactttaggcaggcctggagggaggactccaaggggccagggaaaagaaagcggcgagtccctggggtttacagccagggatgcgagggcccaaggaggtctccaaacaccaatttattttgattaaaaacaattttttttgagagagggggtcttgctctgtaggcccaggctggagtgcagtggcatgatcatagctgactgcagcctcagcctcctgagtagctcagactataggcacatgccactacacccagctaatttttaaacttttatagagacagggcctcaccatcttgcccaggttggtcttgaactcctgggctcaagaaatcctcctgcctcagccttgggattacagcattgggattacaggcgtgaaccactgcacgcagccttaaaaaaaaatttttttttttaaagcagaagcacatgtgcacacatacacttaaaaaacaggtggaggctgggcgcagtggctaatgcctataatcccagcactttgggaggccgaggtgggtggatcacctggggtcaggtgttcaagaccagcctggccaacatggcaaaaccctgtctctattaaaaatacaaaaattagccgggcgtggtggtgcgcagctgtaaccccagctactgggatcgcactccagcctgggcgacaagagcgagactccatctcaaaacaaacaaacaaacaaacaaaaaacaggtagaatttttcaaagttccttaatgtacatttcagccatctccatccctgactgcttttatttccaggcagcttgacctctgtcaatcactcagctcactatgcgccagactttggtcttttcccagtcctgtggaaaggacatagttctctacaatatacttacatctaagtagtttccagatatgtttgacataacatttttttttgttttgaaatggagtttcactcttgttgcccaggctggagtgcagtgacacgatctcggcttactgcaacctccgcctcccgggttcaagcaattctcctgcctcagtctcccgagtagctgggattacaggtgcacgccacgatgcccggctaatttttctatttttagtagagatggggtttcaccatgttggccaggctggttgacatactttcatgtaggaaaaagatgaatatagttttactacagctataagccctttcgtataaacttccatagtaatttccgttttcaattattccttcactagaattttaaaagaaatgataggcttaaacaactttaaaagtaaggatttttgaataacattagcattgtcagaaggttgtacttagaaaggcctctccctcagtggttttatttttgatagctgaaagtctgtagttgtctgtgatttaaacataccactcggagtagtagacataagacagggacatctagtggtaactacagccagaaatctcccttggagccaaacttgaaaaaactgaccgtattctcagtctatgtctgagtagccaggcagcagtgtgtcatgccccacagaggaggtgctggttgaaaagtacgcccctggccttcaccctgagtttgccttgcctcgaggagcttgaattctgcactaggaggcaggcaaagctggccactaggcatgtgtcacctctggtgcagtaatacacctgttgctttacactgttgtattacacaaatatcacacctccttgttagaaaggcatttatttactgccctatacttaaaggtgggtttcttgcatcgaattaaaactcattacgtagtatttttgcactcctcaagattaaaattgcctccttttcaataccattgaattcactgtgttgagactgcccagtacaaaacccctactaggccttaagtctctgacacactggagttaaagggagcatccttagtattgccagaggagccaaccctcctgggttattctgcagttgtcccatctgctcctccagacattgatcaagtggctattctattgtgtgcaaatacttcagtcatactgggtggtggcggcaaagatttgtaaaacccagtccctgccctcaagaaacttacaagtgaagaagggggtaggtacacacataacaacataggggaaaggtgcacatttgcactcttgtacacatatgcactcttataaaggagcacaattaaagtgttatgagccataagcgaggacgtggtcactgtcgtttgttttgtttcacttgactgggaggggtcctgcatgagctgggactcagggagtgggcaggataccagcaaaatgcggtccaggtgagctgaagccatgaaagcagatctggttaaggtgaagatgaggggtggtgtgtcccagagggcccagtcgcagatgagactagaaggaggttgggctccaagcctgtggggccttggatgacagaataaggagcctgtgtgttattttaatatgcactgggcatccccggggtttctgatccaacgaataacccagtatagtaggtttctcatcaaacactacagtcaaagcagtgtttggaaatacgaatccaatagtaatgtggagaatgggtgatgaggtaatggaagtgagaaaggaaaagaagtgacaaatgtgaaaggtaatttgaagaaaacatgatttggggactgagttaagcttgggatacttgaagataagaaaataggcaggaggaacttcggagaaggcctaattcagtacatcctcaaagacacaaaaggagatactcaactctaaatgcccagcacacagcctgaggccttgggaatagagttctggagacagaacagtcaaggccagagttataaactgaagtttccagcagaggcgagatctaggaaaaagacacacacccataggaagggtgcaaaagacaaaatttaccaaaggcccaggtttagagggcagaaaaacaagagatattcagctataaaaatgcagatgacaaccacttaagaaggaagcaaacaacagcagatgctggaggacaggatgctagaaggctgagagaagggcagtggttttgatgaggggtgacctttgagaaaagactgcagcagaatgaaggaggggaggaaaccacagcgcgcactgataggaagagtgtgggatgaggagagtgcaggcgaggacctcgattacccttttaagggctttcatagtaaagtgaaggagaagcagcaccgtaactcaggcagacagcagtgtccaggatgtgctgatcccacatgggctgggggcagggtggggggtgtatgaaaacagataaaaagaacagaataaaaatagaggagtgggaactcccagcatgagggaagaagggagatcattttccagagacactgagatgcccttttctcaagacaggagagatgagaagaaagaaactgagcaaagatagagctgttttaagatagaaaagagggaaactggagaaattcatgccctcgagcttcttgttagaggaggagacaagaataaatgctgaaagtcagggggatactcaggggactggggctggaggaatgagagatagggcttagataatgagtccaggaaagattactgctggaagggttcgctgaggttgggtggctggctttataatggacctgatcttgccgggtgtggtggctcacgcctgtaatcccagcactttgggaggccgaggcgggcagatcacgaggtcaggagatcgagaccgtcctggctaacacagtgaaaccccgtctctactaaaaatacaaaaatattagccgggcgtggcggcgggtgcctgtagtcccagctactcgggaggctgaagcaggagaatggcgtgaacccgggaggcggagcttgcagtgagccgagattgcaccactgcactccagcctaggcgacagagagagactccgtctcaaaaaaaaaaaaaaaaaaaaaaaaaaaaaaaaaaaaatggacctgattttgcagatcctgaccatgcaggtgacacccagcgagggcatctggaggtggaagggctgcatagagctggcaggtccagtgattctcaagtgctactgaaagcacctgtaacaagaagggtagtgggggcgagtgaggccacaagggagcaggtcacctaggagctaggagacgtagagagacccatggtcttgatgagggccagggacatggaggttaagaagtctacagtcattaggttattagcaaccactttagttacctggtctgatggacaaacaacatcttaaagtaattggagaatgaagcaagaactgatttgtgtgccttgaagtatacatcgccgattgcaaccgtgcagtcacacaggaaaccaaactctcgctgagcgtttaactgttgcagtagaataagtccatggttggccaaatccattttttaaaaaatctgcaaagcaaacaattttatttttaagaaggtgattcacaaataagaatgtgtcctttatagtcaccaacagtcatgatcatagctaacatgtcatcatagctaacgtgtcaggcactgctaaaaacgttacacagattaactcatttagtcttcctaacagtcctctgaagtagttatgtcattatgcctttaaaaaaaaaaaaaaaaaaaaaaaaaaaaaaaaaaccagatgatgccatttaaagtaaattagggagttatgtgatttgcccaagctcacacagatggtaatggagaagccaggaaatgaactcaggtggtctgcctttaagcatcacgtcctggagacagacagcaaatatcttggaccatcgagtcttttagtttaaaattccaaatgcaaatggagtcttttagtttaagattccaaatggaaattctaatgatgcatcagagtttgtcaattcttccacagagatagataaattaaggtgttggggcggggtcccagcagggcagggtgagaatcaataagtctgagggccaatagtccagctcctgctgtgtgctcctgctggtgatgtaacagccccatcacccctgacccttaacacttacggaggaagtggggttggagctctgcttccttccttgtggagggaggaaaccggtcttgagaagtataagtaatttgccccaggccttctagccaaaaggtgggagggtcaaaatttaaatgtgaatgtactgattccaaattctatgattttcattattcacacttgaccctggcaaaccccgctggcctgagtctatttataatagagaggctgcctgacattgcctggttcatcaaatcactagtctgctccttttccacaaagagcatttataaaagcccattacacacagaccaacattatatttaacattatacttaatggtaagaaagggtgaatgccttctccataagattgggaacaaggcaaagatgtcccctctcgatattcaacacagcactggaagttctagctcacgcaacaaagcaagacaggaaataaaaagcatatagaagaaaaagaaaaaaataaaattgtcactatttgcagatgacacgattgtaacacagaaagtcccaaggcatctattaaaaaaaaaaaaaaaaaggccagacatgttggctcacgcctgtaatcccagcactttcggaggtgggcggatcacgaggtcaggagatcaagaccatcctggccaacatggtgaaaccccgtctctactaaaaaaaaaaaaaaaaaaaaaaaacaacaaaaacaaaaaattagctgggcgtggtggcaggcgcctgtagtcccagctactccggaggctgaggcaggagaatggcatgaacccaggaggcggagcttgcggtgagccgagctcacaccactgcactccagcctgggtgacacagcgagactccatctcaaaaaaacaaaacaaaacaaaacaaaaaagaccttgtagaactaataaacgagtttggcaagtcataaacatacaaaaaaaaatcagctgtaattctatatgctagcaatgaacatgtggactgaattaaaaagataataccatttaaaatcactcaaaaaatgaaatacatgggtgtaaatctaacaaaacatgtgcaggacttgcatgttgaaaactataaaacactggtgaaagaaataaaggatctaaataaacaaacagatatactatgattatggacaggaagactcaacatggtaaagataccaattttcccaaactgacatataggtttgatgccattcctataaaaatcccagcaacatttttttgtagatatagacaaaattattctaaaatgtacatgtaaaggcaaaggaactagaatagctaaaattatatatgtatatatttagacaaagttctcactcttgttgcaggtagcagtgcagtggcacaatctcagctcactgcaacctccatctcctgggttcaagcaattctcctgcctcagcctccctggggtagctgggattacaggcacaggcacgcaccaccaaacctggctaagttttttttgtatttttagtagagatggggtttcaccatgttggctatgctggcctcgaactcctgacctcagatgatccacccgcctcggcctcccaaagtgctgggattacaggtgtgagccaacacgcctggcctaaaataatttttaaaaaagaaccataaagtgggagaaaccagtctacccaatttcaagatgtagtacattgctatagtattcaagactgtgtggtattggcagagggacagagaagtgaattaatagaacaaaactgtgaacccagaagtagacacacataaatatgcacaactgattactgacaaaggcacaaaagcaattcagtggaggaagaataagcttttcaacaaatggtgcacgatctactggacttccacaggcaaaaaagaaaaaagacaaagaactttgacacttaagtctcatactttatataaaaatcaactcaaaatggataacaaacttaaatgtaaaacacaaaactataaaacttttgggaaaaaaagtaagaaaatctaaaatctagggctagtcaaagagtttttacacttgacatcaaaagcagaatccataatgagaacttgataaactggacttcatcaaaattaaaaacttttgctctccgaaagacctcattgagaggatgaaaacacaagctcaaagactaggagtcaatatttgaaaacttttgcaaactagtcctttgacaaaggattagtaactggaatatataaagaactttcaaaactcaacagtaaaaaaaaatcaaatcagaaaatatgtaatagacttgaagagacatttcaccaaagaggatatacagatgacaaggcaaataaaacacatgaaaagatgttcgaaaccactagccactagggaaaagcaaattaaaaccacagtatcactgtgcacctattagaatggctaaaataagaaacagtcacaacacatggtggcaagagtgtggagaagctggatcattcatacactgctggtaggaatgtaaaatggtacagccactctggaaaagagttagcagtttcttaaaaaactaaaaatgcaactaccacatgacccagcaactgcactcctggacgtttatcccagaggaatgaaaacttatgttcacacaaaaacctgtacaggaatgtccatagcagcttaattcctaataatcaaaaactggaaacaactcagatgtccttcaatgactaaataaacacactatggtatgcccacacagaggaaaactactcagccataagaagaaacgacctactgataacgtacaacaacttgggtgaattacactcagtgaaaaaagccaatcccaaaatatcatatactgtatgataacactgatataatatgtgtgaaaattatggaaagggagaacagattagtggtggggggggtgtggggtagtgggtgggcatggctatggaagggcaacatgagggatccttgtggtgatgggaatgttctgcatgtcaaaatcccagctgtgatactgtactatagtttgcaagatgtttccattaggggaaactgggtaaagggtatatgggatctctatttcttgcagccgcatgactctgtaatgctctcaaaataaagttcaattttttttttttttttgagacagagtttcgctcttgttgcccaggctggagtgcaatggcaccatcttaactcactgcaacctctgcctcccgggttcaagctattctcctgcctcagcctcctgagtagctgggattacaggtgcccgcgaccatgtctggctaatttttttttttttttttttttttgagatcgagtctcgctctgttgcccaggctggagtgcagtggtgtgatctcggcacactgacacctccgttgctgggttcaagcgattctcccgcctcagcctcccgagtagttgggactacaagcgcccaccaccatgcccagcttattttttagtagagatggggtttcaccatgttgttagccaggacagtcttgatctcctgaccttgtgatccgcccaccttggcctcccaaagtgctgggattacggacgtgagccaccgtgcccgggcaagttaaatttttaaaagcctactacacattaattgactaaatttttaaaaagtgagtatgctaaacttcagagttaagaatgcactgtagataatgcactatcaataagctttaaaaaaaatcaaagtagactcagcaatttttaaaattatttatttatttatttttagactagtcaagtgcagtagtaagggggaataaagtagaacaaggcatttgatctgtaaccaaacaatcgcaataactcactatcttcgcaccagccatccacagcaattcttaatcagcaggtgctggactccctactctcccttcctgctctagggatgttcaggcagattcagaaattaacaaatataccctaaaatagacaaatgtaatggaataatactttaagagactgatcaggtcacaaatcaagaatccagaatgtcaaatttcatattttctgccacgagtcatatctaagcacgagataggagagtcatccaattttgcacatcatttgggtataaagacctagactgttgtctcatgcaaacagatggtatggatcagtttccccactactttctgtgtatgccagagaaggtgaaagcactcaggttaggaaggagaggcacagaaaaggcatggggttcatgatgaaagccagagaactgctgggttgcaaaagtaacctggattacagagaaacatcactctaacctgacctccaccaaggcataacttagaagcttgtcttcaaggttattctccgtaaagtgccagaatacttccttttgcatcttactaacctgcttttctcattaaaaaagtatcctctgagacccaactgtgatatgctccctgccatgtcctctgactctgatcatgctgatcatatttaggcagcttgaggtcccacagcttcaggtgtcacgctcatcaacagtagcttcaagtacaggaaaacattactatttatcccttgatgataatgataagaattgtttcttatggagtgctactattggccatcatttacatatgctattaatttaatttcacatcaacttgagatatttgaagtattgctgcccacatttataaacgaggaaatagggttagagagggtaggtggcttgcccaagcttatagaaccagtacattcaataagtaggctttaaactgggattcacttggttagttggaatgtgctacatgacagtgtgtttgttttaaattaatattattatttgctgctgcttttaagtacatatacttattataaaagattcaaatattatggacacacaaaatgtgagatttttctatccacctctaccgtaactcttttctccgtactctagttaatacttggtattctttgccaatatggcttttttactttgtatgcctttaataatgaagtaaagcttatttttacatttattgaccatttgtatttcctttagtatcttttcatgagctctgcccattttcctattcgattgtctttttcttaccaatttaataaaaccaggccaggtgtggtggcttatgcctctaatcctagcacttggggaggccaaggtgggaggactgcttaagctcaggagttcaagaccagcctgggcaacatggagagacccccatctctataaaaaatttaaaaaatagccagggatggtggcacacacctgtggtcccagctactctggaagctgaagtgggaggatcacttgagcccagagggttgaggctgcagtgagccatgttagcgtgcactctagcctgggaaacagagtgagaccctgtctgaaaaaaaaaaaaaaaaaaaaaaagaaaaaaagaaatctataaaactctttgtatataaggaaaataggccctgtgtcacatatgttctaataattttctcactttctttgcatttgtttatagagattttgacaaacacaattttatgttttaatgccatcaaatttgtcaatattttataggaggattttgaggttttggtttttacatgaatgggtgtatattatttccttcaatatagcaaactatatggctccctctctttccacaaacggactaacataagcattctattcagaccataagaatgaagtcatgatagaaacgctcaatattttttaagggagtctaccagttattttagaatctcaatttaggaatttaagagagtctactagttattttagaatgtcaatttaggaacatcccctagatcaggaaacacactgaacataagcattcaaatacagaggaaagaatacatgcgcatgaccagagaaatgaaaaaaaaaaatgaaaaagcagaaaaacagaacaagtcgcatgttcaaaattcacgagggggaaaattcacacagatcaacttgaaaaaaatcttcttttggagaccaaaaaacctttctcaaaaagaaaaccaaaaccaaaacccctagactgttccatatgtgaactgcctgaggaaatggggcaaaagggtggagaaggtactatgggctccaccctggcccctgcccagtgacagtactgacttctcttaaatctttctttcctcttttctcatcacggcttcccttcatactcatttccatgaggcttaactggcccaaaatacgccagctagggccctggcatcctcgtggatggcttggctgaggccgcccctcttttgtgggaatggctgtctgctcttcccacctccaggccagctcccgcccggctctgctcaccaagatcaccaaggaccttgttccccagcctcagggactcagtggcttactcagcctcttggcggcattttgtactcttcctcccgctctgataaatctttggtctctggttttcaggctgcagctctctggttttcgactcaccacaggctgttctattttaatccccatccaggggttccacttgctggtctcctctgcgcctggtccccagcctactcctcattctgtagcctctttggtgatctctttcacttctccttggctgtcccccaggaaccttaaacttgatttaggtaaaactcaactcaatacctccctgtcctctcactgccatttaccccaaaggacaataaaaaccaggtacacaaatctgctccctctttatttcctggctcagtgcagggccctgcttccaccctctggccaaaccagaaatctcaattcatcctcagggctccattctcttactcctcacatcagcccccaattgccattaattgaaactttaccctcctgccacacctttagcctcacctcccaactcatctctccatctccagttttggcctccttcatgcatccaccacacaacagccagaatgaccttgcgaaagggcaaacctgatgtcacctgcttaaaatcctcctgtgggccgggcacagtggctcacgcctgtaatcccagcactttgggaggctgaggcgggcagatcacctgacgtcaggagtttgaggccagcctggccaacatggtgaaaccccgtctctactaaaaatacaaaaattagcctggcatggtggcgagtgcctgtaatcccagctactcaagaggctgaggcagaagaatcacttaaacttgggaagtggaggttgcagtgagccaagatcatgccactgcactctagcctgggtgacacagagagactccatctaaaaaaaataaaaaataaaaataaaaataaaaataaaataaataaataaaatccttctgtggttccttactgccactaggataaaatcccagtgccgctgcacctcttccagggtcctgcaccatctaatagttgcttactctgcatcccatactctggtgctaacctaaactaatgctttccaggctttctgatttcacagacgtactaaaaacaacaaacctctaaactagggtccaacagagtgttgctccctctttattttgccagcaaagacacaaaacattcacaaacctggtaggctcttacacataaatacacagaaatgacacagtatcagtattatcctcccagaggaagggcaggtggcactatattcaatgcagtcataccttgcttaacaacagagatacgttctgagaaatgcatcgtcaggcaattttgtcattgtgcgaacatcctaaaggtacttccacaaatctagttggtatagcctactacacaggcctaggctatatggtaatctactgctcctaggctacaaacctggacagcatgttactgtactgtaggcaattataatccaatggtaagtatttgtgtatctaaacagctaaacacaaaaaacttacgtaaaaatatggtattataatcttatgggaccattgttgtacatgtggtctttcattcactgaaatcttattatgggtacatgactatgtatgaaaaaatacttttctttttccttttttttagatggagtttcgctcttgttgcccaggctggaatgcaatggtgcaatctcagctcaccacaacctccgcctcccgggttcaagcaattctcctgcctcagcctctagagtagctgggattacaggaatgtgccaccacccctggctaattttgtatttttagtagagagggggtttctccatgttggtcaggctggtttcgaactcccgacctcagatgatccacccgcctcggcctcccaaagtgctgggattacaggcatgagccactgcgcctggtctttttttttttttgagacagagtttcgctcttgttgcccaggctggagtgaaatggcgcgcaatcttggctcactgcatcctccacctacccgcttcccccagcgattctcctgcctcagctttccgggtagctgggattacaggcgcctgccaccatgcccagctaatttttgtacttttagtagagacgggattttaccatgttggccaggttggtctcgaattcctgacctcaggtgatccacccgctcggcctcccaaagtgctgggactatgggcgtgagccactggaccttgccctgaaaaaatatttttctaatgcaaacaaattacaacataaaatgttactttaatacattaagttgtatctaatttttttttttttttttagattgagtctcactctgttgctctggctggagtgcagtggtgtgatctcagctcacttcaacctctgcctcctgggttcaagcaattctctgcctcagtctctcaagtagttgggattataggcacccaccacacctggctaatttttgtatttttagtagagacggggtttcaccatgttggccaggctggtcttgaactcctgacttcgtgatccacccgcctcggcctcccaaagtgctgggattacatgcgtgagccaccgcaccaggcctgtatctaattttttatatggggtcttgctatgttgcccaggctggtcttgaactcctgggttcaagtgatcctcctgcctcagcctcctgagtagctgggactagaagtgcatgccaccttgcccagctaattatatgcaattgtcagtttggtgagctctacgaatggatcatcaagggtccagcttgttttgaaatacaaggattattaaaaattcagttttatttgaatatattgataatggagacaaaatgatgttatttcactcactttgggacttctggataagctaagctaagccaaggaatggcagtttcgtctcccagaaggtcctgaacaccctggtgatgatttggctcctgacagcgtacaatacttactgctcaaaggcttcactctcgaggctgggcagcttggcagcctgaactctaaagggttaggggagaggggtcccatctgcacacaggcttagaacctctgctccaggattttgaatatgctgctttcagaggaactgaccatgagacagacagacagacaggcagacacacacacacacatacccctgcccctgcccctgcccctcataatctccttgccctggtgcatgtgtgaacgagccagtttatacaccttgcctgatgcttctggaaagctggcaacaaatcttcctcatcatttactattttatcccagtgccttgtatatggcctagggtttagtatttgttaagtaaattaataagcagatgctccgggagaagaagagtgctgagttccagtcaaggctcagcctcttaccagctgggtgactgagggtagaagttgagtttctagttatcctagattgacctaaaaaattctcatcaatttaacacctgctgttttggaataatttttccatttaaaaatactaccttgtgtttcttcatgctaataattaatttctgaatagtgctttataattcacaataacccggaagggtagagagccagagaataacgaggatggagacagacgtcatgttaaggattttggtccatatcttaaaagcaatgggaagccacccaagaggattttaagcaggatgacttgataagatctctacaatgtagagactgcggaactaatcaagctggggaggagggggtaacaagcgggcaagtgaagacctgctggaaagtggtctagaggagacaactgctagtggtctacaaaagagatgatggacccaggtggtactgagaaagatggaggaaattgacaggattcaaaagatatttagaaggtaaaaaatcaacagacctggttgagtcagatgaaggagaatggagcagatcaaagtgtccaagatgacttcctagacttcttatttgtataaccgcatagatcttggtgccctccaacaggagggaacacagggcaaataataatttggcgggaagagcaagaggttaggttcacacatgttgggtttgagatacttttgagataaccaagtggagatgcagagtatatgttggttacactggtctggagcttggaagtcctgactgtgaattgtctgcgtcttcagaaaaaccatgtccttaaatcactacactgtagttgagagaggttaaaattatcaacaaataagagtcaggattgaactctggtcttctgggcatacagttcatgttgtctccactctactaccttgccctacagagcattcctaaaagttcttactgatcgcagtcacaaagggccgacaatcaagacatgaaactgaagacctatgtaaaatccctaaccatttaacactgtatatgaacttaaaaaaaacccaactaaataaaaaacaagtcatttgtcttttctaaattagaatagtgagctgagaggaactgaagaaaagtagcacaggagagaggaggcagtgcctataaatgggttttcatggaatgccttctttctgtatatgtatgtgtacaaagcttttacttttcttaagtaaattcagagactataagacatactcatgttgaaaaaataaaaaacacttcctagagccaaatacaaatgacctttcagattatttaatgctttggttttcattgccactgtttcctccttgataacaggacattgaccacctagctgtcacttgctttcagttttcatcacagagcacatgtgggctgatccgtaagcaactcactcatccttttagaagtgcagaagaatggggcacatacaattatgttgtattttgacaacctaagttcctccttcattttcagtgtaagaataggagatcaaaacagcttgtggaaattgttgattcagtttttaaagataatagctgttctaagacactaaacaccacttacactacccatttcaagggcactaaaagggtcctctgaagtccttgattttatttaagtgaagcataaatgaatattgtaattcaaaggacaatcagtaacagcagaggcattacccacaagtaagattgattctttcaagtagtttagaccacttactaggatgaaaagctgatttttcaattactattattaataattaatattggagggcccatgaagtaaacctgaaggctggtcatttgaattttaatacattttaaaactgtattttgaaggtagaaaatgcatcttatttagttgtgataatggagtggcatttttttcttaacatttccttagtcaaccttcttccatagtaattagaaaagagagaggcataaacagcacttattttcatattaaaaagcactgcatttgtaaaatactcctgttttcaattatattttccctatgtttacacttaaattagtttttagtttccaaatgtaagttggggtcataaggaggcaattcagggacatcttaggtgtcaaacagaagtagatcagagatttatggctaataacgagttcatattaaagtaataattctaaaggcattatgctacaatcaacctgaaggaaacttacagatgattacacacggcaaaattaaaaaattaatctgggcttgggacagtggctcacccctgtaatctcagcactttgggaggccaaggcgggcagatcacttgagccccggagaccagcctgcgcaacatgacgagaccctgtctctataaaaagaaaattagctgaatgtggtggcatgtgcccatggtcccagctaccagaaggctgaggtgggaggattgcttgagccagggaggctgaggctgctgtgagccatggtcatgccactgcactctagcctgcatgaaagagtgagaccctgtctcaaaacaacaacaacaaaaaactgatctgcttctaataatccaccagagtggagattgcctttgttttttatataccataaaatgattagtaaaattaatctgaagaaaatataatcacctaaatgtgtagttcagggtatataacacaggtgagtttcaaatgtgtttaactcaaagtcttaataatatgtttcaatattttagagcagagcttctgaaactttttggtgttgggatcccttaatggtcttaaaaattattaagaacatcaattatatgtttatatggattttaactactgataattaccaaaatggagaaattttagaaatatttaattcaattaaaaacaataaggccattacatgttaaagtacagaacatttttatgaaaaaataattgtattttctaaaataacaaagtggtgtctttttatatttttgcaattctctttaacagaagacaactggattttgcatttactcctcaattaactctgttttggttgagtagtgaagaaaatccagcctcacccacctatgtagttggaaaaaggagatatatttgaatagccttttcaggtaattgtggacagtcctcttttatattataccaacacttgacaagtctactttcttaaaagttggttgtgtaatataaaactacataactgaattaacttttcctactctattatagtaatattcattggtctatccactttcaacggatcatttacccactcatgatttttaacatcatctgttggtcatttggaaaatatcggctcactgaattaagcagatcttctcagtgtcaacactgagaagacattttgtcaacacagcggaaaaggccataacaacttagtattactgtgacaacagttttgacttcattgaatcctgaaaggatcctggggcttcaaaaggatctgcagaccacacttagacaagcgccgttcagaatcactttggggactcagagaacctaaatgactctcccggtgcaggagaacatgcgcacttcattccagaggattctgacgcttaccctgcttggtgcagaacttagcgagtgccccctgtttaagagaacagtacactaaaatctctaacaaaagtaaaaaagtagtttccctaagtacttagccagatacataaaagtatttttcaaattcctatctttgaatactgaactttcttaaagtgacactcaaaggcatgtgatgcatacctcaagcatgtgaactgggggttatgagtttgagcataaatatgagcctccaagttggcttctaaaatggatctacatatgttgggctgccaactccttgtaagggttctgtggctactgattccatatcttaatggctctatcggcattgtaaaaatactgaatcttatttactatcaattcgaagtaatattttaattatttaatagtttaatttgctagcacaaattataacctacttgagcataaagaacgttttagaaatattcttagtctaatgcttagaatgtttacattttttttttttcttcagggaaataaaaatgttcagttcccttttaggttttcagtcatgtttggagagccaaagagcataagaaaataggaaaagtgatgataaatgacctttcccaggtgcatttggtattttatggtaaaaaaattaccagcaaaccagttctttcaatcttcctctcctgtgcaggctggtgccacgggacttgcccagcttttccaagttcctacagggaaaggtgagtggggctaggaatgaagcaccaagaaacagtaagagctggaagggcagttcccacctctaaagctgctgatcccaggccgatgctacagatgagctttagatatttccttctctattttgtaagtctcaaattggggaaagcacatccacttactcatgggcatgctgtgggtacttgaaatcacaggattgcaaagtatatctatggggttggggtgaatacattttcttttcttttttaatagagatgtgggatctatgttacccaggttggttttgaactcttggcttcaagcaatcctccagccttggcctcccaaagtgctgggattataggcgtgagccactttccctggccatgaacacatttttctattattttatattatcttataaaagtgcagattttggaggttactgaaaagttgatattaaagtttaagatataaaagcaggtgtcaccgtggcagcttttattctataacttaaaacatgattagcgtttattctctgctgctagtggtagagattgctcagcatcaacgtatttacatcccctttgaagagaagctttaaaactggcaagtatgcactgggactgtaggacaaagttttaggggcgtagactacactccactgtagtgtagactgctcctccactgttgaccatcagtggcaccggcgtatcacttcttgtacttacgatggcttcaataactggacaattctttgtctagcaaacaaaccacaagtttattaaatgagaaatgcccagtttaaaaggatgtcctattagtggtaaattactatgcctttaaaaactgccttcttgtccaggagcggtggctcacccctgtaatcccagcactttgggaggccaaggcgggaggatcacttgagcccagaagttcaagaccgtctcgggcaacatagcgagatccctgcctcttactaaaaggaaaaaagaaaaaagaaaaaaatgaccttttaacagtttgaaaacatcctggatacacaacaagatcattcaaaatgcagtggaatttaccttaccaatttataattttggtttgtgataaatcagtcaaatgagaattaaaatggcacagtcccaattctctattaaacgttcagggtactcccacactaaaacgctagtggtgtgtacaactcgccctggtgctccaacggggttggcatagatggatgatttacattagcaaggacagggcagcgcgtttaagcaaacccagagaccccctggagttctgataattctgaccttctttatgctttattttactaaaacaataccctgataaaatgaatagaatcaaggctcacaaactcagtggacccattgtatgatgaaagagctaatgaacaatgcagctgggggaggcggggagcgagagccgggttatatccccaaggcataattaggagttcacgtattcgggtggaagttcctgcagtaaaaggcgtagctgcagcttctcccggcccaggcactcgcctgctctgctaccctcgcttctttattgcctcttttactaccagctaaaagcggcaaaacccagcttcctttgcagcttctggctaaaaagttctctcttgcggctttgtttaaacaagaagggtttagaggtttcgctacaccgagaaaacgacgccggccccgggaagcagcctccccgccttggagtccggttggggcgtgagggccgcgcgggtcccacgccccaaggctaagcagccgaaagcacagcgcgctcggggccaaaccgggctgtatcgcaggcgcagatggcgcgtcgggcggaagctggaggccgccggctcaacacgctccgtacccgggactggggcccggcctgcagcctcagcgagcaggcgacaagggcggcgccacagaggccgacgcgtcccccgcccgcctgagcgcgccgcaacagccacctcgtcccacccgccccggggcggggccgggggcgcggcgccggggccctctggccccctccggtctcgccggccccgccccctccctgtccccgtccccgaggggctgagggggagggaggggcgacgcactccggccgcgttgcacgctcgccgcttccctcagtcccgcgtgcgcgcgcgcgctcgccccaagtcccgcggagtttaacacaatgccgacgcctacgccgtgcgcaacgccccggccggcgcaacagccccggcgccgggggcgggggtggcccagacagggagagagggagagggatgagcgcgcgcgagagccggagacagcgcgagacccgaggaggccggaagcgcgcgtgcgcgcccccgcccgcgagcgggaggcggagccgcagcagtagcggcagcagctgtaggagccgctgcagctgggagaagcgccagagaggccgggcctgctccggtcggaccggatccctcccctccccctccctcctccctcccctcccccaaacccacttccgcagctcgcggccttgccgccgaagcagcagcggcggcagcagcaggaggcggcggcgaggcgtcggaaggattacgcacctgacgggcccgcctctgagggctccagcgcgggacgctcaccggccgccgccgcccagggcgcacttcgcggtggcggcgggaagggagggaccggccacggggaaccgaacgcgaatcgcccccctccccttcctccctcccaccctccctccgatccgccgcccgccctctcggcttccgtcccctccccctcccacaaaaccccggatggaggcgccgccgactcgccgccgcctggctccgggggatggttttgtcaagcggccagagccccggcgccaggcgcagccgccgccgcccccgcgaggcgcccctgccctcgcttcccagaaccgggtccccgagtggcccgggccttccgcctgcctgcacccgtagccctggtacgagggtcattcgtcgtctttgttgccaccgcctctgccggaaccgtttgcgagctccggtggcccccgcccccccaccgccttcccggaccctgggctgggggtggcacgtgggcaccggccccgggaggcggaggcggtgcgcgcttacctgtcgccggtgctgctgcggcggggggtgtggaggaggcgcctctgggcagcctcggccgtgctgtcctccccgccgccgccgcctctgcctctcgctgctgctgctgctgctgccgccgcggtcggtgtctccggcgcggcggcggcggcggcggcggggcttttcctgtccggttacgttaaggtcacatgaccgagagagcggagagactagtgcaaagaggctgcgagcggctcccgccgggggggagaggcggcgagagagcagtggcggcaagagccccctccgccccccccccagccgctcccctccccccgcccgcctccgcctcctgctgctctgccgccgccgccgccgcctgcagcactccactgccgctcccacccaggctccgcgctctgctccagccaaacttctgcagaccatgtgcagccgaggcgaggaaacttctctccacctattggggctggaggcctgagtcacaagccccttgtttacataaagtgtttaggtagcacaagtccttgagatgctcggggtagagatggagagccactgctcgtatccttctgccggcttctgcttgagatctcttggcctttacccttgtcccttgacttttcgtgtttgttttaatctttaagacttgaaatggagtggcctttagaaccggggagatactgtaaaccagcagtatctttgtgtcaccaatggtaactgaaagtcatgctgaagtacagattcctgtagcgtgcacagaggcagaggtgcttcctttaccttgcagatgagttgagcggcgtaagatgtttctgttagggttgaatttcatggttatttcagcaacgattttcgtttttgaagttttggcccccccaaaaatgaaagtctgcaacgcatgtttgttaagagaacagtttattctcctgttaggttttggtctttgaggtatggattccagagttggctattctgttagatttagaggtgtggaaaatcttttaacggggagatcctgaaacacggaaacatggcagggaagttagaatttcctgatggtcatttttaacattttaaagtttactttttggttgttgccatttttctagaatccgtgtcttttttggggaaatacagtcctttgaggactagaatttaatgatttctttacacatctaggattttttgagatttagaaaggatatggctttattcctaaggaagtggaggcagcagtttctaggatactctggtttcaaggcatgctaacttggttgtgatgtctaacccattttggtttacacagtctgaccactagcacaatgcctggcacatagtttacaaatcatttaaggcaagcttaccatcttaagacaatttaatacatagaagtgtccctcctaaaaatctgagtttgatttagaaatccagttatacctgcaggtactgatgactaattccttctttgaagacaaaataagcagctgtgtagcttcagtggctctcaaatggataatagattcagtgtatactcgctttgaactttcctgttttttgatcagctagataaatgactttagtgggtaaatgtctgcctccaaaaccaaattctgaccctgatctaagtattctactgcaccgctgtcactggaatatcaaagttggccttcagactggtgcctggttccttggattggcttgagtattgaggtctgtctcatcttactagggaactaaaatgatgttgattgttttgtagagaattgtaattagagatctgtaggttcttaattcttttggaattccattctgaaaattttcaaccttatggtgttggtggagtgctcatgtgaagagtgaaactgacttaagaataaaagaaaaagtgggcaaaactaatgctaaacttgagaccattgggcagaaatttgcctgtgtgtgtagagtaattggtcttgagtcaaagtaactatgcttatttttaacatcactgaatattttctagcgttacactctatataggcttgtagaaataaacccaggggtaagcccagaaattgaatatcagtcctaaagaaagcctatcaagagcatcctattctctttaagagctgctattcgaatttaggactgggctggtttgctgctcattctctcgaggcataggcagccacacttgaattttgccaagtatgcagataattccaacttgtagtcaggatcatcaggtaatagcattataaggggagctgtacagactgtatactttctacagtttgttgaaatagaaacatttatatggatacatacatctgcaaaggttagggagaaaacggtagccctggcagagaagagctagttagtgtatttcaggatagggccaagggaagctgtcatttctctactaagtctcattgtggaaaagccacaaatgtccctagtacagtaataaggaaaaaaaggctgagcgtggtggctcacacctgtagtcccaggactttcggaaggattgcttgagcccaggagttgcagatcggccaggacaatgtaagaaaaccccatgtattagaaaaaaagaattagccaggcgtgatggtgtgggtctatagtctcagcttgggaggctgaggtggcaggatcgcatatagcccaggagttcgaggctgcagtgagccatgatcgcatcactgcaccctagtctgggcaacagagtctctaaaaaggaaaaaaaaaaaaaaagttaaatcgctgtttaattatgtgccaatttattttggtattttgagaatctggtaaattaggaattcaaaaatagttttaacactttttacttcaaagaaaatcacagtgcaagcaatctgagtggattcatcaaaagttatacatgaatattctgcagagtctggtgttgctgaaagttttgatttgtgttctgctgagacacaaccatgaaaatatgcacttgcttgtattccgaagaggatagttccagtgagacttggacaatgagcagaaaaaatttttttttgagacgaggtgtcgctgtgtcgcccaggctggagtgcagcggcgcgatatctgctcactgcaacctctgcctcctgggttcaagcgattctcatgcctcagcctcccaagtagctgggactacaggtgcccgccaccacacccggctaattttttgtatttttttttttttagtagagacggggtttcgcagtgttagccaggatggtctcgatctcctgacctcgtgatccacccgcctcggccttccaaagtgctgggattacaggtgtgagccattgtgcccagctcagaaaatttaatagtactagatctcgtgtgtgtgtgtgtgtgtgtgtgcgcgcgcttaggttgaaggtggaatttaacattgatttaaaaaaaataatagtaggaaaaaataaatgcggtttgagtccaaagcagcatttttcactaattttatgaaggaagtccttttgagtaatgtcttaaattaggaaaatggcgtacttttacatgttagacattaaactctagggcagataaccatgccctgtgtgttgtgtatcaagcttagcatatacataggaaaagatgtattgtgagagtgtcttacatttcgttggtttggtcataaagtttatagaaaatgcttgttttatagttggttgttattgagatgagagtccctcaaggaactccctatgctttagggagctttttgttttaaacctactggttagacttgtgggttttaatgttttcagctgtggttgtaagaaacacattttaaattgcacctagtatagacatacatgtaaaacaaacaaaatttttacgaagtagtacttgtattaagagtgatgtactctgctatcttctatttcatttttttaaagttgatattgctgccttaaattgattttttcaaccactaatgagtcaggacccactatttaaaaaatactggtgtgttctcttgctgttacgaattaacccaaaacttagtggtttaaagcaataaacttgtgtttatctcatgtaggttctgtgggtcaggaatctgggagtagcttacttaggtggttctgggtcagggtttttcatgaggttccaaggtggctctcatttggcaagtcagctatggctgatggtggaagttcttcattggactgcttgagtgtcctcaagcagtggcgaaggctagctacccgcagagtaggtgattcaagcaagagcagagaggaggccacacaccatcacttctgccatattctattaaaaagaagtcacttaagtccagcccaaactcaggggatgagtatcaaagaattatggacatagtttaatagctgccacatttatatgtttttccactttatattttatttatttatttatttagagatggagtcttgctctgtcgcccaggctggagtgcagtggcgtcatctcagctcactgcagcctctgcctcccgggttcaagtgattgtcctgcctcagcctccctagtagctggaattataggtgccccctaccacgtccggctaattttgtatttttagtagagatggggtttcactatattggccaggctggtctcgaactcttgaactcaggtgatccacctgcctcagcctcccaaagtgctgggatttcaggcatgagccaccaccctggcctgtttttccattttaaagatgagttaggattgcaccaaaagccatgctgaaatcaacctataagtaattatcttagttaattaagtcagtttttttctctgagggcatctagtcacacttccttctcagtcttcaatttgaaaaagcaggctcaaagaatttaagtaattaagcagcccaaggtcattcagtctaggaaaacctcacaaattttctctgacctttgtcatgaataacatgtgagctgataaagatgagaaaattaagaagttacactgtagaactgttcgccagtcttctagtttgcagacctccatattataatacactttaaaattcagataatgcttggtgtctagattcctcatactagcacccctcctgttcatttttagaggaaacaggaaatgtacttattaaatgaattcaaactactttgaatagaccattccagatgctgcctgtatactcactatgagatgtactgtgcaaactaattccaattagcacattttgagaacccaaaaggatgttgtgacttaaagatgatgagaatttaagtgtaaagaagactacacttctttatgctgtgaaattttcatagaaattttggatctggaaggattttgttctaagactagttttagcttagtgataaaaggaataggatgacattggtagtgagcgaaggcaggataaatttctaaagacttccttaaaaatttttttaatccattaggcttttctaaattataggttgggatacaataagttatcttacacctttgcttcacggaatgggctaatggctacttttttttttttttttttttttttttttgagatggagtcttactcccatctcacaggctggagtgtagtggcacaatcttggcttactgcaacctccacctcccgggttcaagtgattctccttcctcagcctcctgagtagctgggattataggcgtgcaccaccacacccggctaatttttgtatttttagtagagatggggtttcaccatgttggccaggctggtctcgaactcctgacctcaggtgtgccacctgccttggcctcccaaagtgctaggattacaggcatgagccactgcgcctggccggataatggctacttaaatcatttttcagttttcccttaccactatgattcctgactgtttctattctgacctaaagtactgtttgtacacaattaattttgattaccctttttgcttgttacttgtctccctatatcttgtatctctcactctcactgtaagctccctgagggcaggtacttctttttatgtacactcctggtactcaattgcttgcagaattgagttgaatttgtagttaaaggatctaagatgatcattttcccactcgaactgagtgaaaaaggtgtttattgttgcagaaaacatctgcgtataggtattggatgctagtggtgcatatatgaatacctatctctgctcttcaggtggtcacagtccactgggggagaaaaacacagatacttagtacaatttattctatactgcagatgtgcagagtgctgtgggtatgtagataactttaagctgaatcttggtcggtgagcaggtgttcagaagatagacttagtggccaagtgcggtggctcacgcctgtaaccccagcactttgggaggccgaggcgggtggatcacttgaggtaaggagatcgagaccatcctggccaacatggtgaaaccccgtctctactaaaaatacaaaaattagctgggcgtggtggtgcatgcctgtaatcccagctactcgggaggctgaggcaggagaagcgtttgaaccagggagttggagggttgcagtgagccgagatgttgccactgcactctagcctggtgacagagcgaggctctgtatcaaaaaaaaaaaaaaaaaaaaagatagacttagttttgtgatgtgctttgggggtggtgcatttcttagcttcattcctttactatacatctcccttgaattattttccttttatcgttggtgagttaccatcataatttaataaattgtttccttctgtgacatgtacattcttgtcacatcatttctctagaactgtgctgtccagttcaactcagtgtcacactagccatgtgtgctgagtagccacctgtggctagaggctaccatatttgggcagcacagataatataaaacatttctattattggagaaagttcagttggacatcactgctctagaatcatgttttgcttctccctattttcacgttatcaatagtgtattgagttcagaatagaattaggaaacaatagcctcctgatattgtcattgggagggatagagtggttgatatttatgaacagaggggggagagtgtagtgtttggtagtggttgagaatatagcctttggaatcagatctgggttggaattatggtccgtcccttacacactgtatggcttcgggcatgttactgaacctctgagcctcaagttttccttctcaaatagggttaatagtaattatctcataacattgggtgaacataaaaacaggaggggggccgtagcacagtacctcagtaaatgataaaatcggtatatttttgaaatcatcactgatttaaaaaaaaaccttagaattatgtagtaaaagtgacttttttttttcagtataccgttctgtgatttttaacatagtatttatttgttgtaatcaccaacacgagaatataggccaggtctatcactttattttgctgtctttatagacctgtgctgtttccacccctaacccctggctgtcaccgatctgttgtccatcactatagttttaccttttctaggatgttacataaatggaattacacagtatgtcgcctttgcacactggcttcctttacccagccagattgggttgagagcgatttgtccaagttgttacatctatcagtcgttgaaaactgatctttaaagacattttaattttgaatcattatttcctaaacgtgaatctgaattccttaacagttcttcaagtagtgtttggctcaggatttttgtgtttaaaagtaaaataaatggtaaaatatatagggaaaaattactgcttccacctgattggtaaaaaccatgtgtgacattaacatgcttttctttagggaaggttcttgtttttagtagttgatccatattaaagctctgtagagttgccacaaagtccagagttgaaaaaggtggctgttaaaatatcagtttctaaaatgtggccgaagatagcgtgaccagtcctggtttgcccaggactttgccagtattagcagtgaaagtctggccgctctcaggaaaccccttggtcccagtcaaacccagaatgggaccaagcgccgtggctcattcctgtaatcccagcactttggaaggctgaagtgggcagatcacgaggtcaggagtttgagaacagcctggccaaaatggtgaaaccccgtctctaataatagcctgacatggtgatgcacgcctgtaatcccagctgcttgggaggctgaggcaggagaatcgcttgaacccaggaggtagagcttgcagtgagccaagattgtgccaatgcactgcagcctgggtgacagactgagactgtgtctgaaaaacaaacaaacaaacaaaaccccagaatggttggtcaccctatctgaaaagagacacacaaaatcagaggattccagttcatcaggtttcagtagtgaaccatcggccaagtatttcatctaatcttaattgcctttgggtgcttagagtcaaatctctaaggtaaccagaacccaaaccacatgaggttttttagattaagatcagcaccttgaatttaaggttttgtggctagaggtttagatttgattggaattacatcgttaatttttgttaaattgttgaataagcaacttcccaagccttgtgtgtagaagctagattaaaagtcaagtttctacttaaccagaatctctgttttgagtttttaaattcaactggtgatgtctaaatcttaaggatattgtaagttccttaactagtctgttccattttcctgagttttcacatcacctctctacctcttgtgtagattttattttttattttgaaacggattttcgctcttgttgcccaggctggagtgcagtggcaccatctcggctccgcaacctctgcctcctgggttcaagcgattctcctccctcagcctcctgagtagctgggtttacaggcacatgccagcgcacctggctaatttagtatttttagtagagacggggtttctccatgttggtcaggctggtctcaatttccggacctcaggtgatttacccgcctctgcctcccaaagtgctggaattacaggcataagccaccacgcccagccctagatttctttatagagcatctgtctataagcagattacttagttttcctgatgtcttcgttggaatgtaagctttgtgaaagccaggggccctatgtgtcatctttaccactatgtcttagatcttagagcagcccatcataagttctaataagtaattgtggaattggatgagaaaatgaatatgagtcagttttacaatgctgcatgcttcccagattattttaacagtctaggggatgtggaaagattttgttttaaaaacgtttaaaagtccacgttttgtttgatattgttcagaggaagtgaaaatgtggtctttaaaaaattttgttgcccgggtgtggtgactcacgcctgtaatcccagcactttgggaggctgaggcgggtggatcacctgaggtcaggagttcaagaccagcctggccaacatagtgaaaccccgcctctactaaaaatatcaaaaattagctgggcatgggggtgggcacctgtaatcccagctgctcgggaggctgaggcaggagaatcgcttgaacccgggaggcggaggttgcagtgagcggagatcgcgccattgcactccagcctgggccacagagcaaaactctgtcttaaaaaaaaaaaaaaaaggctgggcgcggtggctcacgcctgtaatcctagcactttgggaggccgaggtgggcagatcacgaggtcaggagatcgagaccatcctggctaacacggtgaaaccccgtctctactaaaaatacaaaaaattagctgggtgtggtggcaggcacctgtaatcccagctactcgggaggctgaggcaggagaatggcgtgaacctgggaggcaggcggagcttgcagtgagccgagatcgtgccactgcactccagcctgggtgaaagtgtgagactctcaaaaaaaaaaattgtttcattaaccctctatgagggaagggaatttagaatggtgacattaaaccttcctttaaaatggcaattcagaaccagtggagagagctgaaagtgagagtagatttggatttggaaaaattccctctacttctcatacacatcaccttctcccaacacaggcactttgtaaaggcatagagcagggtctgaggagattgggttggtgaaagagagaactgagtcacttgagattagtacttggtaagcaagagagtgctaatgaattatttaaaatctgtgtaacctgagtgtaaaccaatacatagactaagttagtgcttctcagagcttagggagcataggagtctcctggagaattagaagaaacagattttcctagctccggccccagacgttctgatttagtgtggtgtagaactcaggagttagtaatattaatggacagtcttgagtatttgctgatgcaactggtctgaggaccatactttggaagacctgctttagatagtagacaggacagtaatttaaaataggcaaatatggtttatttttaaaatggtaaaactagaaagatactgattttatgtgtttaaaaaaaaaagtctgcatctgactgctatggttatccaagaaggcaccccagaatacctgttggccaccgctgtttggtatatgcaaaaatgtgtagtttttaaaagagtctttttgggcttgcactgaggagccaccctattttatacagtcaaaatattgctatatttaagttaaccattctgttccagtgcaggattcagtaacatctattctgtaagtttcagttgtgatatttcttaaagattcaaagatggatcctgggaatttgatttagcctccatttcatctgggagttaatcctcacagcaaccctgtgagataggttaataattaaaccctcctattcacacatatttcattaatccttacagcaacctgagagatagtttaataattaaacctactccacagatgaggaaactgaggcccaagaggttcagtgattcgcccaaggttataacagcaagaattggtggtgaaacaagaattcaaatccagattggtcttaatagtgagctctcatgtgtgatagaaattagataccactttgaggactttgggagccagtggtgaatgtacttactttaggctctaaatactctgtgtaatttcttggtcattttgttcttagagaggtggtgatcttaataaagttttgactttattaagtaattaaaagtttttacttatgttacaactaaaacaattctttaaaactttcataacttgaagttttaaatcctaaaattagttgaaaaagatgtaattgccagtgtatcgtaaatactggtattttaaaataaagctgctttatcacttttaaggaaagcccttgtaatttagtgcattgtaatagtgtattgagctgatgtccaccatgatccatgtaaacataggtgaactatgcaaatacaagtttttcttcttgaaaatgttacatttcctctacaacactttatgctaataaatgtttatgaacctcttttgatgatcctttcatttcttgtaaatttttgtatataacttgaaatgtttaatttgctgtaatcataaggcatcaaatgttcatggtttttttctggactattttcacattgttagtactgattagttgaccaaaacagcaaattgcatacattgatacttgcagtaaaatttcactggaattgtacctcctaaaaaaaatgggagaaaacataatggcttcaattaaaggaggctgcatttaccaatcttccaaattgtccttttttgtttttgtggcttcccaaaagtgttgacaaataggtttaatgtatttaaaggttattgaatgtagtggaccaaactattgaggataggtgagagacgccgcttctgtaagtgtgataagggaagatgggaagagcaggatacactgcaggtgtgcacacaggtatgttgattttatgaaaattggaacttgatctaggaagcaatttttaaagttattttgagacagggttgctggcctcaagcagtgctcccaccctgacctcccaaagtgctgggattacaggcgtgagccaccatgcacatcctaaaaagcaattcttggactatctgtgcctatatgctccttggagagtttttgtgggtacccttggcatacaggtaggtacctcaaatggaagacagctactgaagaactctcgctggaagacatcagatgtttatcctagcactgttaactgcagataaatatgtccatcagttagtacagatgaatgtattctcttggtataatactgtgtagcagttaagtgagttgcaaaacgaaaggatatgtgtgaaaaaaaagttgacaggtgaggactatagtggggcatcgggttatgcataaaagtaaggcaatgaaggtaaagatttgatttttaaatgttgtcaacccaaggaggtaaatatgtagatgttaaattctttgtgcttggtattttttaaatttccccaaaatatctctggaacaaacatctgtgggaagaatattgtgactaacttggtgaaaggacaaagtattaataaaaggtgccggtgaacagccatactcaaatcatgccatcgaaaataggtatttaagatttcatttctgccaccagaagcctgtcttgttattgtatatattgatttctctcttttttttttttttttttttttttgagacgggagtctttctctgatgcccaggctggagtgcagtggcatgatctcagctcactgcaagctccgcctcccgggttcatgccattctcctgcctcagcctcctgagtagctgggactgcaggcgcctgccaccacacccagctaattttttgtatttttagtagagacgggatttcaccgtgtaatgttagccaggatggtctcgatctcctgaccttgtgatccactcgcctcggcctcccaaagtgggattacaggcgtgagccaccgcgcccggcctgtatatattgatttaaacacttcagttcctgtatgattctcttagccagggccatgatgggattccctggggataggttaagttgtggtgtctaaaacctaagtcctgtgactttaagaagtatctgccaagatttgccaagatttcctagatgctagttttccaaagttcttaactgaaatatttaccttttgaattgtcagtgatgtagatacaaacactagattcttcataattttattcacacgatatactgggctgaaaaagataatttcttgattaaaaaaacacctattaaatgatcacccagtagtgaacatttatttatttattttattgtttatttttgagactgagtctcactgttgccctggctggagtgcagtggtgtgatcttagctcactgcaacctccgcctcccaagttcaagagattctcctgcctcagcctcctgagtagctgagatgacgggcgtgtgccaacacacctggctaattttggtatttttagtagagatggggtttcaccatgttggccaggcttgtcttgagctcctgatctcatctcaagccacccttcttggcctccgaaagtgctgggattacaggcatgaggcaccgcgccgggccgaacatttaatttttgattgtagaacttgaatatctcttgcagtgacactttggttatcacttgatcagaaaaatactcgtcccagctcaaacattaccttagaatagaaagtgagaattatttcatgacgggcaaattatgggtacaaactaaaatgacttccaagattgtgattaatgagaaatgctcctgaagtaaggtaaatgtttgccctttctcacgtggcaacctatgaattggaggtacgggtgcttgatttgatgttgagctgtacattataaatttacagctagaactttttccaaatgctgtctttaaaagcagaaccttgaggtctactctcaaattttaaaaagtggaaccttttcaagaattacttttaatgcatttgcaaatagtaatttgaaacttccaaatagagttagtaatgataacaaagtcagcctcttttctgctaataattttctatctcaaactatcttattagcatagcccctgtatttgtgaaaagatggtaactgatcatagtacagagcatttccatcttacctctatggtaatgaggatgacaatcatccactccaagcggagtgccctcttctcattcaggtgattccgcattagatctgttagttccatgcagtgctgaagtttttcattcatgacctatgtaagaaaaatttcagtaacatgtatttaaacaatttaatacggtcatacacataaaaattctatagctatacagtgaaaaatcctgctcctcagtcctctccccaaaggcagccaccaacattatcagtttcttgtgaatccgtccagagacattttgtaatgtacaaatttaactgcaagaaatactttgcatactgaagctcttctatttgtaagattttgatggaagaactaaaaataggtttttgagtcctagtttttagtagctgccctttttagcagttaaaagaggcaaacttgaaacataatgttttttagcaagacctaaagataatttactttctactagaaaatctacgcttaacatttgacctgctgtacacacaccactagatggcattgctttcaactgaactgcaacagttctgcattccgatgcctccaaacaagctggctgtgggggttcaaagaaaataaagtccctgaattcaaaatttggatgtgacaacttttttttttgttgttgttgttgttttttgggatggagtctccctctgtcgcccaggccggagtgtaatggcggatctcggctcactgcaagctctgcctcctgggatcacgccattctcctgcctcagcctcccaaatagctgggactacaggtgcccgccaccacgcccggctaatttttgtatttttagtagagatgatgttagccaggatggtctcgatctcctgaccttgtgatccgcccgcctcggcctcccaaagtgctgggattacaggcgtgagccaccgtgccaggcctggatgtgataactgttaaatacctacctaatatctttatatatcacttgctactggaaatcctgaaagcaaaattttaaaacagtttgtctcatgggtatgctgaagttacaggtttggtcagtgaacattaagagatgaatcacaggtacgtgttcaggggttgattggaatgcgttaactgcaccatgttacgatttttgcacatagcattaaactgccttactaggctgggctcggtggcttatgcctgtaatcctagcattttgggaggctgaggcaggaggcgcacttgagctcaggagttggagaccagcctgggcaacacagtgaaaccctgtctctacaaaaaaattagccaggcatggtggtgtgtgcctgtagttctagctacttggcagggatgaggtgggaggattgcttgagctcaggtggtcaaggctgcaatgagccaagatcatgccactgcactccagcctgggtgccaaagtgagatcctgtctccaaaaaaaaactgtcttactcacagaaccacaggactaactgactgaaccacactccaccatttgcccctatttccaggcgttatggtcaccctgtagtttctaatctgtatagatgtgtagagcatgcctcttccctcttcctttcccctccctgttttcctttcctcttgccctttcttaatgtctgtttctattggctgcttgatcttggtctttaatgttcatccttaagcttgcttctctcttcagactactgattcagcctcttgcattttctttcaacttgggccaaaaaacaggcaacattttcttcctccactacctcatcatcatccaatttattcctttagtttatattaccacaactctcctaaacgtcccaaagtctattattaagtctaacaacttagcttcgaacctcaatccaagcatctgacaacacactgaaatgtgcaagcaagagtccctatggccgggtgcagtggctcttgcctataatcacaacacttcgggaggctggggcaggaggatcacgaggtcaggagatcaagaccatcctggctaacagggtaaaaccccatctctactaaaaatacaaaaaaattatccgggtgttgtggcggcccctgttgtcccagccagtcaggaggctgaggcaggagaatagtgtgaacccagccgggaggtggagcttgcagtgagccaagatcgcgccactgcactccagcctgggcgacagagcgagactccgtcacacacacaaaaaaaagtcactattaccacagcatgctttctatttatttaggtatagaggcatgtacgcgtcgagcatgcagattaagggagcaaagaaaaaaccaggagaggcttcacagaggtaggaaatgtgaattaggctttaaaaggcagtggacatgaagaaaaggtgggatgctggtggggttattgggggatgaagggagcatgtcaagcataggaaacagcatacagacaagcatagctagattgtggacaacctagaagaaagtgcttggaagtgaggttaagaaggtaagtcagctgggggcggtggctcccatctgtaatctcagcattttgggaggccaaggcaggcggatcacttgaggtcagtttaagaccagcatggccaacatagcgaaaccccgtctctactaaaaatagaaaaattagctgggtgtggtggcaggcacctgtaatcccagctatttgggaggctgaggcaggagaatcacttgaacccaggagtcggtggttgcagtgagccaagaccacggcattgaactccatctcagaaaaaaagaagttagtaccagattgtgagaggtactgtgtactacatatggtataggcagaaccatgtcccccaccccaaagagatttatgtcctaattcttggaacctgtgaatataatatggcaaaggagaattaagattgtataagaaattaaagttattaattagctgaccttaagatgagataatcctagattatctgggtaagcccaatgtaatcacaagggtccttaaaagtggaaatgcggggcagaagagttcagaatgatacaatatgaggattccacaggcctttgctagatggaggagggggccatgagcaaggaatatgggtggcctccagtcactggaaaaggtgaggaaatggattccactcgcagtctccaaagaggaatcaacatcttaactttaggccatgccagacttctgacctacagaacagtaagatgacaaatttctgttaagcagcagtaggaaagtagcatgtcatgctagaatatctgaacttcattctgcaggtaatggggaggcctttgttcagtctggaagtacttgttttaacatttactgtactacgctgggcagaggagacagaatggtgaaatagacatgtgtctgtcttgcagccaaagggtgcagagagactgggaaaaggtccagtctggagactgagagagtcaagaaggaatcagacaagtccaggtgggaaaggaagatgaggggctgtgtggatgaacattaatagttgggggcttgaagacgggtcagtatggtattcccctgtttcaccagcctagggcctatcatacaggctttcaataaatgtttgctaatgaatccatgatacttagagggaactaaaaagattgtttgactggatatggaaggtgaaggagaaaaaggacacccagatgacttttaagtttctggttgaatgactagataggtgaggctagaaggtcctcccatgagctgaaatagagaactgaaaaggtttaccattttctggggtgggggggaatttcaaaagtttcattttgaaattttaatcattgactaattctacaaatatttcttgcggacatactgtatgtgaggcctttgccaagaacaggcaagaaaataatcatggtctccgatctcatggggcttacattctagtggaaaatggtacacacaatttttaaaaggatgcgacgagatatgtaaatgaggaagatctgtgagattgaggggcaactggaaaagtctggaaggcagacaagagactgggatgagagagacatttgaaaatccccaggagaaggtgggattagaagtcacgacaacaaacaagtgttcacggagaaggtggcatggggacagaagcctcagcgacaggacttcaggggatactgacgtgagaaaatggagcgagggatccactgccaactagtttctgtcccatgacactgtgtaactgctctctgcatctggacctctgtactcaactttttagcatgtcttatgcctactcacccctattttctcaagaccctttcttctactttttgagggggaataaaaaaccccgctactctttgttccatttttttttttttttgaggcggagtcttgctctgtcacccaggctggactgcagtggcacaatctccgctcactgcaagctctccctcccgggttcacgccattctcctgcctcagcctcccgagtagctgggactacagacgcccgccaccacgcccagctaatttttttgtatttttagtagagacggggtctcaccatgttagccaggatggtctggatctcctgaccttgtgatccgccctccttggcctcccaaaatgctgggattacaggcatgagccaccgcacccggcctgttccatctgttttcttagaagactgtaaagctggctgaagggcaggaccaattcttacttttcttttgtattatgtataatgccagcactatgctgagcctaaggcagggtgaactctcaaccccttctaaataaccttgacataatccaacgagtctgaactgccttcgggatgctgagaaaaaactctgagaaaggtagtttgagaccttttaggtatgcttcataactcatgcagaagacttaacaccaaaaaagatgtcccacagtgagactggggaatgaaataaagaacaattacttgctcagattactccaattgattaattaatattattctggaatagttgaatcactcaattcaaacctgagtaattcaagttttgggtgctactataaacagaagttttaaaatttcattttccaattgtgtatttgcagtataacgaaagataaccgtttttatacattgatcttgagaccttgataaactcacttattctggtagcttctttgtagattcttccaggtcttctacatacaagatcatactgcctgtaaataaattcagttctagttcttcctgtaggagactttatcttatttattaattatttttttggagataagtctcactctgtcacccaggctggagtgcagtggtgcaatctcagctcatcggaacctttgcctcccaagttcaagtgattctagtgcctcagcccctcaagtacctgggatcacaggcatgcaccaccaggcccggctaatttttgtatttttagtagagacaggtttcaccatgttggccaggctggtcttgaactcctggcctcaagcgatcctcccaccttggcctcccaaagtgctgggattacaggtgtgagccaccatgcccggccctataagagattttaaatcttggggatataaatagagccacccgtgaaggactggtgatatgtctgggtgacattgcttatggctttctccacaggtgtagggtgccagggactggggtggcttttgattcttccagctgctcatgtgcacagaggtatagatgtgaaccccttcatggagggactcaatctcaaattggcctcgataccagaatgaagagcacattcagtagaggcagaaggggcttgggcagcctgcttgttctcaacgggtgtcctttctataactgcagttgatctcagccatgaaacagctgaccacttagttgtcaaggtactcttcactcaggtgggtatcctcagttgcagacttgacttcagtaattccatcttgaatactgaggatggacagataaaaaatgccacccaggtaaaagatcagatcattaaatttggcattaacgttctcgtctaagctgagaccagcggcatttggcttgctgacaattcagaacacaatgagatcagtaatggttccaccaactttgatggcctgaagctggcaaccattaaagtaactggtagtatgaggatcgtgtaggtcaggggtcataaagtaggtttccagaattttctccatctttttcaaaaccaatgtggtaggcagatttctaagatgccacccaaagactccccacctcctggtgttcacttttgtgtcatcccctaccctcgagcgtaggctcagtctaataacttgcctttttttttcttgagacgaagttttgctgtttcatccaggctgatcttggctcactgcaacctctgccccccttaggttcaagcgattttcctgcctcagcctcccaagtgactgggattacaggcgtccaccaccatgcccagctaatttttgtatttttagtagagacagggtttcaccatgttagccacgctggccttgaactcctgacctcaggtgatccactcacctcggcctcccgaagtgctgggattacaggtgtgagccaccacgactggccataacttgctttttaatttttttttttttttaaagagatgggcgggggtatcactatgttgaccaggctggtcttgaactcctggcctcaagtgaccctcccatctcagcctcccaaagggctaggattataagcatgagccactgtgcctggccctaacttgtttttaacaaagagagcacagcaaaaatcacttctgtgattaggttgcaaaagactgtgacttctgttttactagcattctcttcctgacagtctctcttgctctctgtattagtccagtctctcactgctataaagaaatacctgagacggggtaatttataaagaaaagaggcctaattggctcatggttctgcactgttctacaggaagcatgatgctggcatgtgcttggcttctggggaagcctccagaaacttacaatcatagtggaaggtgaagggagagcaggtaccttacatggcagaagcgaagaagagcgaacaaggggagatgcaggtgctacacacttttaaacaacctcacgagaactcactgtcacaagaacagcaccaaggggatggtgccaaaccactcatgagaaatctaccctgatgatccagtcacccccccaccaggacccacctccaacacgggcattaccattcgacacaagatttgggcagggatacagatctaaaccatatcactcccctacttgttcatctgatgaagcacactgccatgttgtgagatgctctatggagaagcttctggacatcagcttatgaggaactgaggcctcaatctaatagcctgagaggaaccaaatccagccaataaccacgagtgaactaggaagtgaatctctgagatgactgcagccttgtgagaaacacagaatcagaggacccagctaagctgcactgattcctgacccacaaaaacttaaatagtaagtggtgtttcttttttctttttattttttgagacagtctcactctgtcacccaggctggagtgcagtggtgcagtctcagctcagtccaacctctgcctcctgggttcaagtgattctcatgcctcagcctccagagtcagctacttgggactacaggtgcatgccaccatgcccgactaatttatggggtttcaccatgttggccaggctggtcttgaactcctggcctcatgtgacctgcctgccttggcctaccaaagtgctggggtaacaggcgtgagccaccgtgcccagccagtaagtggtgtttcagtccaccaagttttggggtaatttgttacacagcaatagctaacacaaccacaggaaatacctcaactgtataaagcttttagtatccctccctttcctcctctggatcttcagcctgtgtgcacagtcgacaaccaggaaagtccagtgcttttcatgtttgaccagacagttggactgtcaaatcggtgtctaattacacctctgttatctaaaactgtgttgatggagtccactgaatttgattcctaaaccatcactaatcaatctttctgtgtcagctaaaagcaacatagcttggttttcttgccgagtggtgatgatctctactgtcctgtgctggaagacacctacagaggaataggtggtgccaagatcagtgacaactgcagatagctttgatgtggttttgcaaggggcggtgtctagcttagaggaaaaaaatgtagacactaaagtggaacatagcattcaataagccatggtaggtttttgaaattataaatcatgtattttttatttttatttttttgagacagggtctcactctgtcacctagactgggatgtagtggcgtgatcatggctcactgcagcctcaaactcctgggctaaagcaatcctcctgcctcaacctcccagggtagctgagactacaggcacatgccattatacctggctaatttttttaaaaaaaaggttagtagaaatgaggtctcattgtgtttcccaggctaatcacttatttttgatgtgatacaaggtgaatgtggggattggtaggaaatatgattgaaaaacagaaacaataggaaggaccttgtatatcaagccagaacacttgaggcaatgagggaaactggaggtattaaaattagttggagggaatcagaaaagacaatcagtagacactaatatcaagaggtatctgaggttaggtattattagatgatgttagagcaaccatcataaaaatgattcaacaagcaattctgaacacatttgaaacaaacgaaaaagcaggaagtctctgcaaagaaacagaagatacaaataaaaaaacatggaaattttagaactgaaaaatataataaatgaaataaactcaatgttgggcagcagaacgaatgtaacagaggaaggaatcaatcaactagaagatgaaacaaaggacattacccaatcttaacagagacaaaatatactggaaaagaagtgaacagagcctcaaagaccttgtgaaatgataataaaagataaaatgtagatgtcatagaattatggcagatttccgtcagaaaccatggaggtcagaaggaagtggcatggcatttttcaggtgctgaaagaaagaaaactgtctacctagaatcctatttctaggaaaatatcctgcaagaatgaagagaaaattaatacactctcagatgaagacaaactaagagaatttgtctcactagacttaccttaaaagaatggctaaataaagttcttgaaaaaaaaaaacagtaaaagaaatcttagaagatcagaaggagaaaagaacagaaagaataaaaacatgggcacatacaacagactttgcttttcttagttttctaaattatgtttgatggttgaagcaaaaattataacattatctgatgaagttttctatgtctgcagaagaatagttaagaaaattataaatacggaagggtaaaggaatataaaagaaataagaattctttttttttttctgcatccaatcatccattagggaaataaagattctatacttcatttaatctgcaagatgttgaaatcagtagattgtaataagttatatacgtaagatgtaataaccagagcaactactaaatatctatgcaacgagatatattaaaaagtaacatcaaaatgaaataccaaaaaattgtttcagtaaccacaggaagacaggaactttgatacaagcaacaatttggatggatccaagttgagggcattatgctctgtgaaaaaagccagttaaaaagtcacatacagatcgagaccatcctggctaaacacagtgaaaccccatctctactaaaaatacaaaaaaaaattagctgggcttggtggcgggtgcctgtagtcccacctactcaggaggctgaggcaggagaatggcgtgaacccgggaggcagagcttgcaatgagccaagattgagccactgcactccagcctgggcaacagagcaagactccgtctcaaaaaaaaaaaaaaaaaaaaagtcacatactgtatgactatctatataacatcctcaaaatgacaaaattatggagatggagaagagattactcactgccaggggttagggacagtccgggtagggggagggcagtgtgactatacagggtagcatgaggaaaagtgataaaacagttttgtgtctttttgttttgttttttttgagatggagtctcgctgcaacgcccaggctggagtgcaatggcatgacctcagctcactgcaacctccacttcctgggttcaagcgattctgctgcctcagcctcccgagtagctgggactacaggcacgcgccaccacacccagctaatttttgtatttttagtagagacagcgttttaccatattggccaggcaggtctcgaactcttgacctcaagtgatctgcccacctctagcctcacaaagtgctggggttacaggcatgagccaccgcacctggcacagttttgtgtcttgatcatgtggttgcatggatctatagatgtggcaaaatgtcacagaactatgtgcacacattgtactaatgtcaattttctgttttctatgctctttccccatgtggtctacctccatcactacagctttttttttttttttttttttgagacggagtctcactctgtcatccaggctggagtgcactggctcgaccttggctcactgcaacctccacctcctgggttcaagtgattctcctgcctcagcctctcgagtagctcggactataggagaatgccaccatgcctggctaatttttgtatttttagtagagacagggtttcgccatgttggccaggctggtctcaaactcccaacctcaggtgatccatccgcctcagcctcccaaagtgctgggatttcttaatacacgtctcttttcccgactttgcttctgcccttctaaatgcctgcatgacggagctaattggatatcttgttgctactctaatctcagcatatcttagatttagtctgtcacctcccctctctgacctctcattattgtttttccacctttctacttgtcacctccaggcaaacatcagtcatcctttattctttcttctccatggcctcttattacccatcacttgatttgtcttacatgattctttcttaaatttatttctattctcactgtcaccatgacagatcagaagcagtcatgaactcttgcttgaaacttgacaagaacttactgatggaccattaggcttccaaactctcatcttattcaccaaccttatctagtctgtagagctaatatcagaagatcctttgacacaaaaaattgaagtgactgtacagaggacaagaaggggaaatataaagagatttgaatggaagtcaaacaagatatttctctgcaagcagttaaacatattcaacttataggcgacaacgtgtctttttctctcattagaagtgcaaaatacgtaccttaactcttcggccaatgctaaggaattgacacgttttatcgtaaagtccttccaggttttctctgtcccagtagaaatcaggagtaatcaggaagtctgaactcaagtttatacggtgcctttaaaaaggaaaattataactttttatttatcttgaattaaaaatcattgtttctattgtatttaatatttacatagtgctttatgaaaacttttttttttttggtaagagagagggtcttgctatgttacccgggatggagtgcagtggtgtgatcacaactcactgcaaactgaactcctgggctcaagctgttctcctgcctcagcctcccatgtagctggaactacaggcatgtggcattgcatgtggctgaaaacatttgttaatgctgacctttgcaaaatactgccaacaaacatgtaaataaaatttacaaatgagtttcaaacttctgaaccaaattaattcaatctttaataccaacattatttatgaagtacacagaaaaaaactcattttgttttcaattttttttttttttttgagacagagtcactcttgtcacccaggctggagtacaatggcatgatctcagctcactgcaacctctgcctcccagatttaagcaattctcctgcctcagcctcccaagtagctgggattacaggtgcctaccatcacacctggctaattttttgtatttttagtaaagggttttaccaagttggccaggctggtctcgaactcctgacctcacgtgatctgcctacctcagcctcccaaagtgctgggattacaggtgtgagccaccattcccagcctaaactttttttattaaaaattttagggccaggcatggtggttcatgcctgtaatcccagcactttggaaggccaaggcgggcagattgctcgagtctgtgagttcaagaccaacctggacagcacagcgaaaccctatctctacaaaaaatacaagaactagccaggtgtggtggtgtatgcctgtagtcccagctacttgggaggctgaggtgggaggatcatgtgaacctcggaggcagaggctgcagtgagccaagactgtgacactgtactccagcctaggcaacatagtgagaccccatctcaaataaaaaaaaaatttaatatgtccacacttttttgttttttatttaaaaaatttttttagagataatgtcttcatatgtcacccagtttggggtgcagtgacacaatcatagcttaccgcagcctcaaactcctgggctcaagtgatcttcctgcctcagcctcctgagcagatcaagatataaacaggtaaaaattgataaatcttaactcttattcttatctgtatctttccctatcagtaatcccttctagtttccgctgtatccttccagtgtttatgcaaacactagacaagcaagcataaacatacacactctctctcttaatttctacattttaatataagaagtctgtgcttacttttttttctgagacagagttttgttcttgttgcccaggctggagtgtattggcgcgatcttggctcaccacaacctccacctcttgggttcaagcaattctcctgcctcagcctcccgagtagctaggattacaggcatgtgccaccacgcccggctaattttgtatttttagtaaagatggggtttctccatgttggtcaggctggtcttgaactcctgacctcagatgatccactggcctcggcctcccaaagtgttgggattacagatgtgagccaccgtgcccagcctttttcttttttgagacagaatcttgctctgtcgcccaggctggagtgcagtggcatgatcctggctccactgcaaccttcgcctcctgggttcaaccaattctcatgcctcagcctcccaagaagctgggattacaggcgcacaccaccattcctggctaatttttgtatttttggtagagatggggtttcatcatgttagccaggctggtctcgagctcccagcctcaagcaatccacctgtctcagcctcccaaagtgctggcattacaggtgtgagccaccgtgcctggccttacacttagatgtttaactaaataaaaatctaagttatgaaagtacacataaactgatgtggtggctcacacctgtaatcccagcactttgggaggcctagggaggaggattgcttgagcaagggtttgagaccctgtctctacaaattatttttaaaattagctgggtgtggtggagcactcctgtggtcccagctacccaggagggtgaggcaggaggaatccctgagcccaggagatcaaggctttggtgagctatgatcatgccactgcactctagtctgggtgacaagcaagaccctgtttaaaaaaaaaaaaaaaaaaagtaacacatacatacctgttcacgattaaaaaaaaaaggaaaatatcctagagaaggattcagaaaaatggtaggctctcttatgctaccacactacttaaatcctttattctccccaaggacaggcctgtagagacactttgctgtgtacttccagatctttctgtattcatacatgcatgtgtgtgcaagcaaacacatgtacatgtgtatgcatataaagataaacatgaatatttttatttgcttacacaaatgggatcataccctatataaatttagatttagttttttaatctaatattatctgccatgtttattttcacagatgtatcacattccttatattaacaaataagcatttttattgtacaggtaaggaaacaggatagtaaaagtaagcctttatagaaactattcacaaacctacgtatatttagtcctaactattcagtttggatattataattcactacatcaatttctgcttgcatgaccaagagaacaggagagaagaatctctctaccctacttctcagagaatttgaggcttcagatatgctgcaggatgctcctgatggatgggtttttaagttttgttggtaccctgaactataggtcctgagctatgagagatacacagacaatgaaacactgtatcacttctctccaggcagagcatctaaggagaatatggaaaaacaagtcttaggtgaacatttgcagtgagctctggtaactcattccacatgctagaagggataaactggacaatgctgcctgtgagaaaaacaccaacatccgggatgtttcattccgtaaatcctgggacaactacaagaataataaaagctgaaaacctttccagatacttatttaaaatgattcatcagtttttagacatagttattcccattttaacatctcgaggcatcttaaaattaatggtgtctgacaggtggcacttgagacttacttgtctttgccttaaataatttattttcttatgctttccttttcatatatgcccaagagggaatgtgatataatttatatccagctaagattaaaagatatttcagtaagtgtaaaattttaatcctctgataaaaaaagtattgtcatagtttaactggcagcagtttttctctccagtggcatcttggtgtctcagattcaaagaaacttttctgtagcaattaagcctatttagcattatgatgcagtgatatatttttacagagaattcccattaaccaaattcaggaatatgtctttctaccttcaaagaacacctactgtgctccttaatgtgggtttaatgtagatgaatcgtgatctcttttgcacatgcgtgatttctttcagtacagtcttaacacagcccaactacttctaatgggtaagagttctccctgcttataatcaatgaaatgaaaacagctacagttcccataaacgtgtaaatgtttgctcttcaccacagaactatgggaatgttttcttgagattgttaaatatatgaaatattttatttagagagaaaacttttaccttagagcaaagagttcaccgattttctgcataacttcttcatgagatagtttcactttcttcccagcttttaaagcctagttgagagggaatcggaaaaaccaaaaaaccatgtatctctctttctaataagcattaggtcaacagggcaaaatctgaagtggcataatttggatcctatgtaaatattttttaggatggctgtctcccagattaatgtcttaactcaccttgaaatttcataattttattaggtagaaattgtatattctcttttttcatttcccttctcatcagcattttcaatgatatatacattcctaatctcttagtagaaaagcagggcctcctttccgaagtataattagattactctttcacaataaagacacagttaattacaatatgatgatttttaatgtatactgaaatttcaatataactttatatgtatttttcataccactatttttctcataatttagcaaaacactttcttaaatcaggaaaagtggtcataatttccattctcagagagaaacatttcacttttttctttaattcagttacattaaaaatactgcaactgacgggcatggtggctcgtggcctgtaatgctagaactttgggaggccgaggcaggaggatcgcttgagcccaggagttcaagaccagcctgggcaacatggccagaccccatttcaattatattaatattaaaaaaaaaatactgcaccaacagaggaaacaatttgaagttttaaaaagtaaaaagtaatcaatatgaagtttcttaatttgtcattttatatgtaactgggagttcttaagtttactgtagttttcttattgtttgtaataatgttgttgtactcctaaacaatcggccctctataagttctgcaactgcagattcaaccaactgcaaattgacagtattttgagaaaaaagaatggttgcatctgtaccgaacatgtacaaactgttttttcttgttattatttcctaaataatacagtataacaactatttacatagtatttacattatattaggtattttaggtaatctagagatggttgaaagtatacatgaggatatgcataggttatatgcaaatatataccattttatatcagggatttggacactggtagattctggtatccagtggggtcttggaacaaatctcccatggatactgatggatagctatatattgttatattgggaaattcatattttttacatataaaaatcaatccttgaataagcataaaattgatataattacctcaggaattgactgaatagattcaataaatttatccagtgatgcttcccaaattgccagttttactgggaaaaaaattaataatggaacatttctttatcatcatattcacatgtatataaaatacataattgcacagcatcttcactactatttcagtaatagtttaagaaaaagtactaaaaccttgaaaatataatttaagaatagttaattatcataaaggacagaattaaagtggatagaggaaactgaatcgctttccatgccctattggaagaccaaagctacatttagtagaactcttgattttctagtattacatcttggaaactgaggagggtagggtacaccttgataccatgggtagctctgcagatagggcgcgactaagactttcctggcctccccttcactcctcaggactaagagtaaacctcagaaatctccgaagcccctcagagtgggatggacaggacgctgcagcagccacctaaggtagactgctggcaaaagaaattcttaaagaacttgtatagttttattcgggatgtggatctttcagaacaaacttatagccactgtgactctgggtcccattcctatggaacactagagtatgtttttctacactgggacctgtgcccagtcacacaaggctgggcttctctgtctggattagagactatctaagaataacaatcgcatagagagaagagaaaaaaacaaaggctaatataatcatcatctaaaaaatacttttggagaggttaagctttattaatacaattaataaggaatgagtaacttcagcacagtactatcttttatactagatattttttctgatggagggaaaaaaaggaaaaggaatgctaaggctttgttgagtattctgaaaatataccaaaatcgtgactatttaaacttccctcagtgaaatgacaactgtagtaccctatcccataagcagtagtaacttaccagaaaggcatagagcattggagaaagcaaacttctctagaatggcatcatctaaatccagctctgaatttaacttgatttcccccctgtgaagttttgactgtcccctgtgaaaagcaaaaagataataccttctaaatcttaaaaagcactttaacttttcctttgaaaaagacaccatatcatctttctggaggtcattttgacaatttgtatcaagagtgttacaaatgttctcatatcctttggtccaggtaattccctttctaggagtttatcctaaggaaataatctaagatgcaaagaaaaatttgtatacaagaaaacttttttttttttttttgagacagtctcactctgccgcccaggctagagtgcagtggtgcgatctcagctcactgcaacctcagtctcctaggttcaagcgattctcctgcctcagcctccctagtagctgggattacaggcatgcgtaaccacacccagctaattttttttgtatttttaatagagatagagtttcaccatgttggccaggctggtcttgaattcctgacctcaaatgatccacccacctcggcctcccaaagtggtgcgactacaggtgcgagccaccttgcccagctgaaaacttttaaaaaaatggtcagtgttggctgggcacggtggctcacgcctgtaaccccagcactccgggaggccgaggcaggtggatcacgaggtcaggagattgagaccatcctggctaacatggtgaaaccccgtctctactcaaaacacaaaataaaattagccgggtgtggtggcgggcgcctgtagtcccagctactcgggaggctgaggcaggagaatggagtgaacccgggaggcggagcttgcagtaagccgaaatcacgccactgcactccagcctgggagactgagcaagactctgtctccaaaaaaaaaaaaaaggtcagtgtttaagagtaaaaaattaggaaataaaccaaatgttcagtaggggttggctcagtaatagtcactccacacaagaaaaacttaaaagtgtgttttggaaggatagttaataaaaaggagaacgttcacagtaaatttctatgtgaaaaaatgctgcatataaaactatatatggagtgtaatctaaaatcacactgacatgatggggttggggagggaggcaaggaagttgtgaaaaatgagtatgtgactgtggagaatcctagacaggggacaggggaagagcggaatgtgtgaatataaacatcacaagcaaatggaaaaaagacagggtaaaccttcacaaaagatgtcagacaagaagtgacggccaaagggagggggacaaggggcctgatggagggcggcatctgctatgacagcctcagatggaggaaggaaagcaaagacagcagtcacaagaggtctttttttttgagacggagtcttgctctgtcacccagactggagtgtagtggcgtgatcttcgctcactgcaacctccgcctcctgggttccagcgattctcctgcctcagcctcctgagtagctgggattacaggagtgcaccaccacatccagctaatttttatatttgtagtacagacagggcttcaccatgttggccaggctggtcttgaactcctgacctcaagtgatctgcccgccttggcctctcaaagtgttgggattacaggcatgagccactgtgcttggtcacaagatgctttatgagtaaactgggcccatgccacagagctgagcagatccctggaatcatggcagaactcacataataaccatgtaggtggcagccaggacagtctttctgacgaaacaaaataactgactctgggatcctaagcactgaggattttactcctcacagactgtacagtaacgtgtgtgtgtgtgtgtggataagcgtacacacacacacacacaagggtctagcagtagttggatatggaagtatttggttggtgcaaaagtaatcgcggtttttgccattttaatgtaaacctaatagaacacagaaaggggattcacaggagctgtatctgcaggccaagggctgagtaactactaaagataataaaactacaggctgctcatttgctgtctctctcaggtttatatccttacctctgactgcagccaccactgggctcaggctgactcacagtcaggtgccctttggcaagacaggattcaataaatctcatcggaaagccagttagctgcaattatagggttttccccaggattaaatgaaataatacatggaaggcacttacttagaaaaccgtgactggccctattggtggtgagcgctgattactcagctcttatccccatctggtctttctatagctagtctctgtctctcttccaagtcttcccaaagctctgcttttaacgctttttttttttttttgagacagagtctcactctgttgcacaggctggagtgcagtggtgcgatctcaggtcatggcaacctctgcctcccaggttcaagcaattctctgcctccgcctccgcctcccaagtagctgggatcacagacactcgccactatgcccgggtaatttttgtatttttagtagagatggggtttcgccatgttggccaagctgtcttgaactcctgactcagttgatcctcccaccctggcctcccaaagtgctgagattacaggtgtgagccaccaaatctggctaacactacctttcttaagaacctgcaaagactcatatttcactagacaggtaactccatgaggaaaaagacactaccatcttgttcatactgcctctgtctcggccctaacatctcttcattttttccctctggctgagtcaggaaaatcagctagtctgttgcctacccatttatcttagtgaaactggtacaccaggtcccacttcttccagcacccacacttctacaagtgggtctcttagattgacccctcactatacttccttttcatacccccaccccccaaaatcaataggaaaaaactggattaagagaaaaatttactggaataatttgataggttcatttgataaatgcatactattttattggattaggctgattagaaacttaacatttccattttggggctatactactgacttgttttaacttgtggatagcctgagaagttcaaaaaattatgtttatcttctaatatttattatatggtttagactttgtatttgtaccagtaatctttttcctctttttttttgagacggagtttcactcttgtcaccctggctggagtgcaatggcgtgatctcggctcactgcaacctccgcctcccaggttcaagcaattctcctgtctcagcctcccgagtagctgggattacaagcacccgccaccataaccagctaatttttgtattttttagtagagatggggtttcaccatgttggccaggctggtcctgaactcctgacctcaggtaatccacctgcctcagcctcccaaagtgctgggattacaggtgtgagctaccacgcctggccacttttttcttaaaagtaagtttccaggccaggtccagtggctcacgcctgtaatcccagcactttgagaggctgaggtgggcggatcaccaggtcgagatccagaccatcctggccaacatggtgaaaccctgtctctactaaaaatacaaaaaattagctgggcgtggtggtgcacacctgtagtcccacttactcaggaggctgaggcaggagaattgcttgaacccgggaggcagaggttgcagtgagccgagattgtgccactgcactccatcctgggcgacagagtgagactccgtctcaaaaaaaaaaaaaaagtttccatatgcataataatttgtctcctctattgctttacctaatttattccaagtgcccctttcataaatttgatgaaaagttgcttactctatttttatgtagttaagttcttcattttcccagtgtaccagtgcgatttcatagggctgaatttcatgtttttctagaactttcatcacatgcttcatctagaagaaaaggaagattaatctgaaatcataactgactccctcagttcaagtatgttatgattttaatgcttataacagtcttcattacacttacaggcattatttctgttgcatgtttttaaggaaaaggcaaatcaaatccattgtgatattaaagtaatcaggatgacatgttcatttgtttttacatttggaaaacacagatgagaatggagaagaaaatcaaggttatcattatcccacaacccaaggaaaatcactagtaatattataatttgtattctttaaatctctttaataatcccagcattttgggaggcagaggcgggtggatccttgagctcaaaagttcaagaccagcctgggcaacgtggcaaaatcctgtctctacaaaaaaatacaaaaattatctgggtgtggtgatgtacacctgtagtcccagctacctgagaggctggcttgagcctgggaggtggcggttgcagtgagccaatgtcagccggtgtgacagagcaagaccctatctcaaaaaaataaataaataaaaaataaaaagtaaagcccaacatactaataaaaaattaagccacacaggtgtgggaggtgatcatctctttctctcttctgtactgaaatcctaatccccagaggcaaccatgattaaacttggtgcatatccttccagactttttatgtgtatatatgtacatatttatgctgctttttatgtaaaataggatcatattatgcacatgacattttcaacactattttcctttacagacgaactgcaatttatttaaccaacctaggtgtgtcctccatggggaattttttctactctccattacaatgttgcgatgtgccacacttgtgcaaaggtcttcatggctttgtgggaatacttctttaggaattgctagatcaaaagatatgtggacttacacaatatgtatatatgtaacagacagggtctcaccttgtcacccaggctggagtgcagtgatgcaatcatagctcattgcagcctcaaactcctgggttcgagcgatccccctgccttagcctcccaagtagctgggactacaggtacacactaccacacctggctaacttctaaaaactttttgtagagatgggatctcactgtgttgttcaggctggtctggaactcctgagcttaagtgatcctcccaccccagactcccaaagtgatacgattacaggtatgagttaccacacctggcccacacttataatattgctagcctgctctccaaagtagtttttccaaatgtagaatctcaacatttatgaaactactcttaagaaatggggtttatcagccttttacatctttgcaacttcaaatagccaacttgtattttcttaaatttattggtcatttatattttcttttctctaagttcccttcccgaccacctactgtgtgtgtttccttttcgtaaaattgggattgtataaagcatgttttttaaccagttctgagattatattggttatattttgtaacccgcttttttttttttttgaagacaagagtatgcctctgtctcccaggctggagtgcaatggtctgaccttggctcactgcaacctctgcctccaaggtttaagcgattcttgtgcctcagctacccgagtagctgggattacaggtgtgcaccaccacgcccagctaatttttgtatttttagtagacatggggttcaccatgttggccaggctggtctcgaactcctggcctcaagatacctgccggccttggtctcccaaagtgctgggattacaggcgtgagccaccatgcctggccgtataatctgctcttttaatgtaactgtattatatatataggcaatctcccagaaatagatatttttttacatgatttctaaggggatctatagtatatctgtagtatatggatgatttaacaaactattattgtgtattttggtaatttctaatttttgccattataaatattgctctgatgaacatttttgtacaaaaatcatcacgaatagttatgattatttcctttggataaatttctaggtgtaaaattactgggttaaatataaagctttaatgtagattaccaatttgcctctaaaatggttgtattaaacaaatcttgatttggatcttgaaaaaattatttcccatgagtagtaagttctagacaacttgacttaaaagaacactcaatgcaaccagcttccaattaactgcatacattttgtatagtacaacatgcaaagtctacagtacttctgtctgcagtatagttaggatggttctgattctccacaaattagtgtgtgtctagagaaaggaaaaagcaggaaatcttaacccaaaatacaatatattttggaagatgaaactgataagtatcatgtaatgcagagcaaataagttgtgcataatctattaatttcccttctaatgtttcagtatgtgctaattaacaattcattctcacaaaactaaatttttatattttcacatttttatttacacttacagttttgtctttcacattccaaaacacagcagctccttccctgatttaaaaaaataaaagaaacaactaagatacagatggaatacattctttagggtcgtatataaaaccatgtaacttctagaatgtatacaggatgcgatttttcaaaatatgatggtacttactaatttgatattatggtccttaggtgaacttcctacaataagagctaaaataaaattcttgataaaacctgacctcctcaaaatttatgatttctcacatggtttgccaaacaaatagccattattgtaatactatataacttcacgtatgtagactctttcatacctggttcaattctgatccacagaaatcagaataaggaaattttttgagaccttgtcttagctctcattaggcagactctactatgtgcaaggaataaagggctatgcctggatttttgtggaataaagagatggtggttaatttaagcatcagatggttaaaggcctctatggaataatgctccccacgctcacagtgcttggaacagaactacagtgacaccacaggaggccctctgaatccgattatggctttaacattatttagggtctaaaactacgaatgcatttgttttgatttctcaagtttgacgtgttgaagctgtttcaggtagtaaataaaaacaggagctatagctcagggtcagtgcactggaggaaggaaaggaggaaataaaagaaaggtaaaaatattaatggctccacgttattcttgaaacatttctaaagtacttagtatatgtgtgggtccatgcttagtatttgtgatagaaacataagtatgatttcattcctatcctcaatctagaaaagactgggactgacacttagaccaccaattacaatagtgtgtgatcagtgctacaagagtatgcagagtataccatgagatgtacaccagagggacccctttgctaaaggactagcagaggcagccaaatgagaaaacaagaggagacaacatagcagaggggacacacaggctcagagaggaggtgggacggagcagagcagcatctcagaataaacagccagtagctgcgtggctgcagatgtggtcaagcagtgggcaagcaggataaagaggcaagcaggggacaatccagaagggaactttatgcagtgatagagaatttgttcatagtccgtggaaatttaggcaggagagtgtagtggtcagaaatggccactgaagaatgaccctgcttacaatagacaaacagactggtggtgggtgagcaggcaggcagggagacaataagctgttacaataggcagggataaggtttcaggatacggatttgagaggtatttcaagccacagccacagtatcagttcagagaatcccttccaggcagaagagaggtctggtgaactgcatattcctccaaccagaggaatgcactgtgctgtgcaatgtggtactcagaggccacatgtggctattgagtgcttgaaacatgcctggtgcaaactgagatgcgctgtaagtgtacaatacacagcaaaattcaaagacttagtatgacaagtgaaaaaatatcattattaattacatgttgaaatgataatattttagatatgctgggttgaataaaatacattgttaaattaatttcatgttaatatgttaagaaacatatttgtgttgttcaaaattaattttatctttttaaaaatatttaaaatgtggttactggaaaatgtatcattacatatgaggcttgcattatatttctttctttctttttttttttttctttgaggcagagtctcactctgtcactaggctggagtgcaatggcacgatctcagctgaccacaaccatcgcctcccgcattcaagtgaatctcctgcctcagcctcctgagtagctgggattacaggcaccctccaccatgtgcctggctaattttttgtatttttagtagagacagggtttcaccatgttggccaggctggtctcaaactcctgaccttgtgatctgcctgcctcagcctcccaaagtgctgggattacaggcataagccaccgtgcccagccgaggcttgcactgtatttctgctagacagtgctgatgtagagtccctcacaaatctaaattcctcactcggaacaacagggatgctattactctacttgaattaaatgttggaatcttgattctctctaaagatggggtcaaaaggaaggtaggcattgaaaggaaaaaagaacttccacttatcatcaactataaggattatgaccacaagaactttactcaactttggattcctacagatggtccatgtgtttctgttctgtcacgtattagtctcatgactatgggtaactcaatccctatgaccctcagtttcctcaggtgcaaaatagaccttcatcggtgtgctgaggataaatgagattatttcacacggttctatcatgttatcattcccaggcagctactgtggagtatttagtattgagtcggcctttagataaaaggaataagtgtgtatgtgagtctcctagtctaaaacctctggagaggtaagctaaaactttaaagagctaccaaaggggaagggagaaaaaaaagaaaatggcaagaagagacagcagggaggtagcgggagtttccctggggcaggagtctgacaaggggcactaaagatgaatgggaaattggctgctttccagaaatttagtccatgaaaatccgaatttacaaagaaagacaccccggggaagatcattcacttgtttgaaatattctttactttataagagggtttaccagagaattcctaaaagtgacaaactctcctagattaaataagaattaaatgataaatttaaatcacaaatacattttgaacacatttactgttaagaaaggtatgcctgcacctttaaagaccacaattacttgacccaaacccatcatcacctaatggggtttctttcctgtcttacctgaagaagaatattgttccaggatcaccttcttttgcagaattttccacacccatcaccaaaatatttgctgcatctgtgatttaaaataaacgaacaaaaaagctatgtcaaggtaacacaagttgtaagagtcacctataaacactgtaataaagtacttaagatcatttctttatataccatggagtgctctgtaacacaatcaccatctttctactaaggcctctgaaaggatttaatatataaaaatgcaaatacgaccaccaaaaaaagatcagcaattacttttataaaacattcaacaacctgtgatattaatattagagctcattcatgcccattttgattcaataatcactagtccagataattaataaagtcttaggttccatacaactaagtgtcaagaattaaacttctttctacaaaattaaaaataaaatttgaagaagtattaatatattctcttcctataaataccatttcattaataatgcaattttaacattcccaaactactactcctgctgaattttaaagtataaaaagtagggcaatagaaaatacacagaaataaagatactgaccacttcaaaacatatgtgatttcaaggttaatcactacaggggctaccactgcagccacctgcaactatttaaaaaaaaagttttttttttgtttgtttgttttttttgagacagggtcttgctctgtctcccaggctgaagcgcagtgccatgatctcagctcaatgcagcctcaacctcctgaactcaagggacccccccccgccccacccacctcagcctcccaagtagcttagactacaggcatgtgccaccgcacctggctaagtttttgtttatgttttgtagagatgaggtctcactatgttgcccaggctggtcgtgaactcctcagctcaagccatctgcctgccttggcctcccaaagtgcattacaagcatgagccacggggcctggcctaagtattgttaaaacatatactaatataccaatattcatcataagaagttgctttatatattagtatagtgatatttatcataagcatatattccataatataaattacaaccaatgttaatatatcaattaaaaaatatactattaatttgcaaaaggttgtatgtcttaacggaattaacataaaattaggatcctcaaagcttcagaaatttctggtaaaggctgggtgatgggcaattcagacacagaccaaaactgtgattttttttttttttctaaattgttaattactacatcctacataggacagagtttgcctacacagccaaaagcaaaataaaatcgactgaaacaacccagggcagtgaagcctgcaattctgtgaagcacagaccacacagctggcagccttcagcatcagccaacaatacctccaggcaaattttcataccaaggggctctagacatagctctgtctttctaagtcaactatgcttgtttttgtcacctaatcacacaaacggtctgtttggattatcacaatgatatttcaactatcttctatgggattgagtcttaagaatttccactgttataggaaggctttcaacctatttttgctactcttaggtaaattaataaatgttctgggtattgagctatcctgagtttcactgtaaaagtttatcaaaatgttctaagtaacttatttatttttgagacagagtctcgctctgtcacccaggctggagtgcagtggcacgatcttggctcattgcaacctccacctcccaggttcaagtgattgtcctgcctcagcctcctgagtagctgggattacaggcacgtaccaccacgcccagctaatttttgtatttttagtaaaggtggggtttcaccatgttggacaggctggtctgaaactcctgacctcaggtgatctgcctgtctcagtctcccagagtgcaggattacaggtatgaggcatcacgcccggcctatttatttattttttaagacagagtctcactctgtcgcccaggttggagtgcagtggcatgatctcagctcactgcaacctccaccctccaggttcaagcaattcttgtgtctcagtctcccaagtagctgggactacaggctcgtgccaccatacctggctaatttttgtatttttagtagagatggggtttcaccatgttggccaggctggtctcgaactcctgacctcaaatgatccacccacctcagcctcccaaagtgctgggattacaggcctgagccaccatggctggcctaaattatttttaattaatgtaaagcaagccatttctcaagaatccttcctgatttcaccataaaaatcctcaattaagttcattttaattttcttctttttcatttttatcttctaactaatcgttttattattattattatttgtatttttagtagagacaggggtttctctatgttggtcaggttggtctcaaactcccaacctcaggtgatctgcccgcctcggcctcccaaagtgctgcaattacaggcgtgagctactgcacccggctaactaattgttttaaagtattagattgagctggtaaattttttttttaaaggctctccccatgtctatcaacttcatggttcttctataagactaaaataacgggctgggtgtggtggctcaaacctgtaatcccagcactttgggaggccgaggcgggaggattagatgaggttgggagttcgaggccagcctgaccaacatggagaaacaccatctctactaaaaatacaaaaattagccaggtgtggtggcgcatgcctgtaatcctagctactccggaggctgaggcaggaaaatcgcttgaacctgggaggcggaagttgtagtgagctgagatcgcgccattgcactccagcctgggcaacaagagtgaaactccatcccaaaaaacaaaaaaaaaaaaaacacaaaacacacacagacacacacaaactaaaataacttcttaatgtgctagaaatgaagtagtatgacctctgaccacctcaagtaataatgatcctataaataatcttaataaatcatactgattttaatgagttctctgtaaatacattttaattcttaactttgtcatctttataaagagattcaacatccacttttatgatacaatcctttcaaaagaaaatgaattgcaaacaaatacatacttaagatagtatcataggaaaattatccaatacattttaacatacttggccccaggttcaagaagaagtacctctaggcaagcttgttacttcaacatatccgtgggaggccagatcttgagacagatttcccagatgatactcatctgccgttgcaaatgctgtgcagtgcattaggtcctgttccagggaaatgagcataacatgggttaccaagaggctgaagcatctgtgacggctgctgagcaccctactggactccattctgcaaagctagaactccagaattttcttcaaacatctccaagggtgatacaagggatgggatgaagatgaagagaatgaagttactgggaggcaaatttcagctcaatcttgaaaagaacttgctccctcccgccaggcaaaaagatggaatggattattctgaaagggaagccacactcaactggtagtatctcaagcacagattgaatgcaaaatagagatgattaaggcatcacatgggtgactggatggaatgtttaagtctctccaaccctgagtttccatgactctttttcaaagcaacattagtatttgaggtcatttcctaatttgtaactactcttgtacaggcagattcctttaaatccccaaaggaattacagtatttttacactggttaacatttaacaaaaaggtctgtaaatctgagcatgtgtcttggtttggtttgtactttgtctcatgccccatcttgcctttgcacacatgaggaaagtcatcttgtgtctatataaaatacagatggtaagcactatggctcaatgctgtgttttttcaaactgtaagtcacaacacattagtgagttctgataccaatttagttggcccaaaacagcttttttaataaaactaaatagaaaatattacagtgcattattcacaggaaatgctattttatgaagttttctgtcacttacatgtatctatgtatctactctaggtcgctatgtatgtaaaatgttaaatatatttctcactataagatgtggtcaataaagtttgaaagctattggcataagagttaagattttaggcacagaagttggttacaattttaaaagagtatcagaataacaataatgcctactttatggggttgttgtaaagtttaaataagctaataaacaaagtgctcaggactgtggctaacacaactgttcagtagttgttagattctagttggccaaaacaagtttatgagtcactaaatcaacatttattcttaggatttactcctctcagctccccaattctttcccattctgtatattcctggtatgaaattctagagaagtatatattaattcattccttcctcccacctccattctgtatctcctggctctttctcatgaaatggcctgaccccatttgcccttcctcaatctgttccacagctctgatgcgtggtttaaaggtagaggaataacagagaacctgaggatccatgcaaactgaaaaatccaaaatcaataaagtatctactcataaacaaaatgagactaatccaattagaaaaaaagtcagacaagctgaaattactggggaatgtggggataaatggatgtagtaccctaattatgagcagataactgctaattccttccaaattagctaattcccatagtcacatatgaaagtaggaacacggggatatacaaataaaaatgtatcaggagttaccagagtacagggaacaggcacgtgcttaaggtttagacctgtgagcactagttctttttaaggcttcatggagttaaaactagctgatgtacgatgtgtgtaaagattcggccagctgaaagaaaggaatcctagcaaggggcatcaggcgagacatcgggtaggctccactctgcaagacctggcaaattcactcaagcttgctaggtgaaatcacagtacattaggttggatgtcagaattacttctgtgatggctacagctcatgtgcttagtttgggctgaagtgggaagagcaagaggcacaaaaaggagataagcaggtcacaagctagtccactgaaggatcttcctgtagctgtactgaaaatggcagaggctgtctcttttgctagaatcggagttgtaaactggcagctcggagaaccatccaactcaagagttgacctacatcacgtttctaaaattcaaattgacttgtcaacaataaactgagagatttcacacaaaatccagatttccatcatcatctgaccgagtggaagatctggctataataatggactaggatagagtaggggggcccagggtctccagcccacactgtccctgcctctccctgttgtctcacgtctgcttcaccatcatgtggtactggccaagcccatctgcactaagaatgtgtactacttttttttttttttccaaaaaaaacccaaaaaccttggcaaggcccaatgactcacgtctgtaatcccagaactttgggaggctgaggcggatggatcacttgaggtcaggagttcgagacgagcctggtcaacgtggtgaaaccctggctctattaaaaatacaaaaattagccaggcgtggtggcacacacctgtaatcccagctacttgggaggccaaggcaggagaatcccttgaatccaggaggccgaggttgcagtgagccaaaattgcaccactgcactctgggcgacacagcaagactccgtttcaaacaaaaacaaaaccaaaacacaactttatgttcctttattggagcaagattctagattgatatacagtgatgtattaactaaacagagacctgtgcagaaattacatactatctatgtagacaggttgttatacttcgcctattgatggaatagttccatttatcaagttttatacatcaaaaagctttgaatttcaccaggctctccattaattcacctctgaaaaagtggcatttaatttcagctactatagtttacagcataaaaagcttatgcatgagagtgcttctctgcacagtggcatgttgcagacagagctgagtccattatcccacccggatttacatttgagagctttataccagagagccaggacaaaattactcctaaccaacacagacttcttactctcagagcctatcttcttggctatattttatagtgccagtgaagacatgctggcaactgtcccatatacagcttggcattagagtacaaggtctgttaatggcggtggcaggcattattattttattctgttttttactttattattattatatttttgagacagtttcactcttgttgcccaggctggagtgcaatggtgcaatcttggctcatcacaacctctgcctccccggttcaagcgattctcctgccgcagcctctcgagttgctgggatcacaggcatgcgccaccacgcccagctaatttttgtatttttagtagagacggggtttctccatgttggtcaggctggcctcaaactcccgacctcatctgatcctcccgcctcggcctcccacagtgctgggattacaggcatcagtgaccgcacccggcctatttattattttttgagacggagtcttcctctgtcgcccaggcgtgagggcagtggtgcgatctcagctcactgcaacctctaccccctggattcaagtgattatcccgcctcaacctcccgagtagctaggattacaggcatgcaccaccacacctggctaatttttgtatttttagtagagacggtgtttcttcatgttggccaggctggtctcaaactcctgacctctggtaatctgcccacctcggcctcaagtgctgggattacaggcgtgagccaccatgcccagccaggcactattattttaaatcaaggtaaaaggtcagttttaaaaaccgccacttggagataaaaataaaaggctcaatatattcagaactgagttttgggcaatctggtatcccaaattatgtgaatattccgacactaacggcaaattgagaatgtgtactattttcaactctcaaggacaggacaagtcaatcactatttttatgagaaaatatattctaagctccaaataaattatgaataaatctttaaacacaatctgttttcacttggccatcctaaggatctttgttgtaggttttccagactgtcaactgtcccctttccttctcttgggatctcccatttagtttggctcaaagttctatccaatgtcactcagcttatatggtttgctacactactttctgtattctccttaaacttcttagctctgagtcttagttgtgggtttcttctattaatagatgaacttgacgttttagacactttgttttggttttgttttctttgctttttttattttagcctatttggtaaaaggaaagagaatcatggaatgtcttgtctgcttttttttctttattaaagatgctgttgttttctgagcagctttcatttttatacatccttttctggatttttacagtgaatccttattaagcattagctacatatatatgtaaagcatattttgggtttcaggatggggatctacaccttcctgttaaatagatgtgtcaaaccaaccgataatagttatgatattcagggcttttctacttcaaaatgttttaaaaaacccaaaaagcaaaaaccccaaaccactgtattttagtatgttttgtttttctggccaaagaagacatgttccagcagatggggctagaaatctacatatgattcttgttttaggagcatcgcatgctctgatcagaacatttttttaaaaattatactttcatttacactgtattactgaagaaaattagtgtgttacagcaatgttgcttctatagtgatataatacatttacatttggtctttgtccttggttcccagtacagactcctaaaaacccctgtaattttctaagtgacaggggcatttttggttgtagtatttgctctttgccttcagttactaacacagagcttctaaaaatcccttggaatttcacgagtgatgggaacatcttttgttttaatgaggtgactctcagtgggtcctggacagcttcaggatggggggtggttaccagaaagaccaaactttgattagaagcttagaactttcagcctcacccttaacttctggtggacggagaggggctggagattgagttaatcattaatcatggcttacacaatgaaacctccattaaaaacacccagatgatggggtctggagaactcctgggttgatcaatgcatccatgtgccaggagggtggcacagcccagttctatgaggaacagaagctcctaagttccaggcccttcttgacttcactctgtgcacctctacatctggttgttcatttgcatactttatataaaaaacccagtaaacataaataaaatgattccctgagttctgtgggccattctagcaaataatcaaacctgaagaggggatggttgtcatagagctggttggtcagaagcacaggtgtcaactgggagggcagtcttgtggggctgagcttaactaactggcgtctgcactaactctggctagtgctggaattgaactgaattgcaggacaccttgttagtgtctggagaattggagaactggctggtaggaggaggaagaggtccccatatatttgatgtcagaagtactgtgagtagatagatcatactaaggaaaaatgccttttctcctgtaacatactgattggagattaaagctataaaaacacagatacattttacgttaccaagatcacgctttatcctgtaagtttttctgactacaacctataaatcattaaacatagtacatatacacatatatgcttacacaccaattgccacaaaagcttcacaaaccagtatttacgtttatcatgagcaatgtattctgttattttctattctatttcatttttcaaaaaaatggttaacagtccaccagtgattctgtaacacagtgctattagcctgaaaacattctccctggtgtcgggctccatgccactcagacctgccgttcccatcctctgctgttctcttcaaagactggacattaacaagaagcactgctattattgttttcttgtttgtttagtgacagggcctcactctgtcgcccaggctggacggagcgaggtgcagtcacgactcactgcagcctggaaccctggagctcaagcgatcctcccacctcagcctcttgagtagctaggactacagctgcgcaccagcaagcccggcttttttttttttttttttccaagtcttttagaaatgggagtcttgctatgttgccaggctggtcttcaactcctggcctcaagtggtctttctgtgtcagcctcccaaagcactgaaattataggcataagccactggatccactattgcttttaggaattgtaagccaaagggatgtgggttgagtatctcagattatgatctctgaaaatgagaccaggtaaagatttaattccaacagacagggtgactgaaacctcattcagccaactccagatgcacgctgttctgcagagctgaaaagatgagctgggtgcaactatgggaacaaaataaagtccacatgctttctgacacaaagcagagtcttttccttgtctcagtcaagaatggtataaagggtttaccattttgatggtataaagtggtataaagggtttaccactatgatggccgtataaaaatggagtggccctcaatttcgggcagaggaaagtcagtctttggtcctggggacatattacctagtcatgccaagactgctttctctatgaaaagtaaaatcttcaaaaaatgatgttccaaaattacattatctcagaccactttagaaacatgattttcttctctttttttgagacagagtctcactctgtcacccaggctggagtgcagtggcatgatctcagctcactgcaacctccacctcccgagttcaagagattctcctgcctcagcctcccgagccgctgggattacaggtgtgcaccactacgcctggctaatttttgtatatttgtagagacagggtttcaccatattggctaggctggtctcgaactcctgacctcaagtaatcgcctgcctgggcctcccaaagtgttgggattacagctgtgagccaccgcccagccagaaacatctgattttctattatttccctgtgctttcagaaagacagcatgcgacttgctcttgccaaactccaactgaagtcattgtctatcatgttacataatgtctcctataacagaatccatgaaataactaactccttaatttcagtgctggaaaaagttatttctctgaagatatttttatgtttttactctgccctctcccacaacaataaacaacaaacactaaatcccaggaggagttcctcttttaattactgcgcttctcaaaacaaaatgttcaactagattattcatttcaggtacttcataacatttctctgttcatgtcaactatttgctctaatatgtgaaagtatttattatctcatttgaaactatgttgaatgttgaaaatctacttcaaattctttcctggaaggaagtagaaaaaaaaatctaaagaaaaatagatacggtatttaggaaaattgcttccaagtctaaggatggcccaaagaaatagcctagggacatctctgacctatcagcttcttcctaagaaacctgatgcactgtgctgctagacgttacaaatgaacaaagtgagttgagctttctcttttttggagctgccatgaattcaggtttttacacttaatgccatctcggacacttaaatactgaatttcccaggttaccccaaagctccagcaaaaggaaaggggaaacagtagctgcacaacacttcatccttcacgtcctgagttcagagtaaccacacaagaattgaaagcattccagaatccaacacaaaaaccattcattcattgctagattcagaatcagaggatgagtaaaggtatgtatgtatacctttccaaggggtgtcagctgcacagtaataaaaacacagccaaaatgaaacaggctcaggggctacttttcagaatcaagacttgaagacagacattctaacctgttttctgatagattcagaagtcttcatcaagtttaaaatatctttaaagttgatgactatcggcattaaagatcctcttataaacatttaagtacaaggtacagttctaggtattatgcaagatacaaaggttatcaagggcttgatcttgacccttaagttgttactgaaggagaaatgcaaattgtagcagaaaaattcccagaaaccccttaaggatgaataaaaaatacccccttaaaccttaagaggataaaaaagctgggccctcctctcctgctgcttttggagtccaccctaccgtgtcatttcaccgccccatgcaactgccacagcctaataaaggcttatctgtctgcagagttacaattttttttaacttgatgaagaatttctagtttgtttttttttattttatttttttttacagtcccattcttagactggacttaatattggtcctctttttcagtttccttagaccaataaccaaatcttttataaactctattttcatgtgttatcacctgtattttgtttttatatgtatcattaattgttaaaaattaagattctgaatccctttggatatttattaggcttcaaagaccttgatgaagaagtctgagtgactgctagttctcttacgttggcggtaaggctggggtgcaacgcacactggtttagcatgagcaatgatcactaagcacgagagccacggccacccctactttacctcgttcacagacagaactggaaggttggtcctggatggctgtctggtcctggatgcttttagtggtctcttcacctgtgggaagtcttgttttggaacaaatgtttccgttgatacagatgagaaatgcctctttaatatttttataaaccatttagaacccaacagatttggtttgtgggtcactctcctgtgagtaccaaaggatttcatggttggaaggtgtgccttttcatcttggcaacgagcagcatttaatggagacagcatgctggtatctgactttttttggttcatttccaggatctgagacttattcaaaccactagctgttttatcaggaaggaacaaatccaagctttgacgtattgtcagtgtgctgcatgttgtattttcaaattccttaagtggttttaacattagatgaccgattcttcggcactgatgtgcttttgataatatatgatgagatctggccacggctctgaggagtgtggctggcattaccacatcccaagctaaaagaaaaggaattcaaagttcaagtttttaaattaatgtttaaaacatatataatatttccctaggtagcaggcatatttctgttagaaaaatttgtaaaacagatacattctaagttaattctagtaaaagaacaaggttaaaaatataagtacagtgtttctgccactttgcctttagcaacatttggccttcttcctggaagattacaagattataaagctactgacataacaagaaccttaaaaaaaatagtgatgggaccacttcatttacttcattagcatatcaagtatataaaaatctgtgctggccaggcactgtagctcacacttgtaatcccagcacactgggaggctgaggcaggtggatcgcttgagtccaagagttccagaccagctgaggcaacatggtgaaacctcatctctacaaaaatgacaaaaatttaaaaattagctgggtgtgatggcagctcatgcctgtagtcccagctactcacaggctgaggtgggaggatcacttgagcccagaagactgaggctgcagtgagtcatgattgtaccactgcattccagccctttttctgtctcaggaaaaaaaaaaaaaaaatcaggaaaggttcccagaaagatctaagctgattctagaaggcgaaggtgcttttcagcttggggctgggcatgggagtgcgaggcatgtcagatacacacatgaacattccagacaaggtaaacagaatttcccccttatttacagtatgaaatgtgttattttaaagttagcctatagtaggccacacatggtggctcacgcctgtaatcccagcactctgggaggctaaaggctggggggatcacttgaggccaggagttcaaaaccagcctggccaacatggcaaaaccccatctctactaaaaatacaaaaaaaaattagccaagcatagtggctttaatcccagctactcaggtggctgagatatagaatcgttcaaaccagggagggagaggttgcagtgagccaggattgccccactgcactccagcctgggcgacagaatgagactctgtctcaaaaaaaaaaaaaagttagaccgtagtaatcaataattctttttttaaaaataatatgttaggtgctagagatagatgaatcaatgatctcagaattcaaagtctagcagaggaaaatgaacgagatgcacaaattgctctagtccagagaaaggagcatgtgaagagtgtggcattgtcacagaggtgacatttgaactgagtcttgaaagggcagaaggatcagcaagttaaacaccccaggcatggagtcctattcatctccccatctcggggaggtaggagtgagctgcaggaggtaaggaccaaaagagccgatggccagatcaccaaaggatatataaagtcatcctaaaaagtttctacaggtggggagaaagctgagcttttaactcagagtcacacggtcaaatgcatgttcatgaaacaaatttttggtgatgatatgtaggaggaaacaagacagactctgacatcactctgagcgctttctacatgctaagtgctcggcttcacctcataatgatcccatttcactgattaggaaactgaggtttaaagaggctaagtgctcaccgttaagaagctgcagagatgtaactaaaataaaacccaggctttcccaattccaaagtcaacactcttacccactaccttgtatttactacctctcttcaggataaggacaaagatgattcacagtgatatttaggaggtagaacctgctgcttccaaaatcccttcaaaagctcgcattctgtgcttcattctagtccaattggctactgtagttcacctttaattagtactatgccatgccagttgaaccacttaattttgaagaaactataaaatattttagaagtttgtctacagtcctggattctttttattctctttgagtaaattcttttttttttttttttttttgagatgggagtctcgctctgtcactcaggctggagtgcagtggtgccacctcagctcactgcaacctccgcctccccggttcaagcgattctcctgcctcagcctcccgagtagctgggattacaggtgtctgccaccatgcctagttaatttttttgtatttttagtagagacggggtttcattatgttggccaggctggtcttgaaatcctgacctcaggtgatccacctgccttggcctcctaaagtgttgggattacaggcgtgagccaccggacccagcccatttttatcactgcaccttctagaaagcctaagattacatttgtgccttacactgtttttctatcagacagggccctattgtcattatcaatacatcggacctcctcatctcagtttcatccattttactctctaagcaccacctcctatctttgcatctcactccttctattacccaattccaataattcttcaaccccaacaggacccacaagtcaatgatccaaccaccttttcactgtctctcactccccatgacttcacttcctccatatccagtttacactccatggtctaccattctaacctctcccttatacccctagaatcccttgcatccctttcttcccagtctttcccattcatgagcagtaataagtatctttataactgctaagccaaaaacgtggggtccagcttgactctttattctccatatccaacttctcagtaaatcccaagggccttctagggaccactgctcatcatcagtaataatactacctgatccaaactgctatccttcccatggattattataatagcttcttaaccagttttcctgattctgttttgggccccctacagtttcttctcaacacagcaaccaaagtgatcctttgaagttgaatctcaacgcgaaatctagctgtggcttcacggttcacttaataaaagccaaagccctccaaccaggcatggcggctcacgcctgtaatctcagcactttgggagggatcacttggggtcaggagttccagaccagcctggccaacacggcgaaaccccgtgtctactaaaaatacaaaaatcagccgggcatggtggcatgggcctataatcccagttacttgggaggctgaggcacgagaatggcttgaatctgggaggcggagattgcgccactgcactccagaatgagcaacaaagcgagactctgtctcaaaaaaaaaaaaaaaaaaaaaaaaaaagcctggcgcggtggctcacgcctgtaaccccagcattttgggaggccgaggcgggtgattcacaaggtcagatgttcgaggccagcctggccaacatggtgaaacctcgtctctactaaaaatacaaaaaaattagctgagcgtggcggcgggtgcctgtaatcccagttactcgggaggccaaggcaggagaatcgcctgaacccgggaggtggaggttgcagtgagccgagatcgcgccactgcactaaagtctgggcgacagagtgagattctgtaacgaaaaaaaaaaaaaaaagctaaacccctcagaatggcctgcatggcactacattatctgtcctttatcaccactttgacagcactctcctttgcttattttgctcctcattctggtctctggatctgtgcacttgctgttccttacgctcttctcccagggatctgaaaggctcacaccctcacctccttcagatgtttgctaaaatgtcttctacccagtgaagccttccccaaccactacattaaaaacacacaaccagccctctccctctccctcctctccctctccccacggtccccctctccccacggtctccctctgatgccgagccgaagctggactgtactgctgccatctcggctcactgcaacctccctgcctgattctcctgcctcagcctgccgagtgcctgcgattacaggcgcatgccgccacgcctgactggttttcgtacttttttggtggagacggggtttcgctgtgttggccgggctggtctgcagctcctaaccgcgagtgatctgccagcctcggcctcccgaggtgccgggtttgcagacggagtctggttcactcagtgctcaatggtgcacaggctggagtgcagtggcgtgatcgaggctcgctacaacctccacctcccagccgcctgccttggcctcccaaagtgccgagattgcagcctctgcctggccccccatcgtctgggacgtgaggagcccctctgcctggctgcccagtctggaaagtgaggagcgtctctgcccggccgccatcccatctaggaagtgaggagcacctcttcccggccgccatcccatctaggaagtgaggggagtctctgcccggccgcccatcgtctgagatgtggggagcacctctgccccgccgccccgtctgggatgtgaggagcgcctctgcccggccgccccatctgagaagtgaggagaccctccgcccggcagccaccccatccgggagggaggtgggggtcagcccccgccaggccagccaccccatccgggagggaggtgggggtcagccccccgcccggccagccaccccgtctgggagggaggtgggggggccagcccccgtccgggaggaaggtggggtgtcagccccccgcccggccagccgccccgtccgggagggaggtggggggtcagccccccgcccggccagccgccccgtccgggagggaggtgggggggtcagccccccgcccggccagccgccccgtccgggaggtgaggggcgcctctgcccggccgcccctactgggatgtgaggagcccctctgcccggccaccaccccgtctgggaggtgtactcaacagctcattgagaacgggacgggatgacaatggcggttttgtgtaatagaaaggggggaaagggggggaaaagattgagaaatcggatggttgccgtgtctgtgtagaaagaagtagacatgggagacttttcattttgttccatactaagaaaaattcttctgccttgggatcctgctaatcggtgaccttacccccaaccctgtgctctctgaaacatgtgctgtgtccactcagagttgaatggattaagggcggtgcaagatgtgctttgttaaacagatgcttgaaggcagcgtgctggttaagagtcatcaccactccctaatctcaagtacccagggacacaaacactgcggaaggccgcagggtcctctgcctaggaaaaccagagacctttgtgcacttgtttatctgctgaccttccctccactattgtcctatgaccctgccaaatccccctctgcgagaaacacccaagaatgatcaataaaaaaaaaaaaaaaaaaaaacacaaccagcatccattctcttatcttcctccactttgcatttctccattgtttaacatcacttgcacacctttaatttttagtttattaattcatactgcaaacgaactcagttcttatcatgtgccaggtattgtcctagttgctgacaatacagctgaaaataaaatagacaaaaatcctatcttttgaatcttttgaaccttgcattgggagtgacagacaaaacgaggtaaatcagtaaaatacgtgagacacaaagctaaaggaaaaaaataagaggaaagggcagatttttgtgtcttccttccagaatggaagctccctgaggatacggatttgtgttttttcctattatatctcctgacaatagcgcccagcacatagtaggcattcgatcgaatttttaaaatgaaatacaaggcagttactcagttcccgggcacatttcaacttttagagaacaattacaccaattaagaaaatcgattacagctaggctacgattcgagagctaagtggcgctcatctttgggagtatgccgttcaattcctcaaactcaaaattattttatcgatttctacagttaccgcggtgcactggctcaaaaaaagggttcattaattgagtgctttttactcccagctaagctgaccaaagatcacggtaagaggcaaagggtcacagccgcactggcgtaacccgtaactgtacacgttccgggcggccaggagccagggcgcagacctccaagccggaccactcgagctgctaaagaaaaggcaatacactaacctctccgccggaagagaagaaggaagcgccagggacgcacgcttcctcggcaggactgcagggaaagagccgcacccccagcctctcactactgcagccaacccatctcctggaagggcgctcccgcccacccccgctactgcgcagccgcactgaactctggtcccacttagcgggagaaactcgggccacgtgactgtctgaccacgtgagccgcgtcgccgcgacctcttccgctccctaggccctgggacctcccggtcccttgcctgcttccggctttcgctcgcttccatatccgctcctctagtcgccctccgctggccccgccttcgtccccggaagattgggtcttctggcgagccactgtttgccgtttgatcgggcaccaaataaagtttctttattcaaaagcactttttttttaaagccacaccacccccattctcagctcctccttcgcggcggtaccgcctctgtttctgcggcgattgaacagccgagctttgcggccgggatcgcggaaagtgatggctgtcgtcccggcgtctctctcaggacaggacgtggggttagtctagcttttctcctccccacttttgcggaaagccgggcctcgccgggagcctgtggggactaagcggagggcgcccgctccccggtgggctgcgttcgagtcccgccgccgggcgcggctttccggggcgcctttgcgggtttcgcggactggctcggaggcgaagggaggcggccccggggagggagcctgcccgcggcggctgctcgtaaggatcaggacaggggtcagcttcgcggtctgttcctggcggtcactttttatttattcactttaatagacgcgctttgggggcgttaaaattctgcgtaagagttggggatctcagcgctattaagaaacgggtttctccctgttgttgatcaaatcgtaatctcacagtaagaactgtctagttttttgctttatagtcgtcacgctactgattcttgggtaaagttgtgggtgaccgtgcaaataacatccatttgcataaatcgaatggccaaatttatatttgaaatttgtccttacttcaaaatattgcaaaagacgagaacactttgaagaaaataaacctgggcagaaagtaggttgaggccaacaaagtggcgccaatggccccaaattgaggcagtcactgtttcaggtcatgcaagtatagagagtatctccttcaattttgcgccctagggcttctggcctcactccagtcctggccagagactttgttccagaggtgcaggaaatgtagtagttaggaaaacagtaatactttccaattaaagtaaaatctcaaaaaaggacttactatacctactgcctgggaaaattcaagtgacagttgatttaatgttcctgctcaccctctgaggtattagtgatttcttttattaatgatttttaaaaattaaattctgatcaacgtagttattatgcgcattaaaacctaatcactgttttgggtggtactgaaagcaccacagagtcggaaagtgtgtgcagtttttttcttaaagttctatagctatcatttgaggaaaccttttgaagaaatacccaagttacaatctagtaatttaacaattgtctcctgtgatctggagataaaaacactagtcagctaagctctgtgctctatatttaaaactgcacagaatttctccaccaaataaagctttttttctacctgtatcatgtatttccttagaatgatataaaatgataatctgtaaatcttgggttttgtatgaataaaatcaagaatatctttaattttttaatgcaggtataagtttttcttcatctccagcttgcttcattcttgaacacttctataaaatctctgattttttgagtgggaagagacagtagcacgccttcatttgcttaggggcagaataggatggaaggagtccattgtgcagatagagaaggcagagaaggggaaaatttttgaaaataattaaaattgacttagaaaatagacagaatggagagaaacaggcttaaaagtacctttaattctttatgttgttcaagcacattagaccctttaggtggttttagatgcattgcttcattcatctttctaagcaggtgacttagcagatagtagacctgggacaagagcctgtttgatttctaagctaatccattccctatcctatcactttgctaagcgagtttctgatttaggaaaataaaagcaatagaataggaaagataagaatgattaaacagactccatgggagaatctgggattagaggcaccaagacagtttggcttccatgacataccagcgaattttccaggttttcttatgtcttaatatagtaatcatacaatacttgtctatcttttaatagttgtatgaggagtttaatatacatgaagtgttccagaaactaaaagatagccagtcttctagtattgatgctgctaagttatatattgcatgtgactcttttctagatcatttgcatatcttacaattaaagacagaataccacagatcttaactaaggttattgatacattgcatcgacataaaagtgaattttttgagaaacacggagaggtaagaattgttttaacttttaattttttgttaatttctcaacagaaacataataaatagttcttgaaggtatcaattttcctttaaatgtaaaaatcaatagatgggccaagtatttatttgtttttaaggtaatacattgaaatgaagatagaacagccaatcttcaatttagaaaatgattgtgttccaataattaattctgtcagttatttagacttcagaatgtattttctaatatatgcaatgttgtaattggtgactgggcaacagacttgcaattgacttagtcaagtgactaagcaattgagttgcttagaagagctttttaaatttcaagtttaatttgagttgcagtatttatattactaatttgagatcttgagtcctggaagttcaagctgctatgcaaagctcagtgatatgaattataattgattgacacattgtactgattcaagttgggactcattagcattcagtgcagaataggactttagaaatcactttgtccattcaattaatggatgaggaaaaatccaaataactatgttattgaaggggtgggttgcccctccacacctgtgggtgtttctcgtaaggtggaacgagagacttggaaaagaaaaagacacagagacaaagtatagagaaagaaataaggggacctggggaaccagcgttcagcatatggaggatcccgccagcctctgagttcccttagtatttattgatcattcgtgggtgtttctccgagagagggatgtgtcagggtcacaagacaattgtggggagagggtcagcagacaaacacgtgaacaaaggtctttgcatcatagacaatgtaaaggattaagtgctgtgcttttagatatgcatacacataaacatctcaatgctttacaaagcagtattgctgcccgcatgtcccacctccagccctaaggcggtttttccctatctcagtagatggaacatacaattgggttttataccgagacattccattgcccagggacgggcaggagacagatgccttcctcttgtctcaactgcaagaggcatgccttcctcttacactaatcctcctcagcacagaccctttacgggtgtcgggctgggggacggtcaggtctttcccttcccacgaggccatatttcagactatcacatggggagaaaccttggacaatacctggctttcctaggcagaggtccctgcggccttccggccttccgcagtttttgtgcccctgggtacttgagattagggagtggtgatgactctcaaggagtatgctgccttcaagcatctgtttaacaaagcacatcttgcaccgcccttaatccatttaactccgagttgacacagcacatgtttcagagagcacggggttgggggtaaggttatagattaacagaatctcaaggcagaagaatttttcttagtacagaacaaaatggagtctcctatgtctacttctttctacacagacacagtaacaatctgatctctcttgcttttccccacatgttatgttagacataggtctttaaacttgtaggttcagtaatctttctattacacaatagactgtaaaagagcatacatataccagtacattttttttgagagttgaaaacaaaaatttagagaaatggttggtgatcttttctccttggccaaattgaaatggagcaagataacacacatgcagtttgagtgtaatgttctacttctttcaacttcttttatattgtcttgtttaaaactaatcctggcataacacagggattacctgttgttccttgttgctaaaatccggcttaatttagacactgacaattatattgctgaatggttttaatgtttatcacataaacataattttggtaactgacatatctttatcacacaagtataatttagccaaatttggatagttcactttagtatttggtcatatacgcaagcaaattaccataatacttttgtttttcttgttgttgttttttgagacagggtcttgttctgtctactaggcagagtgcagtggtgcagtcatagctcactgcagcctcaaactcctagattccagcaattctcccagttcagcatcctaaagtgctggcattacaggcgtgagccactgtgcctggccccataatgcttttgtaatttcagttttttcggccagagtgatctaaaatgtagtaattaatgaagtcctagtatattgctacttggcctgtatgcccgtaatcaccaggtgactgaaggcagagtttattgtctctccagccctcccccatttcacactctactgagcacagaacaagatgtaaattgacacagataaagtctgcttttggtagcctttctgtccctttttcatgcctctgttatacctatggccactctccttgggcctcatgtgttctagcttcctaagcccccacctatagcagggccaggcttatctccgaaggagccatgccacacagttttctatcttcccccacctcagcggtcaaacgtccgtgcccttagactacctggtttggcagatgtgtgtctcttggagacaggaccaggctttattcatctttctctggccctgaggttagtgtcaggcacatacagggttcagtaaatgtttgaattcaattcaagtaagtgaacaaagtggcagtgacatcactattaatccattagcctttttaggtatatgcttctgtaaaagggtgcctgacaccctgtaaaacctcagttgttggaatttatagttaaagagttgaagtttaagactttagggaagagatttggaggagggggagttcctctcaaaacagtcagctacaacttcttttcttctatttctgaacctgcagaatctcgaaagcttcaatctttttttctagcagcaaaataaattgtacttggaacaaaagaaagattggagagatgtttatattgagaaaattacagatctgaaagtagggactaaatatcaacatgataaaaatgatcttataaaaatactcaggcttgatgtttattctctacattttattatatacgtgtcttattaggcttacattttctttttttttaatggagcaggaatcttgctaatgtaaaaccaaggtgtgaagtcattttcacttcattctgatcccattacatttgtccccactccaattggcctgttatgtgagataatattgtagtgccttgtttgtcagcatatgtcatctctcacctagctagaacttggtggaaaacaagttaaaaaaaatttgagctaccaaaagaaacctcagaaagcccacagtttcttttctagtggtgtcaatggtgaaagaagaatatgtatggaagcatgaaagacatggaaaatctggcaggggttcctttccctctgtggtaatggtcatcccaccgaagatacagaaaggccagaacttaggtagataaggcatgattatgttcatatgagatctgtgtgtgttttttgattttcagtttaagagttctaaatgtaatgtttaaagaaataaaatgtagttttgaacatttttcttttcttcttaagtctgtaaaaatatgttaccctagaggaattgcacagacacacacacacacacaatttatttttcttgtatttttgcaggaaggcgtggaagctgaaaagaaagctatctctctcctttctaaattacggaatgaattgcaaacagataaaccatttatccccttggttgagaaatttgttgatactgatatatggaatcagtacctagaatatcaacagagtcttttaaatgaaagtgatggaaaatcaagatggttctactcaccgtggttgttggtagaatgttacatgtatcgaagaattcatgaagcaattatccagaggtacgtgtgtaatcatcaactatcaaatgtttagataatttatactttttctgaaattgtaaaaggataagtttaaaaataagcaccagtggaagcttgaatttggttgagtttagcaaatcttaatagcattgttggacatttctacaaatgttactgatggacatttctacaaatgttactgatggacatttctatagctgttaccaatttaacagattcttggcaattataatctacttgcctagaatagacataagagtaaatatctaaagtacgaattggccaggccctgaggttcatgcttgtaatcccagcactttgggaggctgaggtgggcagattgcttgaggtcaggagttcgagaccagcctggccagcataacgaaacccgtctctactaaaaataaaaaaattagcgaggcatggtggcacgggcctgtaatcccaggtacctgggaggctgaggaatgggaattgcttgaacctgggaggcagaggttgcagtgtgccaaaattgcaccactgcactgcagcctgagcaccggagtgaaactctgtctcaataaaatagataaataaagcgtgaattaattaaagattccaacaaagacttctagaataaaagaagttttgcttattgagtaaaaaatgtaaatttgaaatagttacatttatataaataaggatgggacaaagtaagcatatgttttgtttattgaaatagataataaacgttacaacttacttggtttaaggagtcatgagaacagtgaatcatactattgtattatagtcttaatctttcatctttttttaaaaaggctagtttagaaaaagattttaaaagtacacatgtttcaaagtaactttttctaggcttgtttatattatttaatttttcctaggaaaacatctgatagagaactagtttttagaccaggcgtggtggctcatgcctggaatcccaacactttgggaggctaaggcaggtggatcactcgaggtcaggaatttgagaccagcctggtgagcgtggcgaaaccccgtctctacaaaaaatatataattacccaggtgtggtggcacatgcctgttgtcccagctaccccggaggctgaggcatgagaatcacttgaacctgggaggcggaggttccagtagccaagattacaccaccgcactccagcctgggcgacagagcgagactgtttaaaaaaaccaaaaaacaaaaaactgttatttatagtgccaaagaaaagttaatggggatgattggattatccttaataagcacaggttccaaaaatacaggtttgttaagaggaatcctttggtatctgttcctaaacatagcataggacaatttaaagtgacctatcaagtcagcactaattgtaaaataaaattattttgggaaacatatggaactttaaaatctgttcattagcttttttgtcttaatcttacacacacacgtatatattttgttgttgttgttgttcttgttgttgtttgtttgtttaagatggagtctcgctctgtcgcccaggctggagtacagtggcgcgatcttggcttactacaacctctgccttccgggttcaagcagttctcttgcctcagcctcccgagtagctgggattacaggcacctcccaccatgcctggctaactttttttgtttttgtattttttgtagagatggggtttcgttatgttggccaggctggccttgaactcctgacctcgaactcctgacctcaggtgatctgccctcctcgtcctcccaaagtgctgggattacaggcatgagccaccacgcccagcctatatatttttttttcatatcacaatttgttgttttttctgataggtaggttttagaacttctgatctaaaagcaaaatacactattaaaactctggtgcaggccgggtgcggtggctcacacctgtaatcccagcactttgggaggccgaggcaggcagatcaaaaggtcaagaggtcgagaccatcctggccaacatgctgaaaccccgtctctactaaaaatacaaaaattagctgggcgcggtggtgcgcacctgtagtcccagctactcaggaggctgaggcaggagaatcacttgaacccaggaggcggaggttgcagtgagccgaaatcacaccactgcactccagcctgggtgaaagagcaagactctgtctcaaaaaaaaaacaaaaaaacaacaaaaaaaactccggtgcactgcttggcatggagaaggcaccccagcagaacagcagaagatgtaaggagctgtcagtaactagcaatgttctagtgactgtgcaacccagtgaaatgtaggcgttgttatggtttccattttaacagtttaggtgattgggctcagagagatttctaacatgcccaaggtgacatggctagtaggtggtggaaccaggatttgagcctggtctgtgtgaatcagattagtgtccttattcagccattcttcccaaatagtagatttagatgcctgtcaaggactgagagtagtctgaaattcggggtgatggtttcctaattttggaaaatatctgtggtaggagccaaagctgccaaagtgttgaaagactgggtggcatcttgagtggggttggtggagtttgtgtgtttaaggcaagaggaatgctgtttctgagtttgattttagaggttgatcaggttcagagactaaaaatacctagagcagattttcacaaacctggctgcacatttatgacccagttggggaaaaggaaggtggcttcaaaaatgcgtatttttaggccaggcacagtggcttacgcctgtgatctcagcactttgggagcctgaggcaggtggatctcccgaggtcaggagtgtgagatcagcctggccaacatggtgaaaccctgtctctactaaaaatacaaaaattagtcaggcatggtaatgggcacctgtaatcccagctactcaggaggctgaggcaggagaatcacttgaacccaggaggtggaggttgcagtgagccgagattgtgccgttgtactccagcctgggcgacaagagcgaaactccgtctcaaaaaaaacaccacatagttttagattattgtgttggaataaatacaaattgcttaatttatctggggtggggcctgggtatcagtttttctttcggaagctcagggagtgatgatatccactggttcagcgaacagattgttaaatgggatagagggaacatgcatctttaagttcaagaaactagaatgttgcacaatcacggatgtagaactcttcccaaagcggtttctgtggcagataaagagccatcttacaatggagccagcactgaagtaattcttaaatgtctaatttttaggttcttctatgggggatccctatcctaggtcaatggcaactccagactgaccagcttttataaaagacatgtttatattgatttaccattttacactgaaacatgcaatagtctgccagtctaaattaagattcaaagttttagccatatgtgaaatttaaacatattaggtaaatacacttcagatattgaaagatgaaagtacagagaaaatattagatttttagaaaaactttttaataaagtgtaatatacatatagaaaaatgtgcatgtcttatgtgttcaagaacatacttgtgtacccagtgcccagatcaagagacggaaccttacagaccccaaaagtccactttgagtccctttccagtcactgccttcattactcctcaaggataaccattgttctgacctgtgttagttttgcctgttttttaactttactgaaatgaaatgatacagtgtatagttttgtgtctggcttctttcactcatttttatgtttgtgagactcatccatatgttacaatataattatagatcattcattctcattgctttataatattgcattttatgagcatattacaatctgtttacttcgttgtgatggatatttgagtacttttcagtttggagttgttaggaagaatgctgctataaacattctgacacttttttgctgaacatatgtatgaatacatctgttggatatatccctccctagaagtgaatcactgggtcatagtgtgtgtacatacacagctttagtagattctaaaatagaaaacattctaaaatgagaatttatatatagttatgtgagtttactctcttaaatacgaaaataaggctcattcttaatatgagatgtgactttaatgaatggtttgttaataaaacattagaacatgttttattagaactttctgtaaagggccaggtagtaaatcttttaggcataggggccatgtggtctctgttgcagctgccgaacctgccattgtcgtgtgaatgcaaccttaaataatatgtaagaatgagcatggctgtgttctaaagaaactttattcagcggacaccgaaatttgaatttcatgtgttacaaaatactacttttctttcactttgttttcagccattcaaaaatataaaaaccactcttagcatgtgagtcagacagaacaggtggtgggccggattgggtctgtgcatccgaatgatttttatccttttaagtcaccttgagagactgactgatttcagcggtgctgccattgctaaaaccatctttgaattatttggaacttctttcagagccagtttacatgcctcaaaatgaaaattagtcttcctgtatttttactcatttttgattaaaaaaaaagtttttatccaatttgatcacacacctcattctactgaaatcactccgagtgacttttggctgtttccaaaaataaattgactccaaaggatgaagatatgtgatcactgacaggaggtttaatgatgtgccataggttctgaagaaaattcctaaagaggaattccaaaagtgctctgagcaatggcagcgcccttggaataagggtgtagcttcccgaggtgactgactggctggaaggaggcagccatcatttggatgtttaaatactggtatgttatttaaaaaaacaaaacaaaacaaatcaagccgattacatcagtgttagattgtttttaccctaacatgaatgacccatggaaaaagtagctaatttggaagacccaataatctgaatgtcttttatattcaattcagtaaagattattatattagtatttatatctccttagttatgattttcttaggccaatataatatgatttaatctctcactggaaaacatgaaggtgtagccatgccacatatatcacctttggttaaagttgcccaaaaatacctaaaattagtgataaaaaattatcattcttctaaaacttacaatagtattgtctgatttatcttaagtactcattgtatttccatcatactctgtgtttcattctgttaatgattgctgcattgtattcaaatattctgtttatattctatacatttgttactggaactctgccacatcggtggttaaaaaatgtttgttgaactaaagcagttgtcttgaaatttatctttctccttcttgtgccctggaatccctgctaggtagataattatgagcatagtcactatcactatttaatatgtccagaaaaatacttgatttgggaacttttttgacaattaaaatgagtttgagagatttttgtgtaatttgattatttagtattaagtttttctagttaattagataaatgttatatctagtttctgttagcactgattattgagactgtatggtgctattttctttcaagaactgcagttatccaaatgtacaaactaaaatgtttcactttgtttttctcctactttagtccaccaatcgattactttgatgtatttaaagaatcaaaagagcaaaatttctatgggtcacaggaatccatcattgctttatgtactcacctgcaacaattgataagaactattgaagacctagatgaaaatcagctgaaagatgagttttttaaacttctgcaggtaaatgtgatcattaatcttctgagtatgttttatttaaacagaaaataaactgctatacagttaacaaaacatgtaaatatttttctttgctataattgatgattttttatctagtggtgttaaaagatgaaaatccatttaattgctagaaatgggtttgaaatatttttctgctctcactggctatgattttagtggcaaagaagttatctgacttcctagcttctgtcatacttgagagaatacttcatagtaatttgcttagcttttgtcatgcttgaaagaattcttaatagtaatttggtctcccagctgacttgggtgtgtgttggctctgtggctaatttgtgtttggacctgaggcctgtcacttaatttctctgggcctcagtttcctcctctgttcagtgaggataatgtgtactgtgtaatttgatgtgagaattcaactagatgcttgcatgtgaagtgctgagcacagagcctgggatacagcctgctgttagcatcggtaggtgataatactcgggtattcagttggcccattaatacagtttcattacatttctttatcttgtattcagtttagtttttaattcatgcaaacatcctgaaatttacaacacattattagaatcagaactattaggagacgtggtacacagcagtatccccagccctcacattttccagaaaaagtgaggaagactttcaaaaagaaatgttagaaagtgctatgaagagaaataaagcaggaaaagggcgttgggaatgttggagaagggatcagggctgccagggaagggtccatggaggctgaggccacagacctgaaggcagggaaggagtaagtcaggtgtatgtctgcggagtacatggagaggtgagaaaaattgcaaggaaaccctgtagttactgagaggtagcggggtggaagggacacagaacggcttgtattaaataaatttttactaaaagtgaaacagaagccatcagagggttttgaacagagaggtaatgctatttgactatttcaaggaatgtttctgagaatagactgcaggggctgaaggtggaaatggggagagctggtctgaaaatgacttggggagggaggttggggccaagttggtagcataagagttagtgacatcaccagagcctgggtgttctttgaacatagaagctacagaacttgctaacagattatacctggagacgaagccctggtgagaccccgagggcaagcaaagtcacaaataaaggcatattttgagttcaaaacaaaaattgtcaggacattgttttgttttttgagacagagtctcgctctgttgcccaggttgtagtgcagtggcacgatctcagctcactgcaacctccgtctcccgggtttaagcaattctcctgcctcagcctcctgagtagctggaattacaggcgtatgccaccacacctggctaatttttgtatttttagtagagactgggtttcgccatgttggccaggctggtcttgaactcctgacctcaggtgatctgcccaccttggcctcccaaagtgctgggattataggcatgagccaccttgcctggcccaggacattgttaactaataaaccttgttttttgttttttcctgttaactctgccttatgcttagccttggaattaaaaaaaaaaagactggcatgctagttcttgactcctagctagcccattctttcagggaatcatcttctttgaatgtgttctttgtcccatagtataataaactatgaagaagaatgagcatgcatctattttctgtcatctgatttagctaacaacttcttcacactgtcactgtgctcccaagtgaagggggccagagttgcctccatttggtgtccgcagtgagcaacaggttaacgtttcaagggaagcttgaaaacattctcgttttcagagaatgttgatctctttcaaaagtcatagcactctcccactgtcgacacacacatttctggggctactgtgtcaaatgccattctaggtgctgggcacgtagtggtaaaacaagaacaggctgatcctccctatcaaaacttgtaatcttgagggaatatagacaatgaagtaattgcacaaagagctatgccattacaaactggaagacggtgtgaagggaaagtgcaggaggctagcacagaacctgctctcagtcgctgaaggccatcgtggacaccattgtatgaatttcttcaggaaactctagaaaaaggtgaccttggacactttagttattatttaagccttttttttaaaaaaaatttattcatttatctctttttaaaataatactgttcggccgggcatggtggctcacacctgtaatcccagcactctgggaggccgaggtgggcagatcacctgaggccaggagtttgagaccagcctggctaacatggtaaaaccccatctctactaaaaatacaaaaaattagccaggcgtggtggtgggcggctgtaatcccagctacttgggaggctgaggcaggagaaaagcttgaacccgtgaggcagaggtgcagtgagccaagatcgcaccaccgcactccagcctcggtgacagaggagactctatctcaaaaaaaaaaaaaacaaaaccctattggttggaacatgcattctccttattttaaatcacaaatgagggcctgacaaggtggctcatgcttataatctcagcattttgggaggccacggcaggaggattgctggaggccaggagatggaaattagcctggtcaacatagtgagaccccatctttattaaaaaaaaaatcacaaatgagagtagagtctgttttggctagtgtttattgagtacttctatatgccaggtatttggtacattatttacatgcattatatcaattctcacaataattctgtgaggtaagtactagtatctcgtttttcagttgcaggacttgagccttagagagcttaagtaatttgttgatgatcataaactgaagatgctgagtttgaacccaggtcgagctggaagtcctaaacgtgtaattttatggcttaaaaaaaaataggcctacatactgtttttctacaaaatgtaattgagtattaattcaatttaaagctgaataagataattgattacaatgggtctttagttaacatgaccttgtttaaaaagtagcgtctttagatatcactttgttcagttttttaaattttacaaatgagagaaccaaatcccagagaggtgtcacgtcctaaggttatgcaattagtgaaagaaactggacagttctgcagggccaaggaggaaaaaataaacttttatttcttctcttgactctggattatatgggcaactttgagcctctcttcacacatccgatgatgttctaatatctgcaagctgcaaaaacttttattctgaataaacaatgtgagtgctgaaataattgaaaccagtttttttaagtccattacatactgatgaattaaaaatttcagttttatcttgttaatacagcatcatgtgaaataatttttgtgcattgttagagaaagtatagatttgatggtcatgtaaagagttttgtagatatttagtagttttttagcaatgtccccccatcccgctacataatggagttttgttggctattcagaagaagggtgaatattttgtactttttctttttcagatttcactgtggggaaataagtgtgatctgtctctctcaggtggagaaagtagttctcagaataccaatgtactaaattcattggaagacctaaaacctttcattttattgaatgatatggaacatctttggtcattgcttagcaattgcaagaaaacaagagaaaaagcttctgctactagagtgtatattgttctcgataattctggatttgagcttgttacagatttaatattagccgacttcttgttgtcctctgaactggctactgaggttcatttttatggaaaaacaattccatggtttgtttctgatactactatacatgattttaattggttaattgaacaggtaaaacacagtaatcataagtggatgtccaagtgtggggctgactgggaagagtatattaaaatgggtaaatgggtttaccacaatcatatattttggactctgcctcatgagtactgtgcaatgcctcaggttgcacctgacttatatgctgaactacagaaggcacatttaattttattcaagggtgatttgaattacaggaagttgacaggtgacagaaaatgggagttttctgttccatttcatcaggctctgaatggcttccatcctgcaccactctgtaccataagaacattaaaagctgaaattcaggttggtctgcagcctgggcaaggggaacagctcctggcctctgagcccagctggtggaccactggaaaatatggaatatttcagtacgatggtcccctttgacttgatttaggagctctcagttgcatagaaagatctggtgagcaccttttcatccccagaaaaggagcacgtgaattgagtcgcctggcggctctgtacgcgctcagggaagcttagcttcttggtgcccatctacgtgcactggatgatttttcttttgaacattttgccccactacactgttttggggatagctgggttaagcaagttaaagatatttacatttatattggaattttagcaactttttttcaggttaaatatataatttcaagtgcttttaatgaacttatttttaattggctagggagcaaaaaataagtgagttctgcttttagttagttaaccttgttcttttcttaaatagtacactgcatggtatttaatattccaggaagcatgggattttattttgcttgattttgggcacatgaaataatagctctaggaaaatgcgcatcttaatgactctttgtaaagagaggcatttcttacaactgtgatgtttgcttacataaaagttacctcataagttaattctaacttttattcttgaattttatttcatttcaatagcttgtttcatttgcacgcctttgtattttgattgacctgtagaatggatgttaggaaactcaaaattgaacacagtgaaacaaatggtatttgaagaaatgtaatatcttttatattctatttatgatatccataatcaaatgagattattttaccacataaatgttttaaatatcagatttttagtttgcagttttaggaaaatgctttagatagaaaaggttcttatgcattgaatttggagtactaccaacaatgaatgaatttattttttatattcttacacattttattggtcattgtcacagatagtaaatactaaaaatttcaggtcagtttgttttgaaactgaaattggaaataaatctggaaatgttttgttgcactaaaataataaaatgaattgtactgaaaatctccttggttttattttctagtggggaaaagtcaagaaaggaagattaaaaatgagatttatataaaaagagacataatatatattctagatgttgccaaaagcagttattaaatatcatttataaaaggttattagtctatgctcttgctaagtattaaaaaagatttttgcaaaatgtttatataaagctgtacattttgaatctactgtgtttctttatccacatgtgtgcctattttaaagagtaagtttgtaaaatgcttccatattagaattatttgtaggcatttgacataatttagaacacagttgtatatttaggttgacttcatagccaccgtgtgagctccagcactggaagtagttcagcacccccactcccccatgaaaaagagcaaggaagcaaactagtgcgagaaaggtggcactgaggaagaggaagtcaggtcaaggtggaattttttttaatgcttagcaggaggaagggcctacctatgttttcaccagttaatttttaagttttaatgttagtttagtgttgttttatttttaagacagggtctcgccctgttttcctggctggagtgcagggcatgatcacagctcactgtagtcttgacctcccggacttaggcgatcctctcaccccagcctcttcagtagctgaaaatatgggtgtgtgccaccatgcccagctaattttttttattttgtagcgatgaggtctcactatgttgcccagaactggtctcaaactattggcttcagcctcccgaagtgctaggattataggcaaggccaccgtgcccagcctcaccagttgattttttttttttttttgagacggagtctcactctgttgccaggctggagtccagtggcgcaatctcagctcactgcaatctccgccttccaggttcaagtggttctcctgcctcagtctcccaagtagctgggattacaggtgcgggccaccaccccagctaatttttgtagttttagtagagacggggtttcaccatgttggccaggatggtctctatctcctgacctcgtgatctgcccgcctcgacctcccaaagtgctgggattacaggtgtgagccaccgcacctggcccagttgattttttaaaacagctttactgaaatataaatacaattcatccatttaaagggtacggtatttcagtatattcacagggttgtttttgtcacagctaaaacaaactagtacccattgatagtcattcccctttgccctctccttagcacttggcgaccacaaatctttctgtctatatgaatttaaatgttctggacattacatataaatagaatcaaaataggcggtcttttgtgactagcttattttgaaggttcatcagttgtatgtgtcagtcagtcccaacacttctctaattaggactctacaagtacttcatcttttttgatggctgaatacttttttttttttttttaagagatgaggttttgccatgttgcccagcctggtccccaactcctgggctcaagcaatccaccggtctaggcctcccaaagtgctgggattacagttgtgagccactgcgcccggcccaaatactattccattgtatggacatataccacgttttattcatttgtcaggtgatgggcatttgggttgtttccactttttgactattatgaataatgctgctatgacattcatgtacaagacttgtgtatgttttcacttcttttgggtatatatgtaggggtgaaagtgttccatcatatggtaactgtaatgttttgtgtgtctgtcaaatactttccccgaagtgtttgcatcatttcacattccttccaacaatgcacgacggctccaacttcacatttttgtcagcacttgttactctttttttttttttttttttgagacagagtcttgctctgtcacccaggctggaatgcagtggcatgatctcggctcactgcaaccttgcctcctgggttcaagtgatcctcttgcctcagtttcccaagtaacggggattacaggcacgcacaaccatgcaccagttaatttttgtattttttttagtagagactgggtttcaccatgttggccaggctggtcttgaactcctgacctcaagtaatccacccgcctcagtctcccaaagtgctgggattacaggcgtgagccactgtgcctggcctgttattaatagtatccgtgtttttgactatagctgaactgttgggtgcaaagtgggaatctcatgcttttgaatggcatttccctaatgaataatgttgagcatattttcatgtgcttattggccatttgtgtatcttctttgggaagatgtcttcaattcctttgcccatttaaacattatcttcttattgagttataaggtttaaaagatatattctgggctgggcgcagtggctaacgcctgtaatcccagcactttgggaggccgaggcgggcagatcacaaggtcaagagatcaagaccatcctggccaacgtgctgaaaccctgtctctactaaaaatacaaaaaattagctgggcatggtggctcatgcctgtaatcccagctacttgggaggctgaggcaggagaatcgcttgaaccagggtggtggaggtcgcagtgagccgaggtcatgccactgcatgccagcctggtgacaaagtgagactctgtctcaaaaaaaaaaaaaaaaaagatatatatatatatattctggccaggcgtggtggctcatgcctgtaatcccagcactttaggaggccgaggtgggcagatcatgagatcaggagttcgaggacaggctggccaatatggagaaaccccttctctactaaaaaatacaaaaattagctgggcgcggtggcgcatgcctatagtcccagctactcaggaggctgaggcaagagaatcgctggaacctgggaggccgaggctgcagtgagccaagatcatgccactgcactccagcctgggcgataagagcgagactccgtttcaacaacaacaactatatgtataaataatatatatatatattttctggatacaggtctcttattggacatatgacttataaatattttctccaattctgtgtgttgtcttatcaatttcttgatggtatcagtttgcagcacaaacgttttaaatttggataaatacttttattgcaaaacattggtgttggagctgcttaaactcctcttaagggtctctaaagtgagggactgccaaccttctctcaacccccgtcaacactccccccatcctgcttccaacactcttgtttccacctgagcaaatgtggcctacacatgtttagtatgggtgtagacgagcacagtgagaaagctgaggttctgcaatggggtgtgaatgggttttccactgaagagctgagtagccttcccaaaatagcatctttaattgtttcttaactgctaccacacctacatatgaagtaagtgtagcttataaatttcatgcaatacatttttatcaagacgtagatccagtattgtaggtatattaggatgaaaatgtagatgaagggcaggtaaataattatgcagagaatggtgtttttatttaacagcaagtggacaagatttgttggcatgatccagcttttcttttcttttccttttttttttttttttgagaaggagtcttgctctgtcacctaggctggagtgcagtggcataatctcggctcactgcaacctctgcctctgggttcaagtgattctcctgcttcagcctccccaaatagctgggactacaggtgcacgccaccacgctccgctaattttttttttgtatttttagtagaaacagggtttcaccacgttggccaggctggtctagaactcctgatctcaggtgatctgcccaccttggcctcccaaagtgctgggattacagccgtgagccaccgcgcccagccatggtccaacttttcgtactaatttgaggcagtgtttgtgtttgataaaatgcagtaatgtttttgaacctttataaagccaaaatccgagttgcttattctcaaggtcatgtttctataaaagaaaacgcaccagccacaaaaagcaacacagtttaaacctttatttgcattttaagaaaaccccagagtgtattgaaaatgtagttcaaagttgctgttaaaatttcctctcccaatcatttttctaacacagccctctgcccaaactcccactaagccttattccagaacatctgccacaaaatgtcttttttcctctttttgtctctaccctctttttttttttgctagattgagagtggagaagactttgaacacttctatgcattcatgtcattacctagataaagtgctcatgccatgtctgacactcctggtaagtattaagtgatatcttgaaattgcagcaaatgaatacagcagaggaaaagaaaactcagaaaaacaacaacagtggtaacaccatctccaaatacccctgttaagatttgatgtatatattgctaagttcttctttatgtatagacatactttttttttttacatttctaagataaaaaagcagaatcatatcattaaaacttttttttttttttttttttgagacgaggtctcgctctctcgctcaggcactcacagcagcctcgacctcctaggctcaagtgatcttcccacctcagccttccaagtagctgagactacaagtgtgcaccacaatgcctggctaatttaaaattttttttgtagagatgaggtctcacttcgttgcccaggctggtctcaaactactgggctcaaacgagactactgcctcaacctcccaaagtgctgggattacaggcatgtgcctatatccagcctttttttttttttttttttttaattcttaagtatttttcgaacttctaagttttgtttggttggttggttttgttcttgttgtcgttttactttttgtggggtttttgtttgtttagtttactaattggttcctgttagatggataggaggtttttttgttttgttttgttttgttttgagacggagtttccctcttgtcccccaggctggagtgcaatggcacaatctcggttcattgcaacctctgcctcccaggttcaagcgattctcctgcctcagcctcccgagtagctgggattacaggtgcctgccactatgcccggctaatttttgtattttagtagagacagggtttcgccatgttggccaggctggtctcgaactcctgacctcaggtaatctaccctcctcggcctcccaaagtgctgggattacaggcgtgagccactgtgccccgccaggagattttttttttttctgcatagcaatatgaccctggtactaaataatggcgtgagactcataaatacttgatttctaattcttgattgtcttagtccattggtgccactataacaaaatacctgagactaggtagtttaaaaacgacagaaatttatttctcatagttctggaggctgggagtccaagatcaaggtgccagcaggtttgtggactggtgaggtcctggtctcagcttccaagatggtgccttcttgctgcatcttctggaggaggggaggaacacagtgtcctcacgtggagaaggcggacgggcaagggagctgaatgccgcgtgacgagtctgaaacccatctgtgaaggaggatccctcctgacctaatcacctcttaaaggccccgcctattaatatcaccctattggccaccagtttcaacacatgaattttggaggggatagattcaaatcatagcaccagtctactgtgaactatgtgacctgagtcacattcttaccattttgctggaaaaagaaacgttaattccggtcaatttaaactacattgaatcccaaactcaaattacccgagggaaactggaaacttgctgaaaggtattaacattctggcaccccctagtggccacctgaatattctgtaaaacccgattttttttcccattttgcttttctttggtgtggcacgtttttcgttttcagtttatttactattacttcaccccatttttaaaccttttagaaaataaaagggaacatcagttcatacagaagacacttctaacttgtcgattcccactaatcttacatttcttggggcagccaccacctgtatcttctgtgtatttgtcctacacacaattgaacacagtagttgctcaatgaatgactgattgataggtaatgcagtccagtgtttgaaatatttcttgttttgttttgctttgttttttgagatggagtctagctttgtcacccaggctggagtgcaatggtgtgatttaggctcattgcaacctctgcctcccgggttcaagcgattctcctgcctcagccccccgagtagctgggattacaggcatgcgccaccacacttggctaattttttttttttttttgtatttttagtagagacggggtttcaccatgttggtgaggctggtctcgaacccctgaactcaagtgatccacccacctcggcctcccaaagtgctgggattacaggcatgagccatcatgcctggccttgaaatatttctttaaaactctgtgctgatgctatttaaattgaactctgaaggataaagtggatctgttggaaagcctgacatatataaggagatcaatagtacttgttgaatgaacaaaggaatatatattttatataattgagggttttcttttttcttttttccttttttttttttttttttttttgagatggagtttcactcttgttgcccaggctggagtgcagtggcgcagtcttggcacactgcaacctccacctcctgggttcaaacgattctcctgcctcagcctcctgagtagctgggattacaggcatgcgccactgtgcccagctaattgtgtatttttagtagagatggggtttcaccatgttggtcaggctgttcttgaacgcctaacctcaggtgatccacccgcctcagcctcccaaagtgctggagttacaggcgtgagccaccgcgcccggcccgagagtttttgataagtgtatgcttctttaaagactgctttgttccttcaatattataatcaattttccatttgttaaaaattcttcaaaaatgtatttatttatttattttttttttgagacaggtcctggctctgttgcccaggctggagtgcagtagcacgatcatggctctctgcaactaccacctcccaggctcaagagatcctcccacctcagcctcccgagtagctgggactacagacacctgccactacacctggctaatttttgtatttttggcaaatacggcgtcttcctatgttgcccagacttgtctctaactcctgggctcaagcgatcctcctgccttagcctcccaaagtgctaggattacaggcatgagccaccgtgcccaggccaagaatgtgatttttaaatggctacattcatcatatgactagatcatagtttattttgctatatagattattcaaaaattttggtattagaaaaaaaactgaaacgaacatcttcggacaactaaagtcttcagatactgctaattattaagagccacccggttactctagtccacctagaatagtgtttgcattagactcatagccccaagttgtcaatatcaagtaactgtttatcatggggagggaaactgctttttcctctcgtttttatttatttatttatttattttgagacaaagtctcgttctgtcgctccggctggggtgcagcggcgcgatctcggctcactgcaacttctgcctcctggttcaagcaattctcctgcctgagcctctcgagtagctgggattacaggtgctggccaccatgcccggctaattttgtatttttagttgagacagggttttaccgtgctggccaggctggtctcaagctcctggcttcaggtggatccacttgcctcggcctaccaaagtgctggattacaggtgtgagccaccacacctggccacagatttttgtttttaatgttttgttaactatttctatgtaaaatttccctttgcgttgtttatttaaggcatttacacactttatttggaggagtccatggcacaaaaacagttatgaacatgtgctctgtttttttttttccttttcccccaattctctttccttttcacaaagttgatgaaaggcatgactgattttatttatttatttatttatttatttatgagacggagtcttgctttgtcacccaggctggagtgcagtggcgcgatctcggctcactgcaacctccgcctcctgggttcaagcgattattctgcctcagccccctgagtagctggggctacaggcaagcgccaccacatctggctaatttttgtatttttagtagagacggggtttcaccatgttggtcaggcttgtcttgaacttctgacctcgtgatccacctgcctcggcctcccaaagtgttgggattacaggagtgagccactgcgcccatcccatttatttaattttttgaatcaaagaggagatgcattatagtgtacttttttctttccatctcaaatttcacttaatgcgaagcctttcttgtccagctccatgccgtcaaaagatctttaaaagaaacagaagatttcacatgtgtacaaggattgagtcatccttaacctattattaagaggatttttacaattgaaaaggacgtttcgggccaccaagcagctggaagccagtgagtaagattttggagggaaatggtttttgtgaacaggtggaaatgatttgaccaggacgcactggctcactcttctaaccaaatggatgatagaaaatttgtgttttgctctcaacttgaaatccaaaattctacttgtataaatcaatctaattcctgccttatctttgataacattactgataaactgtttaaaactaaatgaggtccaacttcacatgaatctgtaaaagtatgcattaattttccatttttattttttattttttctcatcatttctcaaatggaatgtgatttgaaccactgaaatccaaataattgtggtcttggagaagactcatcagccacttccattattgagatgaattcaaagagtcaataacttgggcaagcgtccttccagtcccagctctgttactaaataagtatgtaatttgaagataggtcacaaaatctagctagcttttcattcattttgctacttaatgttcttatatataagcagaaaactcacttttagctctgtgtgtgattttaggatctaattgcttgtgctttttgccatgcaccaagcaatcctatttgaccttgcacaaaagttggcactttatctttgtagaaaattctacttccttcttcctacttagcttatgtcattttttttcttcatggaaaactctactttttctctctgctaatctgttgaactcattgaagtattggctaagtcccatcttgacttccatccataaagtgatgactcccacctccacattgggcaggttggtggtatctctctctctccttttttttttccccaagatggagtctcgctttgtcgcccaggctggagtgcagtggcacaatctccactcactgcaacgtctgcctcccaggtccaagagattctcctgcctcagcctcctgagtagctgggattacaggcgcgcgccaccacgcccagctaatttttgtatttttagtaaagacagggtttcaccatgttggtcaggctggtcttgaactcctgatcttgtgatctgcccgtcttggcctcccaaagtgctgggattacaggcgtgagccactgcgcccggccagttggtggtatctcttatacaacaacacacttttgcaagtttactgcttttatgggaagtttaaaatggtttctataagacaaatcgtgaagatataattaaatgtattagtaaggaagaaccaaaggctagaacttattttcaggtaaaagaatccattggccgggcatggtggctcacgcctgtaatcccagcactttggaaggctaaggcgaatggatcacgaggtcaggagtttgagaccagactggccaacatgatgaaagcccgtctctactaaaaatacaaaaattagccaggtgtggtggtgtgcgcctggaatcccagctactggggaggctgaggcaggagaatcacttgaacctgggaggcagaggttgcagtgagctgagattgcgccattgcactccagcctgggcgacagagtgagactctgtctcaaaaaaaaaataaaataataatccattgaaaaaatttcacattgtagactgttgacactatatatagaaattcttcatggaatggaggagtattttgtagcattgaggggtctggcctagcagcaggactccaagggtagaaattgaagcgaacattgttgaatgactatacaaaagtctttttctttgtcttttgctggcgcagacaccatcttgtctggggatccttccccgtgttgataccacccccgcttcccaatgattgctttacgggtgggatgcagttctagccaaggtgaggcaaggtcactggatgcttctgggaaacatcatcttgctcttacaaaacagcttatgaagagacatcccccttcttcctttggaggttttcgtgtctggatgcaatgctctatttactgcattttacacatgaaataacacgactcagaataagacacttgccagtggtaacaaatggcagaacctgtatttgaacaaggtcaaggggtcccagcctattgtttttgccaccacctacgtcacctcccataaaaatagcactctatcatacgttttgcaaagtatttcatactttattaaaaaattcatatgtataccataagaacactatgacataggtattattacacttacttgatctgtgaggcaatagagcttcaatcaggtccacacagctagtaagtggctgggttggcacttgaacccaatgacttccaagtcttctgccctttctgtggtcccagagattactatttaaggacgaataataagatctcccagagatcagaaatgcaactctgaaaacatagactttgtcctatcggttgttggttttcaacctgtgcttttctgagcactaagcgttctgtggaggtactttggggactttgggtggcatggacaatggaggtcatggagaaggatgttagtgggactctagagcctcaccctttgtttacaaggtcaacagagggatctccaaattgatctgttctaaatactgggctcctgaaaaagactccaattgaacaaagtttcattggctttaaaaggagtaagggctaggctgggcacagtggctaatgccagcactttgggaggccaaggtgggaagattgcttggagccagaagtttgagacaagcctgggcaacatagtgagatcctgtctctacaaaaaattaagaagtcagctgggcgaggtggctcatgcctgtaatcccagcactttgggaggccaaggtgagaggattttgttttttctcttttatgaatctcatcattcctcgttaatctgaacatccttgaagacagagttgagtaccttttactctctctttaactcactgtacactctgatcagtggtctgtattcagcaggctgatttatcagatgaaatagaagcagttgatggtcttaaatcagtgttttgtatctagtgataacacttttaggagctatctcaagggacatctgtctctgggaaggctgaggtgttcattttttaaaaaaaatcattagctgattgctcagcttcctgtgtcttgcttccttctctcttttataagaggaagttttacagaccaaatacatttatggccagtaatgcaagtttataaatagggtattttaattgaggttaaatctgtgaaatcagcagaagataaaacatctttccaaaagttagactaatttatgatgatgatgtttctgagaggggcagatgagaatcactttatatatacatacatacatatatatatatatatatatatatatatatatatatatatatatatatatatatacacacacatatatatatatatataggattggctaaacttcaactggtaataaaaatccagcctggtctgaatcagaaaacttactgaaatgtttttgaatgcttttgtgaaacctcagcaggaagttagaatcaacacggggaatccagggcagtaagtacatatgagaaacagtcgttgctctcagcttttaaaaacaagaagtatttgttgctttttgaaagaaagttggcgcaattttaaaagaaatctgacacatgtctaaaatggggtcaggaaaatcccacactaacccctcccaccacccaaagccataagattttccaaactaataagggcattttaaagatccggaagaagctgtcttttttctttcgtttagaaaccatgtttacttttgaggttgattttaacggaatgttagtcaagttatcatctttttggaggaattttaccgttggtctttctagaacttcaacgtgtgggagcaatatcattttctcattgctaccttagaataatcctgagtaacctcgctttggtggttgtgttagtcagggtcccctagagggacagaactaataggatatatacatatatgtatggagtttattaaggagtattaactcacacgatcacaaggtcccacaacaggccatctgcaagctgaggagcaaggaagccagtccaagtctcaaggctgaagaacttgggagtgcgatgtttgagtgcaggaagcatccagcacaggagaaagatgtaggctgtgaggctaagccagtctagccttttcatgtttttctgcctgctttatatttgctggcagctgattagatggtgcccacccaggttaagggtaggtctgccttccctagcccactgactcaaatgttaatctcctttggcaacaccctcacagacacatcgggctcaatactttgcgtccttcaatcccatcaagttgacactcagtattaaccatcacaatggtcataacggcaaccttaacgtcctgttctattgacggctcacgggcacatcctgtgaatggacagggatcctgagggaagacgagtcctggggagggctttgtagccacaggcttgcaggctttgagggtgaaatcttgatttttatgaatttagatgagaaactgagctattaaatggacaagacattggcatttgaggtccactatcttctcagccttccccgctccccaaacagtttccattgtgaaataatctgtcttgtgattatcatatgcttttcttatacgtattcatatatttagttaaatttctgtcttggctggggagatagcgtgtctttataagatgtttgggatacctctgctttggtttaaccatatgaggccaattgattgattgattttatttcatttatttatttatttgagacagggtctcgctctgtcaccaaggctggagtgcactggcctgtcatagttcactgcagtctcaaactcctggactcaggtgatcctcccacttcggcctctcaaagtgctgggatttcaggcgtaagccatcacgcctggcccatagtccaattgatagttctaagttcctggaggcaaggcatctctttgttgctccaacccctttctaaaattcctattttccaaaagtaaagaaaatgcttcaaaaatgtattcttacatactgagtagttaaaaaaaattaagccaaagatcttccaaatttcagaataatttagagtaagagtaaacactttgctttgctagcccttctttgtggtgtcttatgggagaattctctgctctgtgttttagaagagcaatgctaatagctcatacttattttgtactttgtcctaggttctgcagactaagcattttacatacattacataacttaatcttcaaagcaaccacatggattatgcactgctattacttctatgttacagatgagggataggccctaggaggttgagaagcttatccaagatcagggaattcagaaatggcaaagacaggatttgaacccagacacccttactccagggtgtgtctacttaaccactgttagagggccttcaagtccaggggtaaatccaaggactttcagttttttaatttttatttttagagatagtctccgtgtgtcacctaggctggagtgcagtggcacgatcttggctcactgtaacctcgaactactgggctcaagccaccctcccacctgagcctcttaaagcactgagattactggtgtgagcaaccacacctcgccagctttcagtatttttttaaaaggacattgtagttcttgagcaaaaaaaagaaaagagatctctcgtatactttctgtatttttggttttcgttttcatatatatgaaaccagatctcatttataatacattttaaattaagggttaatctactgtttggcaacttggttaaagcagggaaaatgttttacaccacaacaatttcactgggcaatctgttatttccagctaccaaaaaggaaggctagtttttgtgtaggaaaaagctgccaactccatggatcagctctaattgttttttttttttttctgaggcagagtttcagtcttgtcacccaggctggagttcagtggcacaatcttagctcgctgcaacctctgcctcttgggctcaagcaattctcctgcctcagcctcccacgtagctgggaatacaggtgcctgccaccacacctggctaatttttttgtatttttagtagagatggggtttcaccattttggccagactggttttgaactcctgacctcaggtgatctgcccgccttggcctcccaaagtgctgggattacaggcataagccaccgtgcccagcctctaatttttaagtactacatctattgaagacttttgctcttagctgtcttcctctgtcaacatccttggtgacatcagcatccagctatgcgacccatccaaaatcttggccattcagttcgttgatgacatgcctcagaatcaatgatttttttttgcaatatttcaactgagccacctattcccatggttacagcctaggccaggaactgcactatctctggttttaagcatcctactctgcccaccaccgactctcctttcaattcccttaactggaatagccccattgcaacaatgctctgacctcatcaggacctctcagtcattgatcctgttctattttttcaaactcctatattcctttattttcttcctctcttcattttcttgactatccagcttaaattctatgatccatcattataatgactcccttgtaaatacaatcaattaccttgttcctctctctatcttactttcctggcataaccctgaccttggctgaaggtaactatgttccattttctcaaacaatggaaacatataggagaaaaatcatacaattgagctgactggtttcattttaaaatcattaccataaacctcaagggctcactcagcactgctgggtaattccattgtttccctgtatggtgttctccaagtgttagtcattcctctatcatctgtatgacttttgctgtatctgaatactacctatgcaatcatttactaaataatttagcttaagttgattccaattgaaaaatgtacccatatcctaaactttgacctagaccaggggttggcaaactatggcccatagttacctgtttttatatggcccataagctaagagtcagttttaaatttttggttggtttttaaaaaaaagaataataatatcttgtgacacatgaagataagtgacataaaattcaaattttggggtctataggtagttttataggaacatagccacatttgtttatgttttgtctctggttactttcacactcaaacagcaggattgaggggctgcaaaagagactacatgtggtgctcttatcattttgccctgctcatccacaaatcacaaataataggggtacagttataactctaccgtgtttggtaaagtaccgtatgtattgtactatggtgacatttactttacttttaaaattaccagagcttactcatcatgttaatacaagaaacgtggattttggatgtcatgcttttaagacagtggatagtagattatatttgtagaattaaatgccaaagcattatgtttactataaacatgacactatagatgtgctaaaagaatacttagacattgacataactagactaagcacttgttataatatccttaactcacagaaaagtaacagttagaaaaattagaaaatttaaaatggaatatctgaccacagcagaactgtctcacaaaaataaaagataaaatgaggccgcaaccaaagtcagtttctgagtggttaatttattagccaggcaaagagagccatttaccaatgttgagttcattaaatcatgtttaattgctgcagccaaagaaacgtgctcttagagaagataaacttgcctttcagtgagactggttgttcagggttgaggatgttgggagcaacatgaacatatttttgccttaaaaacaaggcaaatgattttctttggctcttgacaagttcacaaatgttaacaatactgagcagttgttatttgaaatatcagtgctaagactgaagtaatcaaaaaaagcctgtgtggagagaatacaggtgagaatattttaatagaaacagaaaacacgaactcagtacaatctgaagtagaatctgataagatgtgttaaaactgatgacggtaaaaatatgtgttcaccagaaaagggtttaattgggtacatttacaaagcttttgaaaatgaaaagcctgtggtttttcatgatattattcatcagcaaacacatcacagaaaatatttgtatttatcaggcattattaagtcagtagtgtaaatgttgaacttcatcgctcttgtggacttaaccattgtcacttctacaagtttttgctggaaatagaaaccatatatcctgacttgctctgatgcacagaaatttgatggatcagtggtgacaatgtttcatttcaattttttgaactcagggctgagatggaaagtttttccaaataagaaacacagccttcagtcagtattattgaatactgaatggctttggaaattagcttttgctgtagagttggtaatatttattaatcaactcaaggtataattacaaggtaagacagtactatatgcaataactgctaatgttgttctaagtacaggctgtcaagctgtcctatatcctttctatgctgatgaaatttaaaacaagatgtgaaatcttcattctcacacaaatattcagccctcaatgcacatgcaaaggaaattcccatatttcaaaaatatattaatattcaactgtagttgaggagcttccatctaaccttcaactggaggcttttaatctgcagcgtaatgacatgctaaaagataaatatcaacataaaaatctaaggtaattttatagatgccttctgagtgattaatatgctcaatttaaatcacatgcttatgaaatgaaagcaatagttagcagtacccatctgtgtgaatgacatttttaaagatgaaacatgtaaattttcattccagataagcattaagaagtggaaatttggccaggtgtggtggctcatgcctgtaatcccagcactttgggaggccgaggcaggtggatcacctgaggttggaagttcgagaccagcctgaccaacgtggagaaaccccgtctctactaaaaatacaaaattagccaggcatggtggcgcatgcctgtaatcccagctactcgggaggctgagtcaggagaatcacttgaacccaggaggtggaggttgcggtgagctgagattgtgccactgcactccagcctgggcaacaacaacaacaaaaagtggaaattaggaataaattttgatgataggaaacactaactttgagccttagtgaagaaaaatgttattcatcccccaaactaattatgttcttattagtagtagacttcagctcttctagggaaacccccaaagggaaaaaaactttaggaataattggctgccaggtgattcagaggacagaggattcaaagaaggctcgtggagctcttgcttcaccccagactttccataatcctcccgattggttgacacttttcctataaaaaaaacatgtgatgtggtccttctggcagtcctttgctagaaagtgctttctcctcctagaacagaaaaatgttaacattgattgcccagtttatccctctaaatttttccaagaatattaaagtattttaaacttgcaatttcacaactgaaagatcacttcagtaagaccatgaatggtggtattatattatatacaacaaatctttttgactagttaagaaaataccaattaaaacagaattcaaatgtattgaatttacagtcaaataaacatcatataggaccagaaaaatatgtttattgtaggtgttttttagaaccttatatttacccaactaaaatgtcttgaaatgtactttacatttttgataagatgttttttaaaagaacaattgtgatttaccttaatagtgaaactgaaggtctttcagtttatttttcataaagtgagctctcagtggttctctaagcttagcgtataataaagttataagatggatcacatttattttaggtgtaaaaatatattggaaacagtcatatgtatggggaaagatagaaaatggaccttaaaataaatgaaatgaaatgtatgaaaatctttggaaatgacactgacaaattgtttgacaaccaactttatgtcacaatagaacaaataagggacggggatctgttttaggatgaattaaagtcattgctgaagagtgttcatttattagataaatcaggatcagcaaacaagtgaaacaagtctaggaaaggactgagaatggctttaaagacctttaagagctgccactcgcttggaatagcaggtttcagtggtctgtacttcaccaagtaatcttctggtagatgactgaaggagctgcttgcaggttttgagaacatttcgttcagctaggacttagtccattcaggctgctataacaaaaataccttagactggggaatttataaacaatagacatttatttctcacagttctggaggccagaaagcccaagatcaaggagccaacagattggtgcctggtgagctcctcctgttccttatggatggatggcaccttcttgcggtgtcctcttttttttttttgagacggagtctagctttgtcacttagctagagtgcagtggcgcaatcttggctcactacagcctctgcctcccgggttcaagtgattctcgtgtatcatccttcctgagtagctgggattataggcagccgccaccacgcctggctaattttttgtagagatggggtttcaggctggtcttgaactcccgacctcaggtgatctggccaccttggcctcccaaagtgctgaaattacaagcctgagccaccatgcccggcctgtcttgctatatcctcacatggaggaagaagcaagggagctcactcaagccacattttttaagtttcagaaatgttgctttatatatagatatagatagatatgtctttttaagaaagaattttgcttttgaaaattttttcttcatttaaaaattttaatttttttttttttttttttgagatggcgtctcactctgtcgcccaggctgcagtgcagtggtgcaatctcggctcactacaagctctacctcccaggatcacaccattctcctgcctcagcctcccaagcagctgggactacaggcgcctgccaccacacccggctaattttttgtatttttagtagagacggggtttcaccgtgttagccaggatggtcttgatctcctgacctcatgatccgcctgccttgtcctcccaaagtgctgggattacaggcgtgagccactgcgccggctaaaaattttaatgtgttttttaaattgacatatgattgtatatatttatgggattcatagtgaagttttgatacaaataatatatagtgaccaggataattagcagatccatcatctcaaacatttattatttctttgtattaggaacattcaatatcctccttctagctatgtgaaactatataatgtactatagtgaacagtagtcatcaaacagtggtatggaacactagaactgattccccttgtctagctgtcactttgtatcctttaacaaatccgagccacttttagaagggctaatgtcaatcatgagggtggtgcccccatgacttcatcatttcccaaaggccccacttcttagcactatcacaatgggtattaggttccaacaaatgaatttggggtggcgagcaccaacatttagatcacagcaagtgtttaggaaaatactaaaattaagcctactcttttaaacaacctttagacaattaaaatgtcataggagtgatttcagtgacaagttttcaatcggaagtcaaaagctccaaaagttatcatattacaaatgttcccgtgagaaacatgtacatctgtaaaacaaacaagcaaacaagcaaaaggaggaaaccagagttctaaacttacgacaccacaagaaaactccaaaacagaggtctgtacggaggtattgtgggccacacggtgctgcccacacacggggttttgtgagaggtctggactggaacttgtttgtacattttttcttccctcctttgcttaaactgttatcagacctagagaccgcccccctccaactcccagcctgaaatgttctaccaccatggtcccagctagcccaaatcgtcatctcctccaaggtccagacctcggggtccccccagctcaacttctttgacgtcatcacatcatcagatgctgcttgaagagtcacttggctcatgtcttgatatcccagaaatctcaaaggcatctggggagggctgagccaagtactttttctgcctccagttaccacaaaatcacattgttttatacagagaaaaatctgtttcatgctgatttttaaagactgcaaatttatatcttctattctcatgaataagagctacaaggttgaccaaactgagcagaattaggctttatgacatgggattcttaaacaattggattagagttaatggagaaggatttccatctggttctcttccaggtgtcttgagttttcatcaattttgtgtttcctctggcagtgttggttcattgaaaatttaacaagtttggccgggcgcagtggctcacgcctgtaatcccagcactttgagaggtggaggcaggtagatcacctgaggtcaggacttcgagaccagcttggccaacatggtgaaaccctgtctctactaaaaatacaaaattagcagggtgtggtggcacatgcctgtaatcccagctagtcgggaggctgaggcaggagaatcgcttgaatccagggggcggagtttgcagtgagcagagatcgctccattgaactccagcctaggtaacgagcgaaactctgtttgaaaaaaaaaaagaaaagaaaatttgacaagtttgtagtggttctactgcaaggaaaaactacaacttaaaaatgtgtttactccaaattgtactattaataggagatttctgaaagcctaagttttcattaagaactttttctttaacggtgcatcaagtgaaagccttgagatgattctggattagatatatggcaaagttaccgtgagctcaaaagccattgtccagatgaagaaatcctcagggtcaatatgaatgcacataggatgactgatggaatccaagaaaagctgccatagctctgattttgcctttttgtgttgtctttagagacatgctcttgctctgtcgcccaggctggagtgcagtggtgatcatagctcactgcagccttgacctcctgggctcaaagctatcctcctgctttagctttcttttttttttttttttttaagatggcgtcttgctctgtcacccaggctggagtacagtggtgctatctcagcttattgcaacctccgcctcccaggttcaagcgattctcctgcctcagcctcccaagtagctgggattacaggcatgtgccaccacacctagctaatttttgtatttttagtagagacagggtttcactatgttggccaggctggtctcgaactcctgacctcaggtgatccacctgcctcagcctcccaaagtactgggattataggtatgagccacctcacctggccccgccttagccttctgagtagctaggactacaggtgtgcaccaccatgcctggctaatttaaaaaaaaaaaaaaaaaacttgtagagatagagtcttgctgtattgcccaggctggtctcaaactcctggcctcaagcaatcctcccacctgtttgatttcatgtgtctcaaacagcataggagtctactaaaggcttttttctttttttttttttttttttttgaggcagattcttgctctgtcacccaggctggagtgcagtggctcaatcttggctcactgcaacctctgcctcccaggttcaaatgattttccctgcctcagcctctcaaatagctgtattacaggtgtccgctaccacgcccggctaatttttgtatttttagtagagacagggtttcaccttcttggccaggctggtctcaaactcctgacctcaagtgatccacccatctcagcctcccaaaagtgttgggattacaggagtgagccaccgcgcctggcccaccaaaagctttaaagtgaggtgaatgcagattccattttcagattctgctacaaattgtgggaccttaaacaagttactcatcttctctgtgctttagtgttatgatctggagcctgatcttcattctaccacttaccctgtacatcttggaaattttattttatttccctgtgactgttgccttgtcttgcagatggattattctaacatccacttcataatcttgtttcatttaaggagattgatcatacgtgggaagcacttagaacagtgcatggacgagcacgagtatttcataatgagcagctgtggctgttactaacactggtattactagtacccgtacttccaggcagggttgttgagaaggtgaaatgaaagaacgcacaccagggcaggctacataatttgtggaccccggtacagaatgaaaatgcaggacaccttgttcaaaacttcctaaaaacgtcaagactgggacagctgagtattaaaccaagcgcaggacccggacctgcacaggttgcacgctcgcagacacatttgcacacagtgtgtgctaaataaatgctccgttcacccttgtgaagtttcctatgcctcactcgcgccagcaccgttcacagtgcccactggctgtatttatcgctgacataaggatgaggcctggaattgcattcactgcagagtcccaccgggaggaccgaccgttatccccgccgactccccccaggtcgccctggcagtttcggccgctcagttgcaggccctcgccacggaggccacgctcgggggttcggggtccaccccggcctcctgcggccgggccaccctactcgcgcgcagccgcgcgccgccgcgtccccgcggtgtttacccgttgcccgaggagacacccgcgccacccgccggctcccggcgccgccgcttcctcagggccggttccgggtccgagcgcgcccccgggctcgggtcgtcatgagcctggactgcaccagccatatcgcgctgggtgccgcttcgccagcgcccgaggtacggtcccagccgccggccgcgcgcgggggtggccctggggatagacgacccaggaggggccgaggcgcccctgatttgcacccttttcctcccggaggcgtgggcagaatcagagcagctctgtgcccgcgagggctgtggcctgggactgccagggcgctgatttcaggaggggatgggcaggaccggagtttgcggagcgcgtctgaattttaggttgtgccactctgcttctctgaccatttaaaccggtgacattcgaaagactgtggccgggcagttcctccccgccacccctgggagcaaagaattccttcatttaactttccctgcttagctactgaagtgtgcttcggagcaatttctggaaaatctgatgtggcaggaggagggccagcccggagtagagtcaccggccctttcgttgcgaagtaatccagaaacgttggtaattcagttgttcctgaatgcatctactcatttactcccaggagttacttaggtactggggactttcaggtattagatgtaccaatgcgcgcgcgcacacacacacgaacatgcgcgcatacacagacgctcgtgcacacacgcgaacaggcacatacgcgaacaaacacgggcgcgcacacacacgaacacgggcatatgcatacttgggcgcacaagaagatctggctggctcagtctgggttaagaatccccctttggccttggcatcggggcccaccgggtatcgtgtgtattgggagtagttgccagagatgggggaattgtgttcagctcaactgctaaccgcaagtaactcacccaattagtaaatgatggaggatttttctttctttccaaagttttggacttttcctaccacgctgtgtactgaccatagatatccctgggggatgtagtggattcaaaacatgagttggattctccaacgtgccatcggaattcttctaatattcagcagctttgattgttgttttacatctgacctgtatttagatttctctgattcctggaatatttgtggaaaataagtaccactgtgtgcaaataaaactattttttctttctttctaactcagaggccagttactagatgttttttctttcatctgacattttcatatttgactttattaatttttatcccaatgtggtgtcttaaccatacataagtatgtggtatttttatattattaatatatattttttttggtgagcccattgagagtaaattacagccatcatgattctttctttctctctcctttttttctcttgttctctccctccctccttttctttctttcttctttttttcagacagggtctcaccttgttacccaggctcgagtgcagtggcacgatctcggctcgccgccgccttgacacccctgggttcaaacgatcctctcacctcagcctccagagtagctgggactccaggcatgccatgatgcctggataatttttgtgttctttgcagaggcagagttttatcgtgttgctcaggctggtctcaaactcctgagctcaagcgatccacctgcctcagactcccaaagtgctgggattacagagatgcactaccatgcctggtcccctatgacctttcatctgtaaatactctggtgtgttatctcctatgaataagggcattctctaacgaacatacaatgatcaaaatcgggatgtttagcattgtgacaataatattatctaatatacacgacctactaaaactttgccacttgtcccaattatgccatttattgccaattttttttccatctcaggatcacacactgtatttagttatgtctccagtctcttcaaacctggaacagttcttcacattttttttgtttgtttttttgtttgtttgtttttgtctttgatgatactgacatttttgcagagtccaggtcattcgttttatagagtaagtttctctgattgtccttcgtgattagatttttgggtaggaataacataagagatgttatgtctcagagtatcacatcaggaggggcatatatcagcttatcccattattggtgatgtccccagctggtggcctctgccagatttttcccctttagcaataaataagaaatcatattagttgagtaataatattgattcggatagaaatttttagcataagtcactgcctacaaaaggaaaatgtccattaagcatgagattttaattggcttaaaataactaaattttattgagaacaaaagtagctgcagaaaaggcagcatttattacaattaaatgttcagtttgcaaaatactttatctgagatcatcttataatttagataggcggggcagaaatttctcactatataagatgaggaaatagcttactggattagaaatgatggagcagggacttgtatctttctttcaaaagctttgtacttttcctaccatgccagactgaaaacattaaattacaaagcagtgatagtctgcaactttctggaaaagtaaaatactgtagagactgagatactagttttagactcaaaactagattcaaacaatcctgattataccactcatctgtgacatcttggtcaaaacaattaatgtatcagcattttagttttttcttctaaaacatggaatcataaaacttatcgcataacgtagtttgaggatttcacggttaataaatgtaaggcactcaagagagtgtctgacagaataagtgcatatcaatattagctatcgttattctttgtaacttttggaatttgctttggtgtcaacaccactgcacctactcctaccatcatcaccaatgcttccatcagtacttcagccaccatctcaatagtcagtgttttgagaatctgtaggagggacagaggatacaaaaatgaattggagattgaccctgctcataatgaagaattgacagtttacaatccactttgggaggcagaggtgtgtggatcgcttgagcccaagagtttaagaccagactgggcaacatggcaaaaccccgtctctacaaaaaacacaaaaagtacccaggcatggcctgtagtcctagctacttgggaggctgaggtgggaggatcacttgagcccaggaagttgaggctgttgtgagccttgatcgcactactgcaccccagcctgggcaacagaacaagaccctggctcaaaaataaaataaaaattaaaaaagagtttacaatcaagaaaaacagacacataaaaagattactccttcatcaacactaaaatttaatgctgcactcttctcaagttggatttacctataatgcgatcaccagcacagccttactgggatggaaaatgtgacaaatactaacagcaatattatgagaattgaagtggagcagcccaaacatgaaggaaagagatatgctttgggggaagtttacaaacatagctttcagtaagactgcataactttgtcatgcatttgaaataacgctacccagtgaaaatgtgctgggtgcggtggctcatgcttgtaatcccagcactttgggaggctgaggcgggaggctcacttgaggtcaggagttcgagaccatcctggctaacatggtaaaaccccgtctgtactaaaaatacaaaaagtagccaggcttggtggcaggtgcctgtaatcccagttactggggaggctgaggcaggagaattgcctgaacctgggaggcagaggttgcagtgagccaagattgtgccactgaacacaccatctcaaaaaaaaaaaaaaaaaaaaaaagaaaagtgacctaattataaaataggatcaccagtcagcaaaaagctgtagcaatagttctgtggaaagtgcttggattccaaatcctctgacaccagtgagaagccacagacatatggtggcttgtaggctctcttgctgtggcagtgttttcacatacctggaaaacctagatcaaagttacagctccagtagataccattgttgggaatttgagcatctctttcctttctgtaaaacaagggttaattagaataactatcaacagaattgttatgagaagcaaatgtaaatagcaacacactctatcagcagctatagttcctcaaaacaaaggacttagagctggtcatagctaactataaaggagttaaagtctgttttcctttttcttcccatcatttctacttttaaaaacctcatataaaatacatataacataaaatttgccatcttaacttacaaatgtacagtttagtggcattaagtacattcacattgttgtgcaactgttgccacaagccatcttcaaacctttgttcatcttgcaaaactgaaactctgtactcattaagcaataacttcacatttcctcctccccacagctcctaacaaccaccattctactttctttctttatgaatttgactattctaggcatgctgtataagtggaatcagactgtatttaactattctaggcatgctgtataagtggaatcagactgtatttgactattctaggcacggtgtataagtggaatcagactgtatttcagtattctaggcacgctgtataagtacaatcagactgtattaaactattctaggcatgctgtataagtggaatcagactgtatttgactattctaggcacgctgtataagtggaatcatactgtatttgactattctaagcactctgtataagtggaatcagactgtatttgactcttctaggcacactgtataagtggaatcagactgtatttgactcttctaggcacactgtataagtggaatcagactgtatttgactattctaggcacgctgtataagtggaatcagactgtatttgactattctaggcactctgtataagtggaatcagactgtatttgactattctaggcatgctgtataagtggaatcatactgtatttgactattctaggcacgctgtataagtggaatcagactgtatttgactattttaggcacgctgcataagtggaatcagactgtatttgactcttctaggcatgctgtataagtggaatcagactgtatttgactcttctaggcacactgtataagtggaatcagactgtatttgactcttctaggcacactgtataagtggaatcagactgtatttgactcttctaggcacgctgtataagtggaatcagactgtatttgactcttctaggcacgctgtataagtggaatcagactgtatttgactattctaggcacgctgtataagtggaatcagactgtatttgactattctaggcactctgtataagtggaatcagactgtatttgactattctaggcatgctgtataagtggaatcatactgtatttgactattctaggcacgctgtataagtggaatcagaccgtatttgactattttaggcacgctgcataagtggaatcatgctgtatttgactattctacgcactctctctgtataagtggaatcagactgtatttgtccttcaatgactggcttatttcacttagcataatgtcctcaacgtttcttcatgatgtaacatgtatcagaatttccttcctttttaagcttgaaatatattccattgtatgcatatgtcatgttctgtttatccattcatctgtctctgcacacttgtgttgtttctatcttttggctgttgtaaataatgctgctatgaaaatgagtgaaccaatatctctgtgagaccctgctttcaattttgagggatatatacccgaagtgaaattgctggatcctatggtaatcctattattacttttttgaagaactgccactgtttccgtagtggctgcacacattttacattctcaccagcagtgcacaaaggttttcatttctccacatcctcacccccacttgttattttctgtgtgttttcttcctttattgtagcctttctaatgggtatgaggtagtatctatttccactttttaaagaaccatttcctccctcttctggtttgctctgttttttttttttttgttctactcctttttctcaaaatcaagtttaagaagagatctgactctagttgcatgtcttcatatgaacttaagtcagaagccttctctagatataaagaaaaccaatctccaccccaccacccccaaaaagagaatatagagaaaaagaaacagaaggaatagggaaaaaagaaaacataaattatagttgaaagaaatacaaacatatcagtaattatgataaatatatatggagaaaatgcttagttaactaagaaaagccatattgcattaaaaaaatctaaatatatactatttatgaaagacacatttaaacaaaaagatatgggaaggttgaaagtaaaagtgtataaaaatgtgtatcaggcacataacaaccaaaataaaattgattggctatattaatattatgcaaaatactttaacacaagaaaagcattagtagtggtaaagagagtcactaaataatgataaaaatttcattcatcaggtagttgtaataattctaaatgtatatgttcctaagaacacagcatcaaaatagaaaaacaaaaattggcagaagcaaaaatctataaggacaaatagacaaatccacaactaaagagaatattttaaacatatctcttagtattttgtagatcaaccagacaaaaatttggtaagagagctgctaaaagtgctaaaatgcaaatttggtgacgtcactgtgaagaatagaaatatgtaaaatatttgggatgtggctgtaaaaattaacaggattatttttccccaattacccaagggaataaatgccttttgtctatgaaataataagccagacaaaagcttagaaattgtactctattggtaggaagtgaattagatgagtaattaaatgtttccccttgttttaaattaaaatgctttatactattaaaaataatgactatctaattatgagcaaacgttagacaaacccaccttgaaggatattctacaatatgttgaccaggactcttcaaaagtgtcaaggtcaggatttggggagactaaggaaaaatgaaaactaaatggcttctggactagaaaaaggacattagtgaaaaaaaaactgattatattggaataaggcctattacttagttaatagtgttgtaacaatgtcaatgtcttggttttaatagattaccttagttgtataagtcgttattattaggggaagctggctagagggcatatagaaactctgttttgttttgtaacttttttggaattctaaaattatttcagaataaaaaagtctcaataaatgataaccagttaatccgtttacacatccaacttcattttagctttaacatttagtttctcttggtatctatctgctctttgaccacctggctttagagatgagataaaatcttcaaagaaaaggtaggggagagctttttgaatgccaaactttttctttgcatattttaaagagactgcttgtgtatttacttactgttaccaaatataatgtgtagtgtatttcaaacaatagtgaatactccttggtttgtacttgaattgagttgactaataattataaagacttacttttttccatgttcaaggacaacttgattttttttaattgaaaaagggagtaacatttgctgagccaggaattatttatgctatgctcttttacccaaggtttccttatttctttgttttgcttccaactttctttcctttgatattggtgctttggtggctttgatctaaggcagagaagttcaaaggcattgctgaggcagaccagtagcacctcattctttctcttactgataccagcacagctattgctgatagtttatatatctacatgttcagatattgctcataaaaataactgtctaaaccaggcatggtgacccatacctgtaatcccagcaactcaggatactgagactggaggatcgcttgagcccaagagtttagagactgcagtgaaccacgatcacgccactgcactccaggctgtgtgcagagcaagactttgactctaaaaataataatgacaataataattagtaaataataaatcaataaatatctgagttccctcattagtgccatagggagtgggtcagtctcataaaaataaatatctgaattatatttctgagtaactgaaatgacttccttttcattgactgaatttcccttatgcttttcttcttgaatcttccttattagcttcatataaaaatgcatttttcagcatattaaggccatcatagtctaacctcaatatctgtgcaagaaggaacaattttaagacttgactataattgtcccatttccctaagtcttttctacttcagactaaaagaaatggatagttgaacactgaaaaggaactcttattgttgaaatcttatgaatgtttggagtaagcaaaaatgaaaactcaggaggaaatgggaaccataaatattctgcttagtgaatcatacattgtattagtcacccacttgacaaacatttattgagtcttaggcactctgttaggcactgaagataaagaacttttttccttgaccaactctaaaatgagtgcccattttcaagcaggtgctcttttagatacggtccccctttcacaaaagttatatccgcggccaggtgcggtggctcacgcctgtaatcccagcactttgggaggctgaggtgggaggatcacgaggtcaagagatggagaccatcctggccaacatggtgaaaccccgtctctactaaaaatacaaaaaatcaaaaaattagctggacatggtggtgcgcacctgtagtcccagctgctcgggaagctgaggcaggagaattgcttgaaaccgggaggcagaggttgcagtgagccgagatcacgccgctgccctctggcctggcgacagggcgagactacatttaaaaaaaaaaagttatatcctggtgtgagaaatagatttttaaaaagtaaacaaatagacaaacaaggtaattttagagtgttaagtcctttgaaaagaaaataaagcagaataacaggatggagatggaatggggtgagggctaaagtctagtctgggtagggtgggtagggttggctccccaaggagataacatgctgaattggaatagtcttagaaacagcaagagcggtgccaggcccttgggtgggaatgagcttgatgtgtttatttttatttttatttttatttttttgaggtggaatcttgctcttgtcacccaggctggagtgcaatggtgcgatcacagctcactgcaacatccgcctcccaggctcaagcaattctcctgcctcagcctcccgagtagctggggttacaggcatgcaccaccacgcccagcaaatttttgtatttttagtagagatggggtttcaccatgtcgtccaggctggtcttgaactcctgagctcaggtgatccacctgccccagcctcccaaagtgctgggattacaagggtgagccaccgcgcccagcaatgtgtttagaaagagtgcagtttgtggaatgttcctcgatttgggtatatctaatgttttctcatgattagattcaagttaatcatttggggcacttttggcaattggataagaggtgtgtttttctcagtgcattgcagatggaaccttgtgccagaagacaaaaaaaggctgcaaaactgttccagattcaacagactaaatatacttggcagctacatgcaatgcatttattgtttctctaaggaacattattgagataattggtgaataatatagtgtcattgttaaatttcttgaatttgacagttgtatgaagaggaatgtccttgttcttagaaaatacaagctgaagtgtttagaggtaagggaccatagtgtgtgcaaattgctcacaaatgattcagcaatcatattgtaatatacgcatagagaaaggaatacatcaaatgtagcacaatgttctcacaattggttaatcaaagtgaaacatacttgagttccttggattattcttgcaacttttccgtaggattgaaataaaaatgaaaaaaaaattatgtgccaggcaacaaatggagttaaaaagtagaaggcattgtttcactccaactatggagcttacttacagttgagttaggtaaatagtaattggtaataaataaaatttttaccaattttaccaataaaaaataattggtaataaataaaatttttaccaattttaccaataaaaaataattggtaataaataaaattttaaaaaggaagaaggcaagcatcactagagtaaatatatggtctcagagaaggacctagagggacagacacaatgaacaaacagaattacacagtgtgctgtagcagaccagggagggacgagggatgggaagttttgctgaggttactggggcaatggtggtgatggtcagggggtaatgctgaccttgatgtgccatcaggacatgcaaatgatggtcactagacggttggaaatgtcagtctctagttagagatgcagatttgggagctactagatactggaagtggctgagatcgcaggagggcatgaagtaaaccggtgagaatgtcccagtgatgaggagagagcgtcgaggacagaacccagcaaatatcaagttgtgagtgggtgaaggaagtgagctgcagtagggactgagtggagggctagagaagtgggaaaaaggagagacgctcagtagagaatgggggcgtgagagtaaggaggattccccagcagtaagtgatttgtgtgtcaaggcccaaaaaggaggtcaagtcaggtagagagtaaaaagtgtcacctggacttggtggcccgcggagctgcccgctggcctcctgggcacttctcttagtctttgtcattcattctactcctaggagctgtgctgcccgcagaccttctctgagaggttcccttctcagtggcctgcatactaggaagccaggaaccagctggagtgtttatgcccaccaagcatccaggtcccaagagggcaggcggcatctcagcactggtcctgcctcccctttcccctgtgttggtggcacacattccctttcaggtgggaaaatgggtcccatacggattgttctccactctaggattaaaagcaaggattcttactgggcgtggtggctcatgcctgtaatcccagcactttgggaggccgaggtgggcaggtcacgaggtcaggagatcgagaccatcctggttaacacggtgaaaccctgtctgtactaaaaatacaaaaaaattagccgggcgtggtggctggtgcctgcagccccagctacccgggaggttgaggcaggagaatggcgtgaacccgggaggcggagcttgcagtgagccgagatggcaccactgcactagagcccaggcgacaaagcgagactccgtctcaaaaaaaaaaagcaaggattcttgtgctgtgactcctcaaggctttgctattgatatgcaaaaccatgcttttgaaattgtaattctacttctgttccagaaagcctacttcttaaaaatcaagaactctaggctggtcatggtggctcatgcttataatcctagcagtttgggaggccaaggcaggaggatctcttgaagccaggagtttaagaccagcctgagcaacatagtgagaccccatctctacaaaaaaattaaacaaacaaacagcgggcatggtggtgtgtgcctgtagttccagctactcaggaggttggggcaggagggtaccttgagcacaggagttcaaggctgcagtgagctatgatttgtaccacttcactccagcctgggtgatggagtgagaccctgtctctaaaaaataaatagagaaataaaagaattctatagctctggaaatcttccagtgttggcctgagttatatcctcatggacccatcagcaatatctacccacaaaatatacctccaagtaatggaatgaattgacttattacgtggatttatttagaattgacaattagaattttagagaataattgccaagaaatgattatagttttgaccatattggctgttaagtgtttctttctgatagtaattaaccaactatttaaagtcatgtctggttcacgattttaaaccatgccatttgagtagagatcaatgcctgtgcttctattcgtgaaggcaaatgggcagactgacatttacctaacagtgaaattaaaatattcagatttattcaagcttacaaagatagatttattcaagatgcaggcgatagagtttcatttcacatcattttgacctggagacagtttattccttctccaatcctggcagggatatttgcatgaagatttttgtaaccttgtgtaatggtctggtattaaccttaagaccacactcttttggaaacacaggatgtgatggttcattttatgtattgctgggaagtttttttggttttgtttgtttgtttgttcttagatgagattagcatttaaatcaatagactgaaagtaaagtagatggccctctgtaatgtgggtgggcctcatccaagccattgaaggcctaaagagaaaagactaagatttcccaaggaacagagaattctgcctccacaatccctttagacttgagctgcaatatcagttcttccctgggtctcggggctgctggcctgtcctgcagatttccgacttgccagtcaccacaatcttgtaaaccagttccttaaaatgaatctctctctatgtacatacacatcctattggttctgtttctctggagaatcctgactaatacacaggggaacttcactgtgagtccttccatgcttgaggggtttgttgaaatgaggggatctggagcccacacagagggcagggtatagctaggcccacaggtacttcacacacagacccaaagctgggaagagcctgttgtagcccctgcccaatttcgtagagagacagggctgaccaatccatcggtgctcacggtagcctaacatacttttaaggatccatgagaatgttctatattttttttaatcagtagagaaaaaaaaatgagctttgaagttgaaaaaattacagatgatccccaacttatgatggttcaacttagaatttttcaaatttaccatgggtttatgaggttgcaaccccattgtaagttcaggagcatctgtgttttgatacataatattttgatatattcatctttatactaatgcagtcacaaaaaattatttttaatatcttctatgaaagaagggacccatgaaggcaaaagtgtatagggcccacaaaagttataaggcagccctgtagggagatgaaactgtgtgtagaaacattatgtagaaaacattgataaatattggccaggcgcagtggctcatgcctgtaatcccagcactttgggaggccgaggtgggcagatcacgaggtcaagagatcgagaccatcctggccaacatggtgaaaccctgtatctactaaaaatacaaacattagctgggtgtggtggcatgtgcctgtaatcccagctactcgggaggctgaggcaggagaatcgcttgaaccagggagtcggaggttgcagtgagccgagatcgtgccactgtactccagcctgataacagagtgagctccatctcaaaaaaaaaaaagaaagaaagaaaagaaaacattgataaatattaataatagaagagttactactaggtgatagataatagaaaattcagtcttaaagttgtttgctcctcttcctataggttgatatgaaactgatgagtattgaaatgacatccaacagtcttcagtctccctagttccacagttttgtggcactagagcattgctcttttggaagatggcattaactatatttcaagtctatgtaagggaaatattcctgaggagctaatttaaatcaatagcttattaaggtttcaagcataccactcaacatatgagctaaaatattacatctgctgggcccagtgtctcacgcctataatcccagcactttgggaggccaaggcggatggatcacctgaggtcaggagtttgagtctagcctggccaacatggtgaaaccctgcctctcctaaaaatacaaaattagccaggcatagtgggggggcgcctgtagtcccagctactggggaggctgaggcagaaggattgcttgaacccaggaggcagaggttgcagtgagcaaagatcatgccattgcactccagcctggatgacaagaacgaaactccatctgaaaaaaaccaaaaaaaccccaaaaattagccgggagtggtagcgtgtgcctgtaatcccagctactcaggaggctgaagcacaagaattgcttgaacccaggaagtggaggttgcagtgagctgagatcacaccactgcactccagcctgggtgacagagtgagactctgtctcaaataaataaataaataaataggccgggcgtggtggctcacgcctgtaatcccagcactttgggagcctgaggcaggtggatcacctgaggtcaggagtttgagaccagcctgaccaacatggagcaatcccgtctctactgaaaatacaaaattagccgggcgtggtggcgaacgcctgtaatcccagctacttggagggctgaggcaagagaatcacttgaacccaggaggcggaggttgtggtggggcgagatcatgccattgcactccagcctgggcaacaagagcgaaactccttctcaaaaaaaaaaaaaaaaaatacaaaaataaatattacatcttagaaaaattttcattttaaactaaaatttatcaagtgtctaataataagtgaagtgaaaaaaatcccatttgggaagagttctaaaatctttaacatgtggaaagatctctttctctctctctctctcccccctttcgctctctctgtctcatctatctatctatgtatctatctatctatctatctatctatctatctatctatgaatgataatgatgaataaagtgtctcatctcgttgtcaacagggacttctcattccaccattcctttctcagtggctattccatatgtgacattgttcccaaatttgcattcattattcttgacagctatacccaatacctcccatggaggtagatcctgtacaaatgctaaaaaactgctagttgcttaaaataggacctgaagttaattaattttttgagtccagcctaagaaattatcttactaacttgaacagatatttttaagcttcatagaactttatattaaactaaattataagctcccaaatcaacaagatccaatctgtacatttatgaatgtgtacagttatgaacgtggaagaatccattttccaaaaagtggttagaaagagatttatgaattaattaaaattaaatcaattatttgagcttaacattacttatggaaatgcaagtgattgttacaatagtcttggagacagcaatatcaagcatcagaaaatcattcaatttagggaaaggtgatcatttcaacttttagccaggcatatatgggacaataacattgtgagtaagaggccaggcgtggtggctcacgcctgtaatcccagcactttgggaggccaagacagctggatcacaaggtcaggagttccagaccagcctggccaacatagtgaaactccgtctccactaaaaatacaaaaattagccaggcatggtggtgcgcgcctgtaatcccagctactcaggaggctgaggtatgagaatcgcttgaacctgggaggtggaggttgcggtgagaaaagattgcaccacagcctaggcaacagaaagagactccgtctcaaaaacaaacaagcccataaaacaaataaacaaacaacaacaacaaaaaaacattctgagtaagagcatgggctttggcgtcagaaagtcttggtttgaattcttactgtgtcattttgttcattcattcctcaaatatttactgatactcagtcactggggctacagtgatgaaccagaagccattcttctatctctgtggtagaaaaagagcttccgagaaaaatttcacacttatgctaattctagaaatgagttatttattacagtaaaaactgaagaaaaaggcaaaacaaagcattttaatgttttctgattaacaagtgaatttaaatgtcatatatcagtgaggttacagaataaagatactgaagtcagagagggtgtgttaatataatttcccataatgtacgtctgccatgcaaaaaaaacccttgagattaagattcgatattgcaaaggaggtgatgaggagcttttaaagatagaatgagttaaggaaataattgcaaacttattagtcaggacactcataacaagatacagaaaaatcgtaaattagatagaaagggactttcaccctaacaaatattaaggtttataattttataagtaagttttttttcttcttcttttttttttatagagtctcgctttgtcacccaggctggagtgcagtggcacaatctcagctcactgcaacctccacctcctgggtttaagcaattctcctgcctcagcctcctgagtagctgggattacaggtgcctgccaccatgcctggttaatttttgtatttttagtagagatggggtttcactatgttggccaggctggtctcgaactccagacctcaggtgatccacctgcttcggcctcccaaagtgctgggatttcaggtgtgagccactgcacccagcctcaaggtaagtattttatagatgttttatagttttgtccttacctaataagatgtggatgaacaattcatggctttgcctctccagtgtatcttggtcgactgtctactacgctttccagttcttctaaaactcactaactttgcttctaagtttttgtctagcgagggctaatttttaaaatagggggtttattatttcctggttttacaagacgtagtgaaattccatctatacttgttctagggggctattgtttgccccctagagtataacactagtaaagtgttataattaagttcagccaggtatttttatctttgacgtgctaaccctgtaaagtgaccagagggaagaagcctttctgtttgtctatttatcttcccatccatgtgctcattcatttatccatccattaatttattcaacaaacattaaatgtatattcattcaccagatatttatggggtgttcattatgtgctaggaaatgtgcttggtgctaaggataaaaatataattgatttctagcttctgccttcaaacacacaaccttgtagctgactcgttcatttattaatgcccaacatatatttcatgagtgcatactatctgccaggcactgttgcagacacagtactggaaaacagagggcctgctctcacggagcttacattctagtaggtagacataaaacacaagatgtttttgagaggtccaagaagataagatttgaatttttgtttatcttaatcttaatttacatttttgtatatgtttggtaccgtgcataatatgtacagtagtatatgtatatcttttttatttttgagacagggtctcagtctctgccacccagactggactgcggtggcacgatcagagctctttgcagcctcgatttcctgggcttgagccatctcccacctcagcctcctgagtagctgggaccatagggacactaccatgcctggctaattttttaatttttgtagagacaggggtctcaccatgttgcccaggctagtctcagactcctgagcataagcaatcctcttatctcaacctcccaatgtgctgggattacaggggtaagccactgcacccagcagtataccgtttttttttgtttttttttttttttgagatggagtctcgctctgttgcccaggctggagtgcagtggcataatctaggcccactgcagcctctgtctcctgggttcaagccattctcctgcctcagcctcccgagtatctgggactatagatgtgtaccaccacacctggctaatttttgtatttttagtagagaggaggtttcaccatgttggccagcctggtctcgaactcctgacctctagtgatccacgggccttggccttccaaactgctgggattacaggcataagccactgcacccggacccagtagtatatcattttaaaataaacacatatttaaatttgtttcataaactcataccaagagcttgcagacaaaaacatttacaaaccccagggtaaaagcatgggtgttaggatcagagacttgtgggtttgaatccaggttctgctttactcgttgcctgtgggtccttgggtaagcccgagttcctcctcctttctaagaactgttgtaagggttgagtgcaataatgttagtaaagtgtttaaccgagttcctcctcctttctaagaactgttgtaagggttgagtgcaataatgttagtaaagtgtttatgttgcgtctgtatataccaagtccttaaaaaaaggatgactaatgttactactatgattattcttcgtgtgataaatattataatacagacacctcttaaagggcatatagaaatattgagaaggaactgattaagcagtgacccttaaagtcatgaacctatggtacataattggtgggagtgtaagttggtgctattttctatgcaatgtgtatcaaaacaatttttatttcctttgactcagttgtttcttttccagagaaacaactttcctcatcctaaggaaacagtcagaattctaacagatttataatagtgatcaattagaaagagaacgaaatgtcgaatcgcgggagagtagtcaacttaaaatacagctttatgatggaatattgtgcagctgttaacattttaaaagaacacttggggaaatattaatattaaatgtagaaaacaggttgtaaagttgtagttacagtataaccccaattatatttttaaaaagcacatgatatatttgtattagaaaaacactataaagaaatgcatcagacagggatggtggctcacgcctgtaatcccagcactttgggatgccaaggcgggcagatcacttgaggtcaggagttcaagaacagcctggccaacatggtgaaaccctgtctttactgaaaatacaaaaattagctgggcatggtggtgcacacctgtagttacagctactggggagggtgaggcaagataattgcttcagcctgggaggcagaggttgcagtaagccgagatcccaccactgcactccagcctggatgatagagtgagagaggctccgtctcaaaaaaaaaaaaaaaaaaaaaaagccaggcaccatggctcatgcctgtaatcccagcactttgggaggctgaggtgggtgaatcatttgaggtcaggggttctagaccagcctggccaagatgatgaaaaccccgtctctactaaaaatacaaaaattagctaggcagtagtggcattcgcctgtaatcccacctactccggaggctgaggcaggagaatcgcttgagcctgggaggtggaggttgtgatgagccaagatcatgccactgcactccagtctggatgacagaatgagaccctgtctcaaaaaaaaaaaaaaaaaaaagaaaaaagaaatgcatcaaaatacaatagagttatctctgataagactgtgggtggcattcatttttttcatcgattagacaatcacagaaatattaaccaagataaataaagcaagatgagcatgtgggcaggagtggtaactgggataaaaagaaattttgaccagcctggacaacatggtgaaactccatctctaaaaaattacaaaaattagctgggcgtggtggcacgtgcttgtagtcccagctacctgggaggttgagataagacgataacttgagactgggaggtcaagtctgcagtgagccgtgatcatgccactgcactccagcctggatgacagagtgaaatcctggaaagaaagaaacgaaagaaaatgaaagaaaggaaggaaggagggagggagggagggagggagggagggagggagggaggaaggaaggaaggaaggaaggaagggagggaaattttgcctggggatcctaggaagccttcacaaaaatgccagttccaactcttgaatggggcccagacttttgcccagtggagaagcagcttgtgaagaaagaggaagaacccagaaggtgaaacagcgatgaaagctctgtggcatgccgagacacatttaattttttccatgtgactggaggtcaggctagatattgggcattgaggcagaaaccctgggaatgtgggttttggctgatagagaagagactcacataccttaaggagtttattccttaccttgtctatcgtgggcagctttgtaggtggggaaagatggatcaggtctgcatttcagagtggctactttgtggcagcacaaaggttaggtcggcacaaagtgagtcggaagggagagcagtgaggagcctcttgcttcagtctccattctttttggatgaagccttggcagaaccattcatttccatcctaatattgaaatgccttcacattattacatcagcttaggctatgtgacttttgaaagcttggtaggttggtgtcagataaatgaggccttcacactcactcacctggtctctgcaagaaactggatcaaggtgatgaggaatgcactcttaatacctgaacaagaggtcttggaaattgtgtttcttatattaactaaacaaatgtagtcaaatgctattataaaggattggctgaagaatatgcatttcattcattctatgctctacttcaaaattatccttgaaatgcaagagcctgggagagatgtctacttggactacattgtttggaccctgttttaggcattggcattacgccattagatttgtaaatcaaaaagtatctgagacaagtctccatcaatttatttacttatttattgagacggagtctcactctgtcacccagactgaagtgcaatggtgtgatcttggctcactgcaacctctgcctcccaggttcaagcgattctcctgcctcagcctcccaagtaactgggactacaggtgcacatcaccacacctggctaatttttgtatttttagtagagacagggtctcaccatattggccagtctggtctggaactcctgacctcaggtgatctgcctgccttggcctcccaaagtgctaggattgtaggcgtgagccactgtgcaggtgggaagcccaggttcttgttatatagatgatgcctccaggtagcaggcttcagagacaatagatggtaaatgtcttcttatcagaccaataaaaggtggtagactctcctgaaaagacctaataaaggagagagattctttacagaatatacatttccttcacaagagacagctttgcaggaccacttaaaaatatgacaaagaaagtgtggcgcagtggctcatgcctataatctcaactctttggaagtccgaagcgggtggatcacgaggtcaagagatcaagaccatcctggccaacatggtgaaaccctgtctctactaaaaatacaaaaattagctgggtgtggtggcacatgcctgtagtcccagctactcgggaggctgaggcaggagaatcacttgaaccctggaggcagaggttgcagtgagctgagatcgcgccactgcactccagcctggtgacagagcaagattctgtctcagaaaaaaaaaaaaaagaaaagacaaatatattttgaggtaaaatacttcgatttctttcagggctgttatctgtcatataatgctatactagagtcaggttggaatttggtatcttattgctacaggagtctgttctctcagtcttaagatctctgttttaatgttaatgctggtcagttgtgtctgaattccaaagggagaagggtataatgaagtatgttgggcctccattttccatcaaggcttgaactagtttcaggtttactttggaatgcccttggccaagaggaggtctccattcagtcagttggaaggcttagaatgttatttttagttgatagattgttttgtgggttttgaaatttgtcatgatttcttgtcatgaatgggtgtgttgtaactgagcaggttctttgctttaccatgaggtcctagtaaatcatgttgaagcggtgttgttgtctagggtaaatacccagggtttgtcatctcgcaccaagaagattaaggacacagacacacatgaggagtgagtttaggagcagaggtttgataggcaaaagaaagagaaagaagaacagctctctcccttgaaagagagaggagttcctgaaagggaaaaactggtcagctctagactgtaccagattttacaggcaggcttgaggagacagtgtctgatttacgtagggcccagagattggttcaaccaggtgcgatgtttacctagtgcgtggggaaggctggtggtcccaccctaatcttattatgcaaatggagtctttgcctggctggtgccatattgtcttttccttactgtgcacatgctttggcaaaaagagagaagatgaacatgcctagtcccaggaagccttttccttttggcacaactgccaacttccacccatgcaagcttccagcttacttgtctatgcctgcagcttgattttacaagctgctctttgttaggaaagaaaatgattttggggccgggcacagtggctcacgcctataatcctagcactttgggaggcctaggtggatggatacctgaggtcaggagttggagaccagcctgaccaacatggagaaactgtctctactaaaaatacaaaattagccaagtgtggtggcacatgcctataatcccatctactcgggaggctgaggcaggagaattgcttgaatctgggaggtggaggttgcagtgagccaagatcaccccattgcactccatcctgggcaacaagagtgagactgtgtctcagtaaacaaaaaacaaaagaaaattattttggggctgcttttcatttaaaagaaaaccttactgaggactcccatacccttactaatgatttcttcttcttctttttttttttttttttgagatggagtcctgcactgtcacccaggctgcgtgcagtggcacaatctcggctcactgcagcctctgcctcctgggttcaagcaattctcctgcctcagtctcctgagtagctgagattactggtgcccaacaccatgcctggctaattttttttttctttttgtatttttagtagagacggggtttcaccatgttggtcaggctggtctcgaactcctgacctcgtgatccacccacctcggcctcccaaagtgctgggattacaggcgtgagccaccgtgcccggccactaataatttcttcttaactcctgtatcaatgtgactcatgtctgtcgacttggaagggccaagtcaagctgtggtctacctctaggaagtgtacaatactcacagcacatatataatactcctgtgcttcctcttattttttccctcctttaatttttctttacggccatttgcttcttttttttttttcattctttcttgttttcacactggataagaaatagcccttaagctttggatggaaattaaaggaattctcaaaaatccaggccttttgcaaacagtaaagattatacgaaacactagcaaggtggggccttgccttcagtttatggtcctgccatggtacaggagaagcatgtcccagaacagccacagagtccagaagaaggcaacctttctccttttgacttgtagttatggtatacatccatgttttttagtttgttaatgcttctgggtggaccaggctgagatggagtgttgcaagctatctttcttagtgtgggaaaatctgtgcactttctaagccagcccatctccagggggtgggatcttggagaaatcaggcagctccaggggctgaggggatttggtttagcagatgagaatgggacgagactgtcaagtcaatcaaatgtgaggactaagatgttagtaaaaaaagcatacatttgttaccaggaaggagtcccaatccagacccccaagagagggttcttggatcttgttcaagaaagaatttgggtgagttcacagagtaaagtgaaagcaagtttattaataaagtaaaggaataaaagggtgcctactccataggcagagcagcctcgagggctgctggctggctatttttatagttatttcttgattatgtgataaacaaggggtatatgtatcaggggaaccagcccccaatatttcaacgtaggttctttctattttccctaagggtcaggcggctgagaaataaagagaaagagtacagagaggaattttacagctgggcctccatgggtgacatcacatatcggtaggaccatgatgcccacctgagctgcaaagccagcaggtttttattaaggactttaaaaggggaaggggtgtacaaacagggagcaggtcacaaagatcacatgcttcagagggcaaaaaggagaatgaagatcacgtgcttctgaagccaataaagatcacaaggcaaagggcaaagcaaagatcacaaggcaaagggcgaaatcaaaaactcctgataagggtctatgttcagctgtgcatgtattgtcttaataagcatcttaaacaacagaaaacagggctcaagagcagagaatcggtctgacctcaaattcaccagggtgggatttttttccccaccctaataagcctgagggtactgcaagagaccagggtgtatttcagtccttatctcaactgcataagacagacactcccagagcggccatttatggacctcccccgaggaatgcattccttccccagggtattaattattaatattccttgctgggaaaagaatttagtgatatcttccctacttgcatgtccatttataggctctctgcaagaagaaaaatatggctctattctgcccgaccccgcaggcagtcagaccctatggttgtcttcccttggtccctgaaaatcgctgttattccgttctttttcaaggtgcactgatttcatattgttcaaacacatatgttttacaatcaatttgtacagataacacaatagtggtcctgaggtaatgtacactctcagcttacgaagttaagaggattgagagattaaagtaaagacaggcataagaaattataaaagtattaattttgggaactgatacatgtccatattaaaatgaaatcttcacaatttatgttcctctgccatggctccagccggtccctccgttcggggttcctgacttcccgcaacatatattattcatgagttttctaggaaagggatgaggaattcccagaccggagggtttgtcttctttttagaccatacagggtaataacctgaagttgccatgacatttgaaaatcgttatgctagtggtaggagtgtcttttagcataccaatgtattataattagcatataatgagcagtgaggatgaccagaggttactttcattgccatcttgattttggtgggttttggccagcttctttattgcatcctgttttatcagcagggtctttgtgactatactttatgatctcctatctcatcctgtgataaagaatgcctaacctctgggagatgcaggtctcagcctcattttacccagcccctattcaagatggagccactctggttccaatgcctctgacacattcattcacttaattctacaaataagtattgcatgtttacattgtgaggtcctgagtaggggagggaggaagacattgattacttattaaaaattaaacacacagcttattccttccccttgtgataagtgccaggagggagaaacaggggttgctgtgagaggagaactgaaagacagaaatatggtcagtgggaactgtgatcggcaaagatgtacagacacaggaccctgggcagacaaataatgaaaccgcctttgcgaaattatgactgagacagtgaaagagatctaatctaactgactccatcttgtttgtaacctttaagctgtccttgttccttcctaggtgtaggctgaaataactttgggaggaatttggtttagagtttaaaataaagataacaacactttcccaaaacaaacctccttcttgcctggggactagactgcctttgtagtactaagacattagccacaagattagaaattatggttaaggagtcattgcagctggaggctacaagactctgaccctccctaaactgctcctaagatccatgcttgagacattttgcagaccctgcacttgatggatcagctggcatgacccagattgataaactggcccatctgatcttgtggcccccagctaggaactgactcagcacaagaggacaatttcaacttcccatctcttacttaaccagtcaacattcctggttcactggcttccccccacccaccaagttatccttaaaaactctgattcctgaagctcagagagactgatttgagtaataagaaaactctggtctcctgcacaaccagctctgcatgaattaactctttctctattgcaattcccctgtcttgataaattggctctgtctaggcagcaggcaaggtgaacccattgggtggttacaaaaatggcttgggaagagtttaaattgtaaatattagaagaatgagaggattactatgaaggtgtgcatgctgttcatttgctgattttgttcattggcttctgattccttcttaccctccccagctgcctcctgttactctctttattaaattgagggtgagctctggttataaaggagacagtgggttccatcttttgaaaggatgggatcctaaactggagtctacctatgcctgtcccaaaaagagtgttgaggacactcttgttatccttctgataagtaatgagagttgctaagcactacagtataagatttgtaatctgctgttaatactatttgttctgaaaacaaaattgtgaaagaaaataataaaaatctaattgtggactttgtctcattgcaagtatcagaggcgttcaaatcagagtaactccatcttggatagggattgggtaaaatgaggctgagatctactgggtcacattcctaggaggttaggcattcttagttaacaggatatttacagttaagggaacaagttaataatgtttattgaacagacccaggacttaagtgacccaggaaatagaccaaggaaatgtcttgatgtcccactgtcttaagaacaaaagcattcttagtttaagcgtaagtttcgggccaggcgtggtggctcacgccagtaatcccagcactttgggaggccaaggagggtggatcacgaggtcaggagatagcgaccatcctggccaacattgtgaaatcccgtctctactaaaaaaatacaaaaaaattagctgggcgtggtggcaggcccctgtagtcccagctactcaggaggctgaggcaggaggacggtgtgaacccaggaggcggagcttgtagtgagtggagatcgagccactgcactccagcctgggtgactgagcgagactctgtctcaaaaaaaaaaaaaaaaaaaaaaaaatttgttgggcatgttggcatgtgcctgtcatcccagctactcggaaggctgaggcaggagaatcgcctgaacctgggaggtggaggttgcagcgagctgagattgtgccattgcactccagcctgggtgacaagagtgaaattccatgtcaaaaaaaaaaaatttcactttaaagataatactatagattcttgcagaagacagtagttacacaaagattaacaatcctttattgcaaggccttgtagagaacatcttcctcatgttttttgctttgttatcttacatgtaaacaagcattgtatcttgttagatatgagttctcaatttcttttcaaagaattaatatgtagtatgttcaattctttgacttctacttttaaacttaacttccttgtaaaggaacctttttcaatgacctactccaccctgactcattccgatcacctgctcaaccccaactcattccaattacctgctacctgctctgccctgactggcgccaaagtactcaccccgtcattctctttaaattagccaatgggaattagtttagcctgtgcagtctaaccctagccaataggagaacaacacagcagcaggggccacgtgcatcagggaaaagaaccccttaccctcccttgtccaagtgtgcgctcaccattgctccgtctttaagggtgcacccttctacagaagtaacttgccttgctgagaattaaaaagaaaatgttatattcgagtgctattccttttgtggcactgaaactttataacaaccttgcatataaacaagcatcgtatcttacatagaaacaagcatcgcacctaaggtgtgcgcatttctcttcttgctttcgagaatgccctgctctatctgctgtctagagagtagccattcttttattcctttactttcttaataagcttgcttttaccttattctgtggacttgccctgaattctttcttgcacaagatccaagaaccctctcttggggtctggaatgggaccgctttccagttacagtagaattgttataggaaggttgatttctgctaaagtgagacatgggaagattacatactgctacaatttcccactttcttctcatgtgtttacaaaatgggccactgtggaggctctgttgctctcaggagtttgtgcagctggatgctatggattctgtctaacagaagaaatgggtcctagaaatgatgaagcagcattatttttattgagtcttcttcaggcagagctaaggacaccttggaaaataaagcaaggatttagtgcatcacagaagctatttaattttctctctggcatatcctttgctaattggagatgttttcccagttaataaaagtattaaaaaaaattgaattcttggcagccaggcatggtggctcacgcctgtaatcccagcatttgggaggctgaggtgggtggatcacttgaggccaggagtttgagaccagtctggccaatatggtgaaaccccgtctctactaaaaatacaaaaattagccaggcgtgatggtgcacgcctgtaatcccagctactcgggacgctgaggcaggaaaatctcttgaacccaggaggtggaggttgcagtgagctgagattgtgctgttgtactacagcctgggtgacagagtaagactctgtctcaaaaaaaaaaaaaaaatcattgaattcttgttttaatccttgaagacacttaatattttggccagaacactatttatattccgtttattttaacaatgaatttcctgtcccaaatgtagtcaaaatgtgtacttgcacaacaaaagcattgcaaacactgctgtgttacagactggccaatgcaccacaatgtattggtctctttgtgtgagttatcacctggagtactttgtctcaggaccaagagaattaaagggtgaggttggagcgaaagtttaataagcgaaaggagaaagctcactgcaggggagaggggatccagaagagggttgctggtttttgcagttgaatgcaaaggcttttgtaagaaaccgatgagggctgggcatctcatttgcataaggtgcaaatttctggtagctccaccctgacctcctagtgcacatgtgggcgcttagcttaagttactccatattgctttgttctccttactatgcatgtgttaggggatggaattttccattgcaggcatgtctgggcaagcccccctgtgcaagttcccttatctgtgcctgcaggctgttcttcagttcgaaagaattcatctgaggacccaccctaactgtctgcctgactagtttcttcctttctcctctctcagctggaactcagtgattctccttttgacttctactttgaccatgcaggggtccaagttcaggatttcctgtggcctctgaagccaataaagaattcatgaacatggaattcacaaacagttttcagattcttgaaggctgcaatatatgaatattaggatgtaaaactgaaaacctaataaattggacttttaaaacatgcttccagttgtcttttacttaattaagaaattgattttaatactaaaattatagtcactttttctttaaaaattagaacattacaaatgaagctacagtttccattgacaaccacctctaatcttgatcatcttctcccattgttcagaggttattatgatgtaagtttggtgagtgtccttcagaccattaaaaatacttttttcatttcatttcaatgtgcctatacacattgtgcctatacacaaaagtttggtatgtacttttaagacataaatggtgtcatactgttagttttgttctctaatttactttatttaaaaaacagtatgtttttgagatctatttatctccaaatagatccaaatggatttagtctgattctttttttttttttttttttttgagacggagtctcactctattgcccaggctggagtgcagtggtgcaatctcggctcactgcaaactccgcctcccaggttcacgccattctcctgcttcagcctccctagtggctgggactataggtgcccgccactgcacccagctaattttttgtatttttagtagagacagggtttcactgtgttagccaggatagtctcaatctcctgaccttgtgatccgcctgcctcggcctcccaaagtgctgggattacaggcgtgagccaccacacccagcctagtctgattcttttaactgctttggagatttccatttatgaatgtactatatgtcaggcctctgagcccaagctaagccatcatatcccctgtgacctgcacgtatacatccagatggcctgaagcaactgcagaaccacaaaagaagtgaaaatagccaggtcctgccttaactgatgacattccaccattgtgatttgttcctgccccaccctaactgatcaattgaccttatgacaatacaccctccccacccttgggataatgtactttgtgatatttccccacccttaagaaggtactttgtaatattctccccacccttgagaatgtactttgtaagatccaccccctgaccacaaaaattgctcctacctctaccacctatcccaaacctttaagaactaatgataatcccaccaccctttgctgactctctttttggactcagcccgcctgcacccaggtgattaaaaagctttattgctcacacaaagcctgttgggtggtctcttcatacagatgtgcatgacactatagttaactaattcatgtattgatggacacttacaaaacatgaacatgcatataaaattagaagtaggactgtgggtcacagggtatatgccaaagtgtcccctacagtggctgggacattttatatgtcccttcattaagaatactttaaatttgtttttatttattatacaggaaagaaaagtgtctcctgcagtagctgggacattttacatatccctccattaagcatactttaaatttgtttttatttgttatacagcaaagaaaagcaatcattgcttccagatctggtaccagtccttccttccttccttccttcctttcttccttccttccttccttcctttcttccttccttccttccctccctccctctctccctccttccctccttccttctctctctctctcctctctctctttctttctttcatctgtcttctacttgttttctttttctttttttttgagatggcgtctctctctgatgtccaggctggagtgcagtggcatgatcttggctcactgcacctccacctcctaggttcaagtcattctcctgcctcagccttcctagtagctggaactacaggcatgcgctaccacgcccagctaatttttgtattttttgtagagatggggtttcaccatgttggccaggatggtctcaatctcttgacctagtgatccgcttgccttggcctcccatagtactgggattacaggcatgagccaccccgcctggcctttttttttttttttgagatggagactcgctctgtcgccagactggagtgcagtggtgcgatcttgtctcactgcaaactccgcctcctgggtccaagcgattctcctgcctcagcctcctgagtagctgggattatggcgtgagtcacggcccctggccttctacttgttttctgtccagcaatataattcccattttaggccttaattgcctgatttttaggtgagggaataacaggactgttttgtgaagagtgaaagtttttctaagtgcagcccctgcccactcaatgaaaagaagactcaggggagcaagagtgttaagaatattttagaatgctgccttcacttcaacaaggatgttgaattagaagaattttttttgagacagggtctcactctgtcacccacgctggattgcagtggcaccatcattgtcactacaacctctgcctcccaggctcaagcaattcttgtgcctcagcctcctgagtagctgggactagaggtgtgcaccaccatgcttagctattttttttttttttttttttttttgcattttcaatagggttttgccatgttggtcaggctggctacgaactcctggcctcaagtgatccacctgcctcagcctcccaaagtgctgggattacaggtgtgagccatcgagcttagccatattagaaggatttttaactgaataagagtaacacccaagagaaaagagatggaaaataatgtaaaaacaatatgatcagttttttcaccgtacttgattttatgcagaaatgtcttcttccaaaacttttcccacaaatgctaaggtatagatgctcagatatattttctggatctcacagctgccacactctcctctgcaggctctagtgggccccagaaaccacgagcagatagaagaaggaagaaaaccaggagggccaggaaagtcctcccaagtggggagaattggcaaatagtcaaaaattgacaggatgaatgataacattggagaaatgcaactttcaagacttaatgtatacactgtaaattagggaagaaactttatgtagtgagaaaaacatggacagtaggggagagcttcttagaaggagttgcttactgggcaccactggaagcttggtgggggcgtggggagaaagagagggagagagaaatagaaagagagagagggagaggtagagaagagacaggcacaaggaggcattccataatggaagagcctgcggtaatacaattgtgcactgcagcatgggataatgctgggacaaagagtagattggttatgggatagaatgataagaatggaatggatttaggagcttttgtgtgttaggggcaggcagtgattttcttcttattttttcgtccgtgggataataagacaactaaataccatagtagcaagactggcccaagacattgtccccaggtcagataatttggcacattgtatactaaattatgaataagcttatctttgctttatgccattgagctttgaaaccaccctttattctgaaaagactgtgagccaccccgtgagacaatttcaatcattatcataataatatcagtagcagaatcaaatcatatgtagttggctctctaaaactaatctaaaattgcttcatgggttagctgagaggtacctaataacttagattgtcctcaggtgaggacaaatggatgagtttttatttaatcttgccattttaaataggggaaaaatttttttaagggaagattgtttgatacaggaaaagttgaagaattttcagaaaattttatgaactccaggagggctgaattaagagagaaaacccccaaaatgtcagctttcatatctgttcaagtctatgttacctatggttgtttctttgtcatcaccttcttcataaagacacagcatagcagggttggtgatttttgtctgtccttgtctctttttttaaatttaagagggaatgttctaattgtgaaggtaatacagttattgtaaaggatttgtaaatatagaagcataggtggggtgtggtggctcatgcctgtaatcccagcactttgggaggctgaggcgagtggatcagttgagttcaagaccagcctggacaacatggtgaaaccccatctctactaaaaatacaaaaattagccaaatgtggtggcgcatgcctgtagtcccagctacttgggaggctgaggcaggagaatcgcttgaatacaggaggtagaggttgcagtgagccaagatcgtgccactgcactccagcctggacaacagagtaagactctgtctcaaaatatatatatatgtatatataagcatataataaagaaaaaaaaagtctaccttacaaccaaaagataaccatagttaacacttattcccagtgtttttcttttctttaaattatatttagttgtacaaataatgagtaaatacatccttattgaaaaagtcaaaccactgcgcctctcaccacaactccaattgtcgtgtcaccctcaggggtaagtactgttatcaggtgatggggattctgtaaaattcttttttttcttgtctctaaatatatttatagacaaaaacacaatacttttcctcctgcatgtgttttatgaaaaacagtaacaaacaatgaatttatattatcttatttttgttcagtgatgtcttaaggatattaccatgccaaagcatacagatctatctcatattacctgttgcataggattcaatagtatagaaatatttttatttgataattgctttgtcaacaggaatttatggtttcaacatcctcatccttcttgctgctattactaataattgtattcctgggcatagtgactcacacctgtaatcgcagcactttgggaggctgtggtgggaggatcacgaggtcaagagatcgagaccagccgggccaacatggtgaaaccccgtctccactaaaaatacaaaaattagctgggcattgtggtgcatgcctgtagtctcagctactcgggaggctgaggcaggagaatcgcttgaacccgggaggcggaggttgcagtgagctgacatagagccactgcactccaccctgctgacagagctaggctctgtctcaaaaacaaaaacaaaaacaaaataatggtataacgaatatctttatacatatctctatgcacatgtatgagtattttcataaaggagataattggagagtggagcggcagtgtcttagtccagtttctgttgctataacagaataccacagactgagtaatttatgaggaaaataagtttattccgttcatagttctagagactgggaagtccaaaagcatggtgtggtgtctggtgagggtcatcccacggtggaagggtagaagggccagaaagcatgagtgagagagaactttattttataacaaagtcactctggtgatacctaacctactcccagaataacagcatcaacccatttatgaggattaatgtatcaggacctaatgacatttttctccaaaaatataatttttaattactgaatataatttcattgtgtgactgtatcagtattgttttttctttatattaacattcttttatttttgaactctagttgttttaaatatttgctatggcagattttttgaaaatgttgctaaagagtacctttctgaatatttttgtgtttaatttttgggtttatttccatttcttttgataagatcatgagaaagaaattcaccaggacaaatagtgttaactttaaaaattttttaatgatacatattgccaaatacttttctggaaattttgtaccagtttatctttatttgagcagtgtattagcatgtctttcttatagaactatcttttcatatgattaataatgataataataataattattattattattttgagacagagtctcgctctgtcagccaggctggagtgcagtggcgtgatcttggctcactgcaacctctgcctcctgagttcaagtgattctcctgcctcagcctcctgagtagctgggattacaggcatatgccaccatgcccagctaatttttgtatgtttagtagagactgggtttcaccatgttggtcaggctggtcttgaactcctgacctcatgatcggcctagcctcccaaagtgctaggattacaggtgtgagccactgcacctggccaatatgcttaattattaaatatatttaaaatgttgctagttttaaagatcagaaataataattaaatttatatttaattgatgatgagtgaggtgggacatttctcattttattagccatttatggcccttctgataattgttagttcttctatagatgttttctcttaggtcattggttttcttactggtgtgaataggctctttgcatattaaagttttgattctttgtattatttctggaaatatttttccagtttgctctttcactttaaattctgcttacacatttaaaaaatttgttgtcatctgtgcactttttcttgaatgttcttgcattgcttttgtgcttagaaagtcggctatggctttcatgtttgtgttgttcctccaattcatatgctgaaatccttacctccaagaagatggtattaggagatgggacctttgggagaagatgattaggttatgagggtggaggcttcatgaatgagattgaaaaaagaaagcttagagctgtacttacacattataaaccaaataaatttaagatagacttaaagcactgaatataaaaaataaaatcaggccaggcatggtggctcacacctgtaattccagcactttgtgaggccaaggcaagcaaatcacttgatgcaaggagttcaagaccagcctggtcaacatggtgaaaccctgtctctaccaaaaatacaaaaaattagccaggtgtggtggcacatgcttgtagtcctagctactcgagggactgaggcaggaggatcaactgaacccaggatgtcaaggcttaagtctaccataatgtttagggggaaaacccaaatacattcctatgaaagttaggaacaagacaaaatgtccgttattgctattaatgtttaacaatgtgttattagtttttatgctgctaataaaaacatacccgagactgggtagtttataaaggaaagaggtttatttgactcacagttcagcatggctggggaggccccaggaaacttacaatcatggcagaaggggaagaaaatacatccttcttcacatggcagcacaaggagaagtgcagagcaaaaggatgaaaagttccttataaaaccatcagatctcatgggaactcactactatgagaacaggggtaactgccccccatgattcaattacctcctgctgaatccctcccacaacttgtatgtttatgggaactacaattcaagatgatatttgagtgggaacattagatttgagtggggacacatccaaaccatatcaaatgttctggggttattaaccaatgcaattagtcaagaaaaggaatagaggtataaaaattggaaagaagaaggtgaaattttcattatttacaaatgatttgcatgtttacagtgcaaaacccaggagaatctattgaaaacaatcccaaacaataagaaacataaaaaagatatttaggtacatatttaatatataggaataagtagaccccatttacaatatgacaaaaagataatatttttagagataaactacaaaatatagtaaatctaaattgctaataagaataagacttcttggctgggcacagtggctcatgcctgtaatcacagcactttgggaggccaatgtgggttgatcacttgaggtcaggagttcgagaccagcctggctaacatggtgaaaccctgtctctactaaaaatacaaaaattagccaggtgtcatagcacatgcctgtaatcccagctactcgggaggctgaggcaggagaattgctggaatctgggaggtgaaagttgcagtgagccgaaattacgtcactgcactccagcctgggtgagagggagactctgtctcaaaagaaaaaaaaaaagaaaaaaaaagaataaggcttcttgaacaaatgagaaaaatgattttagttggaagcctcaacatttaaaacatataaattctctatagtttatttataaaattaacatgaccccagtaacaatatcgacaaaattttttggaattttccaagaagattttgaatttcatatgggaaaatgaatatgtaagaatagccagggttattcagaaaaataagtcctaccagatacaaaatatattaatgacctcagagctgccttttaagccctgctgccactattttttgtctgtgtttgtctgtaggcatcgctgctttctctcagatccttgcctgcacgggccagatccctgccgcagggcccttgcatggcctttttgctatttgaatgatgtgggcagctcctgcttcaatacctcttgactatttctctttttttttttttttttttgagatggagtctcgctctgtcacccaggttggagtgcagtggcacggtctcggcttactgcaagctccacctcccaggttcatgccattctcctgcctcagcctcccgagtagctgggactacaggcgcccgccaccacacccggctaatttttttttatttttagtagagacggggtttcaccatgttagccaggatggtctcgatctcctgaccttgtgatctgcccgccttggcctcccaaagtgctgggattacaggtgtgagccgccgcacctggccgactatttcattcttatttaatcatcacttctggctgggcgtagtggctcatgtcagtaatcccagcactttgggaggctgaggcaggcagatcacctgaggttgggagtccaagaccagcctgaccaacatggagaaaccccatctctactaaaaatacaaaattagcagggcgtggtggcacatgcctgtaatcccagctattcgggaggctgaggcaggagaatcgcttgaacctaggaggtggaggttgcagtgagccgagattgtgccattgcactctagcctgggcaacaagagcgaaactccatctcaaaaaaaaaaaaaaaaatcatcacttctttagggaactctttccttccacctccttcatctgaagtcattttcctttgttagctgcctttttgccttccttgcatttatttcattttgtaattacacaattctaagtgtggttgtttgataaattctctttccctttttagactgtcagctcattgcctgatccagagtaggctatcagtaaataccacttggtggacaatctccagtctgttggactctgagggtgatttagattcagcacctaccttctaaactcactcatcaaaagagctctccaaatgtagtccctactccagtgttaagggaataatatcttaatacacagcttcttttctttctttcttttctcgttcattcattcattcattccttttttttttttttgagacagggttttgctctgctgctgaggttggagtgcagtggtgcgatcacagctcactgcagcttgacctcctgggactcaagccttcctcccacctcagcctcccaagtaggtgggacaacaggaacatgccaccacgcccagctaattttttgtagagatggggtctcactgttgcacaggctggtctggaactcctgggctcaagtgatcctcttgcctcattttccccaaacactgggattacaggcctgagccactgcacctggtctagcttcttttcttaaaaaaaaaaaagatgttagtcattgaaagaaataatcaaataatcatagccattgggaaacttattttcctaataaattttataaaatggtatgccatacatactataggtgaaatctcttataagtgacgtatgtcctcatatggcctagtttagaaaatatggtgtggtggtcagggtggagaagaccctccgactattgaatgagtctgaacaggatgtggttctctaataagagattcagttaaacttcttatgctttttccccagagtacatatctaccattttcttggttgtgctatgattggcaaacagtagctattactaagagctccgaaggttttgtttggcattttgtggactgaatcacactggtcatgacgcttgttggaaagttatgagctttaagaagacttttgcattcatgactatatcaaacagtagttgctggtagtggagtagtctctggcagtcttaaatagattttatcgctgagcctcctgaggccatttaaatactccaggaaatcctcctttatgtgacctcttttgtattccttcaaaaatgaatggctttcttctgtgtctttcacaaagaccacaggccttggaaactccatagaggtggtgtagatatccaacctcagtaataattcttgaaggaagcaggcatatggcatgagtcagatggaaacaggaccagagggttcagtctgcagcccacaggccaaacccaccaaatctgctctgcaggtgtgtttatttgattcatatgtgtttcttttttaaacatttaaatcagttgccaacctgcaaaaactgggaatttacacttcaaaaagtctggatatatgacttgtcttgaaaaactggaatgatttggaattggaaattccaaaattggagtggtttggccaggctggaaatccttatttctgtatctgcaaccaccagtggagctgagacctgttcccttccagatgggcaggggctgtccatgtgtgacactgccatctctcgtctcacatgttcatttcagttgccttcatgattcatggatatgagattatgagattgagaatatgatggttatgaggttatgagactgagtataaaaggcatagtgaatagttacaaaggagacagccttttacatttatatcacatgatctgtttgataaataaatgagacactttaatcaacagacaagaaatgagctgatcatctttgtgatctggacaaagaaaaataacgaaaactgtccctcgttacacaggatgtagcattgttcttctctgataattctttgttgagtctattgattctgggcagaggtcaaataccatttgagtcgggtggaaggaaaatctttttttgtttttttgtttttagaggcagtctctctctctctattggctgggctggggtgcagtggtgcaattatagctcactgaaacctcaaattcctgggctcaagtgatcctcctgcctcagcctctcaagtagataggactacaggtcatgacaccctgcctgacaaattaaaaaaaattttttttctttttgtagagatagggtcttgctgtctctatctggtcaggctggtctggaacttctggcctcaagcaatcctcctgccttggcctccaaaagggctaggagtatagatgtgagccaacacactctgccataggccaattcttaaatgacaaacctcatcaccatcctggaggagcacatcatttgttcccgaactttctcctgcttccctttgaactttgagaatgagaaccaaatggtctgaacataacacttctctgcgtagcatgtttgacatatttggaatacaaagaatgcttctgcctttaatctggctttgtgcagctgcacggaaaagatcgtttaacactcttctttatattttgtattttgggggaattctaccaggaaacttacgatcatctttcggaagtcccggtcacgcgggagcagttaaaccactatcggaatgtggctcaaaatgctcgaagtgaacttgcagcaactttggtcaaatttgaatgtgctcagtctgaggtaagataatgcatttccagcactcagaaatgggccttcttagcttcttataaaatgaaacagatcacgcctgtaatcccagcactttgggaggctgaggcaggcagatcacgaggtcaagagatccagaccatcctggccaacgtagtgaaactctgtctctactaaaaatataaaaattagctgggtgtggtagtgagcgcctgtagtaccagctgctcgagaggctgaggcaggagaatcacttgaatccgggaggtggaggttgcagtgaggcgagatcacagtactgcactccagcctggtgacagagtgagactccatctcaaaaaaaaaaaaaaaaaaaaaaaaagaaaaagaaaaagagacagaatgtaggagtgattagaaataggacagtgggatatagatttaaggcttttggcaaagttgaaacttgttctcttgtgcctatcccctagaattcctgaaaagttatgcatttgccagattgtaaagctaggtggcttgggctgaattctggatctcagaggagctatacagccttgagagatctgggggcgcctgaagatgttaagtaaagctccatgggcctcagagaaatttagcatctctcagaatatcttcctttaatgtgggttgcttgcaatctggagttcttaagagggaattctgaatccctttcctgtggtagttccaactggctggggaaattctaggaagaagagtgggatccatctaccctgtaggctagctcgggtttagagtggagtttctgagagtcttcctaaactcattctgcttatagcctggtggccccaaggagttctagactggcctgtgatttctcactaaggctgccaggaccccatagaacgatgagttgataatgtgtgtgtgaataaatgtatgtatgcacactcacagttccaaagaagtagatgctttcataactttttctcatagggtagatctgacattttaactcaatagggcacatatattgttcagcatttcgatatcacagaactcataaaagttaaaatgttctctttatataaatcctataagggtttttcttttctcctatgttttttttcccagaaatttaaatgttatttttatttatcactcacagttagaatccaggagataagtgtgagaaatatagtgatatactgagtagtctgtatttaagtgaggaacagttatggctgtgaaatcacagatcatatggtttgtaggttccttgtctgactgtttatcagcagcaataatagcaatacagatttagaaaatgtggaccattgcaaaatattttattgcttatgcaatcaacatcataaatgtctcctgaatgagactaaacaacataagacattgctcaattggttttggaaaagatagaatataaagtccattatttaggcataatttctcatttggtaatacagatacaaatattagaaaaaaaataaagttagattaagtcatgaataaaagagtgaacatttaaatgatggctttgggtttcttaaagataattcaaacttatgttgttaaggttttttttttttttaacttcttttccatgttagcttcaagacctccgatccaagatgctttctaaagaagtctcctgtcaagaactgaaagctgaaatggagagctacaaggaaaacaatgccagaaaatcatctctccttacctctttgagagacagagttcaggaactagaagaagaatcagcagcactttccacttctaaaatcagaacagaaatcacagctcacgctgcaatcaaggagaaccaggaattaaagaagaaagttgtagagttaaatgaaaaattacagtaaggatactgcaatatatttttcgctttagctagcattaaaatactagcttctgatagcaagatatgtctttgaaagtactggcattttgcattacttggcccttaaactcaatttgaaaaaaagttattgacctcaaatatctttggagtcttgacaaatttttccaaggctcatttctaaatgtcatcaagagtcttaacaaatacagccttgtcttaagcatgtttatagcctatcaattagggctgcaaatgcttatttacacaatttcgaagatttctctaagtagagtttaaccctgagcttgtggggtagtacacagaggtaggtatttatttagtagccagttataaaaatatcccagaagctagaccactccagatcacactgaacattcctcattagattttattgctagtttatgcagagaactcatgaaacctaggttttccacacttcattctgacaagaggtgattattgagacaaaattgggaatgagttgttcctaaaatatattttaaaattctacgaatgagttaaatatctttagtaacaaaatacatggtatttattttacttatttcatcttaaaaaaataacccaatacttccagcccctgtcctctttctctacttccacttacagcaaaaactccttaaacattgtatgtatggccgggcatggcggctcacacctgtaatcccagcacttttggaggctgaggtgggcagatcacttgaggtcaggagtttgagaccagcctggccaacatggtgaaaccccgtctctactaaatacaaaaattagctgggcgtggtgccaggtgcctttaatcccagctactcgagaggctgagataagagaattgcttgaacctggacaggtggaggctgcagtgagctgagatcacaccactgtactccagcctgggcaacaaagagagactctgtctcaaaaaaaaaaaatgttgtatgtattcatggtctccaatttctcttctctctctggaatctgctccactgaaaccactcattaaggtcatcagtgagtgcacagtgcaagttaaatggtcagtcttatcttacctgacctatcagtagcatcagttacagttgatctttttctttgaaccgttttcttcttctcttggcttccaggactttacacatgcctaggttttttctttttctaatcttaccttgctagctagtgtctttcactgtttctcctcatctctttggctttcaaatactggagtacctcagggatcagcccctgaatctcttctcatttgtgtctaaatttactctcttggtgatatcatttagtttcatggctttaagaatctaaatgctggtgactcccacatttctgtgtctagcctggatctcttcccagagctcaagaaccacatatcttactagctactgtatatctccatgtggatctctgacaggcatctcaaacttaatgtgtccaaaacggagctcccagtgttcccacaaaatccttctgtacttttcctcatctcatgtgatcataattccattcttctagttgatcatttcaaaattcttgctatcaaacttggttctctttctctttcaccctccatgtctgattcttcagcaaatcccatcatatctatcttcaaaacaaatctaaattgtgtcagttttccattatcacctttattgtcactaacttggtccaagccaccattaactctcacctggagtattgtaatatgtatctgtaacagcagcatcccactcctggtactaatttctgtcttagttggtttgggctgctataagaaaaataccatatactgggtggcttaaatgacagaaatttattccttgtagttgtggaggctgggaaggccaagatcaagatgttggcctattcagttcctggtgagggtcctctttctggtttgtagatgaatgccttcttgctgtatcctcacacggcagagaaagagatcacctctccatgtttctcctcctcctcctcctcttccttcctcttcctcctcctcctcctccttcttctgctgctgctttttttttttttttttttttttttttttgtgacagagtgttgctctgttgcccaggctggaatgcagtgggtgtgatcttggctcactgcaacctccgcctcctgggttcaagcaattcttgtgactcagcctcccaagtagctgggattataggtgtgcatcaccatgcccagttaatattttgtatttttagtagagatggagtttcaccatgttggccagggtggtctcagactcctggcttcaagtgatctgtctgcctcagcctcccaaagggctgggattatagggataagccaccacacccagccagtgtcccttcttataagggcactaatctcattcacgaggtctcctctcttatgacctaattacctcccaaaggcccaacctccaaatattataccatcatattgggaattaggacttcaacatatgaattctcagaggacagaaatatttggttcataggagtggttttcctgcctctgactgtgccccctgcagccagaatgatcctgttaaaacacaaattagatcatgtcaattcttagcacagagtcctccagtgacttctgttctcattcagggtaaagacagtgttttctatgagccaaaaggctcatcctgacctggttttgctaccattctcccccttattctttctattccagatctctggcttctttgctgtcccttgaacctgacagacctgattgtacctcaggacctttgcaattgttaatttcttttcctggaaggctcttcccccagatatcacatggctgcctccatttcctttaagtcttcattcagatggcactttccaagtgagatgttccatgaataacatatctaaaaatttactcctctaatatctcttgcccctctttccttcctgcttaattttttctctctagtcctattatgatgtactatacattttacacatattaatattttgattattgtccatctttccaaatagaacataagctccatgaggtcaataatttgtttttcagagatggggatctcactatcttgtccaggctggcctaaaattcctgggttcaagtgatcctctcacctcagcctccctagtagctgggactacaggtgcacaccactgcgcctggctggatttgtatctcttttgtttactgttgtatctttagcacctttaatggggcttggtgtatgatgggtactcaataagtatttattaaataaatgagtaataaaaacactatatgcatattgtaaaaaatattttttatacagaaaagtgccaagaagaaattaataattacttaaaacctcatgattatagaaaagctataattaatattaatattttattgaacagatttttcagaaaatcatatacaaatgactttaggtagtgtactatttttactgaatcatatgttctaaatatatatatgtatatatataaatataagtatatataaaaaatataaatataaatatatatatatatatatatatttttttttttaagacagagtcttgctttgtcacccaggctggagtgcagtgacatgaccttggctcactgcagcctccacctcttaggttcaagcagttctcatgcctcagcctcttgagtagctgggattacaggcatgtgccaccacacccagctaatttttgtagttttagtagagacggggttttgccatgttggccagactggtctcgagctcctgacctcaagtgatctgcctgccttggtgtcccaaagtgttaggattatagaagtgagccactgtacctggccatatgttataaatattttaaaaactcatttagtatataattttatttatttacttatttaagacaggttttcactctgccacccaggctggagtgcagtggcacaattatggctcactgcagctttgacctcctaggctcaagcaatcctcccaccttagcctcttttgtagctgagaccacaggtgcatgccactacacccagctgatttttaaatttttttgtagagatggcgtcttgccatgttgcccaggttggtcttgaatccctggcctcaagcaatcctcccaccttggccttccaaagagctgggattacaggcgtgagccactgtgccaagcctagtacataattttaaatggcccattgtattccattgcttgaaataccataatgtactcaatcactttggctatttctacaggctcttaggttagttccactaaaaaaattactataaaccaagttgcagtgaatatctatgtgattcatatttttaaatttctgtgattattttcttagggtagattcctgaaactttgttgggtcaagtgaattgcaaatagaaatggaagtagtttagagacctttggaatggagaagaaagattgaaatcttggggttaatgtatggaatcctatatgtatatcaatcagcaccatacaattaattatgcctttcctgggtccaaaagactgaagagttttacctttcatatgctaaaataagaactcagaaatatagtgaagttagtcttttatcgttacacatttttctaaatagaaatctgatatgctttgagtatctgcaattacatgctttgttaatctttgaatagcgtgaaggaatttgcagtaaacactcaacatggtaaaaaggaaaagcaataatcatgtttattatcttggatatttaaaaaatgacactaaattactgaaatgattctaatttgcctttaaagtatgcctatttttgacaatctcttagttgctaacatttaaagcattagaaataggccatactatttcaacaaacctatctgagatttgaaacaatatattcataatggaccataaatttcctttttccttgactggccaattctagtactttcctaatgctctttttttccttttatttttagttgacttataataattgtacatatttatgggatatggagtgatattttgatacatgtatacaatgtataatgatcaaatcagggaaattagtaaatccatcatcttgaatatttatctttttttgtgtgtgaacattcaaaatcctctctgctagctatttggaaactaaattcttgttaactgtattcaccctactgtgctacagaacactagaacttacccctgccatctagctttataactttataactatctttataagtttatagccattgactcacctccctgtatcctccttcatccgctaccctttccagcctctaataatcaaaattctactctgcttctacgagttcaattttttgtagcttccacatatgagtgaaaacatgaggtaattatctttctgtacttgacttattttgcttaacataatatcctccaggttcatccatattgccactcctgacaggatttcactcttttaaaaggctgagtagtattccgatgtgtatatatcatattttttttcccattcactcactgatgggcacttatgttgattccctatctttgctattatgaatagaactgcagtaaacatgggggttcagacatctcttcgatatactgattttctttcctttcttccaatacactttaaagactgagggagtgtgaaaactaataatgaactttgctggtgattgaacacatctcctttccagaggcaagaaccttctgtgcttttgatgtatttgatattatagttatgcctggccatgaaccaggacccttataaatcactgtattgtaaagtttgaaaataaaatgaagcttggttctctagaaccaatgtggtagcactctccttccccatgaggccccaatgaagacccatggctatgtggattgtgtgtgctctagacacgtgcctccatttttagagatcctaaagggttgaggctaggggaattcatttcccctcctgttactaagtccacaatgccttgaagatttccttatatttctgcaaagcacaggtgtcccaaaattgctgccacttttctccttcctttatagggctttatagggcttctgtgacaataatttgctctgtgtctgggaaactgtgttgtgttgaaaatgacaattatttcccccatagagcttatattctgacttggtttgatgaatgttatcttccatggtgttaaattctgacttatttgttatttgcctaacagaaagtgttcaaaagaaaatgaggagaataagaaacaagtttcaaagaattgcaggaaacatgaggaatttctgactcaactgcgtgactgcttggatccagatgagaggaatgacaaggcatcagatgaagatttaattttaaaggtgtctgtatgcagattaaaaagtctataaatgtagtggtgattctgacatgtggcatgaaaggaagtgctgtggttgagtttgggggtggcaggagaatggcacagtagaccaagtgtagtattaattaactgtatgacttgggacaagtcacgtcacctgcctgagcctcaattccaagatcttttctagcattattggaattaattattctccaaaagagattaatggctttgtctaaaatatatttaggttgtcatatagagttaattactcattgtaaccatttgctttagggagtttttttccttttagttacagccagacatatactcacacaagcagctgcatgtcatttttaggatactgattgagtgtgagatctaaagtactttaaaaatttacattaaaaccaaatagtggctgggcgcggtgactcacgcctgtaatcccagcactttgggaggctcaggcgggcagatcacctgaggtcaggggtttgagaccagcctggccaacatggagaaaccccgtctctactaaaatacaaaaattagccaggcgtggtggcaggtgcctgtaatcccagctaattggaaggctgagacaggagaatcacttgaaccaggaggcggaggttgcagtgagatcaagccactgcactccacctgggccacagagtgagactctgtctcaaaaaataaacaaaacaaaacaaaatagcaaaaattctactttaatggtagattaccattaagtcagaaataaataataataactgaataattcacttggcccatagtgcttcattagggtacctgaaagtatttggttctctttggctatttacaaacctttcatatccttgcttcctgacagatttccatacagccgtttgttgttgttttttttttttgtttgtttgttttaaatttagagacaagatcttgctctgtcatccaggctggagtacagtgatatgatcctagtttactgtggccttgacttcttgggctcaagtgatcctcccgcctcagcctcctaagtaattgagactacaggcatgcaccaccatgtctggctaattattttatttatgtagagatgaggtcttcctatgttgtccaggctggtcttgaactccttgcctcaagcaattaccccacctctgcctcctgaagtgctgtgagtacagttgtgggccaccatgcccagcacccatgcatcattttttttttttaaatggagatgaggtctcactatattgcccgggctagtctctaactcctgggctcaagcggttctcccaccttggccttccaaagtgctgggattacaggcgtgagccatcacgtctggcctatcatgcagccatttttgaaaaccacctctcaggtgtctactagtgagcttcccaaatgtcctctctgaaagccgcaagatgacttcattcgactttgggaagtattccacttcacggatgggttttgatagctgggaccatgggtccacctgatgctctcatgggtgctggatgcctctcctcctccctatggctaacttgtgaccaggaactcagctgtaaaagtccacttgtagtttgagaattatctttcaaaccaaatgatggggacaagaaaagggaattcagaagctgcttcttccgtgacacacttttctctatcggacacaatctccaggtgctaatcagggtgtttctactacatttatcatgtccttgtcttttctgtatttctaatgctttgacttccggggtcttgctgagccgggagagcctgcccttcccagcagagctttcacgtgtgaactgaccaatccagagcccactccccagccacctcctacaactggctgttacctgcagattactgccccttgccctaagccccccagacagctcgggtcagcccctacaccccaagagccactgaaatcattcaatagccaaccctaagtctgcttactctgctttgcttattccttcctgtggaggcgacaataaagcctctcgcccgcttttctccccacttcttctgcctcctgactggccctggtgcttccccattgccctgtgtagtgtggtgggttcctgccacttgggaacaatgaataagaaaccatctttttgatggcaatttcctcctgggatttgttggcctcagcttacctgaacagtaatggaatctatatttcacgacacagggtaggaatctggagctttggcatctcggccacgtgagcaggtgcctgtcttaagaagaaaaaaaaaaaaaattggcccagatcaggaagtctgctgtcttgaccaagacttcagcctcattaggtgttcctccaagaacaaaatggctctggtttcaaaactgttccttcgctttcacacgccctcataaacacgtgtgcacacgcattcgcaaggaaccatgcattcctaacaattagacattcattccttcatttcacaaatatttagtgagtgcttactatatgctagacactgttctgagtgctggagagatagcagtgaatgagacaagactatgtctatgctcgcctagagatttcattttcaaagggtaaggatagtgaagaaataaccaaataaatatctacgattgctccacatggtgaaaggtgcaatacagaaaaacaaatcaggatgcagggatagagagggaagcaagtcacaggtgttggacactgtctgaagagcgcccccgtgaggtcgggagttttgagggccattgaggagagagatcatgcaaatgtgaggaagagtgttggagagagagggaacagcatgagttgggagtggggcaccatgttttcagagcattgaggctcaaaggtatatcacttccacggagagtctcaacacaaatgctggccctgtcctgaggggtctcaagtcaccctacaggcctccccctggccctacagagtgaaattgtctgtatggctcgttccctgaggtcaaggagcctgctggcttttattttccccttgtaaatcttataaatgctcccagttaaccattccaatgcacaacatagtgagcaaaagccctgctaatctcaattccctatgataaacactgagctgttattcagaattttcctatgcttatattacatagaagaatatttttttaaaaagcatggccgtgtgttctctgtatttcctccagtgccacatggtgacttgactgcagaaggtctgagtggacatgggctgaaggcaagtcccttgcttcatcgcctactgtagcctctgtagagcttcaccttacctgatgtatttagcaggtttgctgatgtgtgttccgtcgggacacttttggcttcattatccttgccttgtggccaccttttggataatttgaatttgacccccaggtctaaaacagagtttacaggctgcctttgaaaatgtgacctttccagtccatgtagggatagtgctcttacatttttcatatgataatgcagtctatagatgtgacttgcttagagaaaatgatgaaattgttaatttttataggacagctgtaattgctttctcttcagcttagagacctgcgcaaagaaaatgaattcgtgaaaggacaaattgttattcttgaagagactataaatgtccatgagatggaagcaaaagctagcagagaaacgatcatgaggctggcttcagaagtcaacagagagcagaaaaaagctgcctcctgtactgaagagaaagagaagctgaaccaggtatgatatgtgaagtatacgtgtgcatctgggaccatgttgaagaagcagaaatggaagagatggatgtcagataagtgccctagaactactgattacgattttttttattgatcacaattttaagagcctgcactcagcaggagggttgggggtgacatgggacaaagtgacttgaacaggccattggctatatatgtacatttaaaaattttttaatttaaattttaattaattaattaatttttgagaaggagtctcactctgtcacccagactggagtgcagtggcacgatcctgactcactgcaacttccgcctccctggttcaagcaattctcctgcctcagccacccaagtagctgggactacaggcacccaccaccatgcccagctagtttttttgtttgtttgtttgttttttttgttttggacggagtctcactctgtcacccatgctggagtgcagtggtgctatcttggcttgctgaagctccgccaccctggttcacaccattctctcacctcagcctcccgagtagctgggactacaggggcccaccaccacacccggctaattttgtttttttgtatttttagtagagatggggtttcaccgtgttagtcaggatggtctcaatctcctgacctcgtgatctgcccgcctcagcctcccagagtggtagaattacaggcgtgagccaccacggccggtctaatttttgtttaatagagacagggtttcaccatgttagccaggctggtctcgactcctggcctcaagtgatctgcccaccttgacctcccaaagtgctggaattacaggtgtgagccactgtgcctggccacatttttttaaataatggaaaaaaggaatacaaaacacttaaaattaaagaatttgtagagaagatgtcttactttagttaaattataggatcttaaaaagtttaaatttaatatatttgaacaaataggtaatatatttacaagaaacaaaattctaaatgtacaggagtatatggtgaaacatgttccccatacccctctccccagccacccagttctcttcagaggcaacctttctgttaacaatttctttctttaaaaaatttatttgtagagacggggtctcactatgttgcccaggctggtcctaaactcctggcctcaagtgatcctcccacttgggacttccaaaatgctgggattacaggcatgagccattgagccctgccccagtgatttcttatatactcttctggaaatattttacacacatatatacatattcttttaatttctttttaacacaaatgttgacacactctgcacactatatgtttctctttttatttattttttaacacaagtggcaatatactatacattattgtcaatacagctattatgagtaatcttatatcattcttcatgtgggaggatatatcagtaagacaaaatccaagaagtagactcgctgggccaaaggacatggaccttgtaattctgacagatattgccaaagggaagtgactgaattgtaaacttttatttacacaatgaattggctgatcttttcaaatggtctgcaacctatttgagctatttaataccatatgtattttttaacattgtataatcccttaactataattttgtgataaagaaatttattatgggattaataataatgatccatttccaaaagcaaaaacgagcttatacaatcagttaataaaagtacataggaaaaaagtgaatggcagtggcccagcagatggaatttaagatcagctaaggactgatgctgataaagggagcctccttgtgggtgaagggctagtggtggcccacaggctgaggaggggcctggggaattggtgggtgcaggagaaggagttgccttttcaggaatttcttttgggccttttctgtctagtgacagccacactgaggtgagaagggaagttggaaagcacagtcatgatgataatttctattttcaattaattccctgcatcaaaaggcccttcgcaccactagctttattctcctgacacattaactctgtggaaagtgcaaagtttattattgttgtcaatgccctcattgtcagcttgggctgccataatacagtaccatagactgggtggtttaaacaacataaatgtatttctcacaaatctggaggccgggaaatccaagatcagaaccaacatggtcaggttctggtgagggccctcatcctgcatgtagatggctgccttctccctgtgtcctcacatgtcacagagagagcaagcaagctaagtgctatgatgtctttccttctaagggcactaatcccatcgtgaggtccccaccctcaaaacttcatctgaacctaatcatctcccaaaggccccacccacaaataccatcacattgggggttaggacttcaaagtatgaattttggggaagatacaaatcagtccatagtattaggttggtgcaaaagtaattgcggtttttgcaattacttttaatggcatcaacctaataacttaccattatttttcaccaacattgtcttttaaaaaatttcaaatatatagaaagagtgaaggaatatgacaatgatcacccacccaccatccacccagatgcaacaatggttagcattttgttttatttgctttattattttacataatatgtatttgttattgtttatttattgttacataaacatagatatatttgcagaatcacttgaaaataagttgcagacttcataagtattgcctctaactatgtcagcatatttatcctgagaataaggacattgccctatgtaaccacaataccactgctgcatctgaaagttaactataatgccggataccatctgtggtggttttcaagcacatacatttttttatatgcttcctcttgagcacggtctggacttagtgattcccttctagtgaatagaatatgtcagaaatgatggatatcacttttgatattaggttataaaaaggctgtggcttctgtcttaaatacactctattgatctctctggagtcacttgctcttgagggaagccaggggccatggtgtgaggtaggtctagggagagggaagtcagctaccatgtggtgaagacacttagcctcctctcgggaggcccacgtggtaaggacctgaggcctgtcagctaccatgtgagtgagcccagcagggaatcgtcccctggtcaatcctggggaggactgcagccctgctcaacaggttggccctaaccttaggagagcccctgagccagaaccaccaccagcaaagtcgtgctgagattcctgacccatagaaactgtgagataatcagtgtttgttgttttaagccaccaagtttggcttagctaataataatctagtatcatttcacattcacatttcaccccttgctacaagaatgtcttttacagcagttttcttccccaaatttggaacctacctaggttaattcactgcatttgttgattagtgtcaggtttttttttttttttttggttgttgttgttttaaatagcattgacatgttggagagtccagagcagtggcctgattttttcttcactgtgtggtttaacttgtttctctatatcctgtaaacttaaaagttggatctagaggctggattggattcaggttaaggcttttggcaagaatattatgtattatatttcacattgcattctattagaaggcaaataatgttagagtgttccactgctggtgacgataagtttgactacgaatctctttggcgtaagggtacatttttttctcttctgcagttaagtttctatggggtgatcattatcaggttattcctgttccctctgactttacctagtgatgttagcatacgccgattcttgtctggattaactattacatcatgggtggcaaagtggtgatattctaatttcgtcattcctcccatctattaggcagtagtcttctctaaagaaaagctttctttattttctttccttttgttttcaattctatggacacatgggtttttatttatttactgtgttataatcaattattctctttcagtgctccaaattctccaaatttgtccggcagaagctccttcaggatgtaccctgtgaccttgtagcatgagtcctttagtctctcaagtcttcctcgatctctggctgaagaagtcatcacaggctttcttgcaatattcaggccactgaactaaaaccagccaaatcagccaattcttttttttttttttttttttttttttttgagacagagtctttctgtctccaggctggagtccagtggcatgatctcagctcactgcaacctctgccttccaggttcaagtgattctcctgcctcagcctccctagtagctgggattacaggcacgtgccactatgcttggctaattttttgtatttttagtagagagaggtttcaccatgttggccaggctggtctcgaactcctgacttcaagtgatccacccacatcggcctcccaaagtgctgggattacaggcatgagccactgcgcctggcctaccagccaattctttaaagagctttggttcctaagactggtgaatggtgcttagaaaccaaaattgatgatttataaatgctcatttattgaatacttaccattagcccagtcattgtgctaatgatcagagaggttattcactttgctcaagttcacacagctattaaatggcaaagctaggatttgaacccatatcattacattattgtaccttcagcaataatcctctttccatatatattcacagttacatcctacatacaagtctgatgccagaaactatttattagtcagtggaacaacaataataaatagccatacaaatgtcctcagtgagtaattttaattcaattataactagtagttattaaattatcaagatttgaatattagggggagaggaggggttaaaaaagacttgactattaggaagaatttaatatttatttataaaaatgcatctctagagatcagtagtaggaaacgagtaaggaaatgtgttgtaatagcacattcaaaaaccagaacttattcctcttcttatataagtgtcttcacttgtaatgactgatgcaatgttgttcagactttggaaacacattcactttgggatgaagttcctgccaaaatcataaaaattgtaaaaaaaaaaattatatgggcaataaaaaaacttgaggtctttaataaagtactttattcataggattgtgcctcccgaagatttactacttaaaaataccatcaggtggttttactgacacattaacagactcaggaagagtcttcataatgctttctaaagctctatttttgaggtaggaaacttactttattagtgaggtccagaaggactgcagaagtagaagtagccacaggactagggtgtggtttctacataactcagcttttctgatctgcttgaagactctacttcagttccttcaagaaaatttcgcaaataaaaatccaagtgatttgtcatatatatgataaatatattacttaaaaatattttagtagttcatattgaagtatgtcttaaaaactaccaaaagttggtacttggtactttttcccttggttttcttgaaataacctactgaggaataacctatttgaggaaagtagtcattttgcctgggcaagccacacacccatttcctatgaattacagaagttaaaatcaatgagatcagaaactaaacttccatgttgcatttaattctactagcaagaattaaagctaggaaataaagtggtgttagagtcaggcaggcctggatttgcaatgatgtcagttctgccttttttgttagcttacagtggagtatgtaagagagacactgcacaggccaggtgcagtggctcaagcttgtaatcctagcactttgggaggccaaggcaagcggataacttgaggtcaggagtttgagaccagcctgaccaacacggcaaaaccccatctctactaaaaatacaaaaattagccaagcgtgtggtgggcacctgtaatcccagctactcgggaggctgaggtagaagaatcgcttgaacctgggaggcagaggttgcagtgagctgagatggcaccactgcactccagtctgggcgacaaagctggactctgtctcaaaaaaaagagagagcaagacagagagacactgcgcagagcggttaagaagctaggctctttaattaggctgcttgggtttttatcctggctccagaatcattcggctatgtgattgcaggcacgtagcttgatctttttggacctcagttttttttttttttttttttttgtgagacagagtctcgctctattgcccaggctggagtgcagtggtgtgacctcggctcactgtaacctctgcctcctgggttcaaatgattctcctgcctcagcctcccgagtagctgggactacaggcacctactaccacgcccagctaatttttgtattgttagtagagatggggtttcaattcactatgttggccaggctggtctcgaactcctgacctcgtggtccacctgcctcggcctcccaaagtgctgggattacagatgtgagccaccgtgcccagcctggacctcagtttttaaaatctgtaaaatgggaaaataaggctctcttactattacgttagaattaaatggtaaaatatacataaaatacttaggacgtgtctggcacacaattggtgttcagtgttttcatttccttttcctagttatttacttttacctggggataagataaacatgagattaatttatagtcatatggaaatagttcctggaagtaagaaatgactagatgagatagactactgaagaaatgacagacctctttacaattctagaatcataaagttggaagtgaccttcaggccatttagaatctagatcatctaactctctatgtgaaataagaatcatgttttaaaacaatttccctgactagctaatgttcaacctttcctttaactcttctagaaatggggaactcactactgtataaggaggtccgtctcatctttgtgaactgtttgacagttccgtattgtagcaagtcaggattagagtctctataattcaactcctcatcctgttactcacttgtgaaatttcactgaataaatgaaaatccgttttcttatggccacccttcaaatggttaaggacatttattatggatttctaagtctcttcttctggctaaacagccttagatctttcaaacttttcttacttgaaccctccttcttattgcctgtgaggctgggggagttctagtctgtgggtgaggaattaaaatgaaaacaaacaccaaataatatctgcccatattatacaaaattaaagctggattggggatggtggcgtatgcctgtaatgtcaacactttgggaggctgaggctggcagatcacttgaggccaggagttcaaggccaacctgggcaacatagtgagatctccatctctataataaaaagaaaagctgtttataagactcctacaaaatgacttattctcttttttagttcttttgaaaattaccattaagactttaaagtggccagctgtggtggctcacgcctgtaatcccagcattttgggaggctgaggcaggcagatcacttgagggcagaagttcaagaccagcctggtcaacatggtgaaaccccatctctaccaaaagcacaaaaattagctgggcatggtagtgcatgcctgtaatcccagctattgggaggctgaggcatgacagtcacttgaacctgggaggtggagtttgcagtgagctgagattgagccactgcactctagcctgggcgacaaagcgagaccctgtctcaaaacaaaatcaaacaaacaaacaaaaaactaaaactttaaagtaatacaattttattcctgattcatcaatttgaggcagtatttggcaaagactttctgctatgaaatatgaagaatttcatgcctcctactttttttatttattattgctacacgatacttgtatgtatttaacgggtacgtgtgctattttattacacgcatagaatgtgtaaggatgaagtcaaggtatttaaggtcttcatcacctcaactatttatcatttctgtgtgttgggaacatttcaagccctctcttctagctatttcaaaatatacaatacattgttaactatagtcaccctactcgctgacaaacattaaagcttatttcttctatctactgtatgcttgtatccattaaccaatctctcttcatccctcctcccacccacttacccttcccagcctctggaatctatttttctactctctaactatatgagtcaactcttttagttcctgcatatgagtgagaacatgtgatatttgtctttctaggcctgacttatttcactcaacataatgacctctcattccatccatgttcctgcaaattacatgatttcattttttaatggtttaatagtattccattgtgtatatataccacattaaaaaaatctattcaggcctggcgcagaggctcacacctgtaatcccagcactttgggaggccaaggcgggtggatcatgacgtaaggagaccgagaccatcctggctaacacggtggaaccccgtctctactaaaaaatacaaaaagttagccgggtgtggtggtgcacgcctgtagtcccagctactcaggaggctgaggcaggagaatggcatgaacccaggaggcggaggttgcagtgagccgagatcacgccactgcactgcagcttgggtgacagagcgagattctgtctcaaaaaaaaaaaaaaaaatccattcatccgttggtggacacttcggttgattccgtatatttgctattgtgactagtgctgcagtaaacatgagtgtgcaggaatctctttgttatgctcatgtcctttcctttggataaatactcagtagtgggattgctggatgtgtggtatttacatttttagtttttttaagaaatctccatactgtgttccatagtggccatacaaatttacattcccaccaacagtgttaacaaaagttatctcttctctgtatccttgcgagcatctgttatgtttgtttatttgtttttgtctttttaataatagccattctaactggggttagatgatacctcattgtggttttgatctgcatttccctgatgatcagtgatgttgagcattttaaaaacttaaccttttgggacaaatcccagcactttgggaggccaaggtgagtggatcacctgaggtcaggagtttgagaccagcctggccaacatggccaaactccatctctgctgaaaacacaaaaaatcagctggacgtggtgatacacacttgtaatcccagctactcgggaggctgaggcaggagaatcgcttgagcttgggaggtgaggttgcactgagccgagattgcgccactgcactccaacctggtgacagatcgagactctatcttaaataaataaataaataaataaacctttggccatttgtatgtctttcgtgaacttctattcatgtcctattcatgtctattcatgttctattcatgtctattcatgtcctcacccactttttattgagattagtgtttttttttttttttttttttttaatgttgacttgcttgagttcctgtatgtattctggatattagtcccttgttggataaatagtttgcaaatattttctcccattcagcaggttgtttcttcaccctgttgattgttccttgtgctgtgtagaggctttttagtttaatatagtcccatttgcctacttttgtttttgttgcctgtgctgttgagatcttagccctaaaatattttcctagccaatgtcttgaagtgtttcttctacattttattctagtagttttatagttttaggtttaagtcattaatccatcttgaattgatttttgtgtatgatgagaaagatagtgacctagtttcattcttctgcatatggatgtctagttttcccaacaccatttattgaagaggctctcttttaccgcaatgtatatgcttggcaccattgttgaaaatcagatggctataattatgtggatttatttctggtttctttattctgttccatttagtctgtgtgtctatttcataccaataccctgctgttttgtttattatagccttgaagtatattttgaagtcagttagtatgatgccttcagctttgttctttttgctcaggattgctttggctacttaaggtcttttgtggatcaatagaaattttatgatttttttccatttctatgaaaaataatattaatgtttcgacagggattacagttaatctgtagactgctttgggtaatgtggtcatttaacaacattaatttatctttttttttttttttttcgagacagaatcttgctctgtctcccaggctggagtgcagtggtgtgatcttggctcactgcaacttccacctcccaggttcaaatgattctcgtgcccagcttcctgagtagctgggacaacaggcacatgccaccatgcccggctaatttttgtatttttagtagagataggattttgccatgttggccaggctggtcttgaactcctggcctcaagtgatccacctgccctgacctcccaaagtgctgagattacaggcataagccactgtgcccagccaacaacattaattattctgatccatgagcatgagatgtcttttcatttgtttgtgtcctctttaatttctttcatcagtgttttgtagttttccttgtagaagtctttcccttccttggttaaatttataaattattttatgtttttgttggtattgcaaatgggattaccttcttgatttctttttcaggtagttcattgttagtgtatagaaacactactgatttttgtatgtttattttgtattctgctactttactgaatttatttataagctttaagagtttttttggtgtcttttggctttcctaaatataagatcatgttgtctgcaaagagggacaatttaactttctcttttccaatttggatgtcatttatttctttctcttgtctgatttctctggctaggattttcggatacatagaaatgttcatagtcatctctgaggatcttttgtatttctgtggtatcagttgtaatgtcacctttgtcatttctgattgtgcttctttggttcttctttttttcttagttaacttggctagtggtctgtcaatttggtttatcctttcaaaaaagaaactttttatgttgctcatccttttatatttttttggctctgaattttatttagttctgttctgatcttagttatttcttctattggccttgggttgagtttgttcttgtttttgtagttccattaggtgtgatgttaggttgttaatttgagatctttctatgtttttgatgtatgcatttagcaatatattttcacatttagcactatattttcctcttaacactacttttgctgtatcccagaggttttgatatgttgtatctttattttaattccattcaatgaatttttaaatcctgctttaatctcattgtttactcaaaagtcattaagaagcaggttgtttagtttccatgtgcttgtgtggttttgggagtttttcttggtgttgatttctaattttattccactgtggtcagagaagatgcttgatatgatttagtttctttttaaatttattgagacttgctttatgactgaggcatgtgttcaattttagagaatgttctatttgcagatgagaaaaatgtacattctgtggttgtggggtgcagtattctatagatgtctgtgaggtccatcttgttgaaagtccggtttaagtccagaccttctttgttagttttctgacttaatgatctgcctattgctgtcaatgtggtgtcaaagtttcccatgattattgtatggctatctcttttcttatatctattaatagtagtattttataaatctgggtgctctgaatctgtgtgcatatatatttaggaggatagctaaatcttgttgaattgagccctttatcatcatgtagttcttttctttttcttcttactgttgtaggtttaaattctgttttatctgatacaagaatagcaacttttgctcttttctgttttccatttgtgtgatggatatttctccatccctttactttaagcctgtgtgtgttattacatgcaagatgggtctctagaggaaagagaatgtagggtcttgctttttaatccaatttaccactctacttcttttaagtggagcatttaggccatttatggtcaaagttactgttgatgtgtgaggttttgtttctgtcatagtgttgttaactagttgctttgtagtctttttttaaagtaaaaattattttaatttttatctagtaaatttttttttaaaattgtgtgggtacatagtgggtgtgtatatttatggggtacatgagatattttgatacagccatgcaatgtgtaataatcatatcatgaagaatgggtatatccatcccctcaagcatttttcctttgttacaaacaatccaattatactcttttagttatttaaaaatgtacagttaaattattattgactataatgctttgtagtcttaattgtgtaattgcttcatagggtctgtgaactttgtacttatgtgtgcttttatagtctcaagtattattctttcatttccatgtttagaactcctttgagcatttcttgtaggtctggtctggtggtgataaattctcttactgtttgcttgtctgggaaagactatatttctccattcatgaagcttagtttggtatgaaatttttggctggcaatttttttctttttaggaggctaaaaataggacctcaatctcttctggcttgtaaagtttctactgagaagtctactattaatttaataggttttcttctctaggtaatttggcccttttttctaggggcctttaaggttttttctttctaattgaccttggatagtctgataactatatgccttgggaatggtcttcttgtatactatctcataggagttctctaaatttcttgaatctggatgtcaacctctttagcaagattagggaaaaatttctgaatttttccctcaaatctgttttccaaattgtatactactttttcatcttctctttcaggaatgccaataagttgaagatttgtgaagatttggtcaaagccatatttctcaaaaactctgttcatttttaaaattatttttaaaattttatttttgtctgacttggttaattagaaagactggttgtcaagatctaaaattctttcttctgcttagtgtaatctattattaaagctctaacattattttgaaattactttagtgatttttttcaatttgagcaattctatttgtcttttttcttaatatgggcatctaatctttcatatcctgaatcatttttctggttttttatgtaatggatttcaaatttctctcagatgttattgagtttccttgcaatccgtattttgaattctttatctgtcatttcagatattttgttccgattaagatccatcgtgagagagctagtgcaatgctttggaggtgtcaaaacactctggctttttgtactgctggagttcttgcactgagtccttctcagggaaatgttgcttcttatttttgaatttgctattgtttgaatgggacttcttttttaaattctttttttctcttaggggtatggctgtgatatatattatgtgtgatcgtttggcttcattttgggtgatttcagagggccaaagtgctgtatatgttccttggttgtggatagcttctgtgtggtggctttatcagaccatgcttgttgaagctgtattttggctgtaagaactaattagaaagactggttgtcaggatctaaaattctttctcctgtttagatattctatcttctgtagggctgggggtgcagagtcctggggcacttattttgtggaatagcactaagctcttctggtagcagattttgtatttggtagtgcagttgaaactgcagtccagtaaatggtgcttaagagtaagagctggcaggtaggctgatgtccagtgaaagcaggtgccttgatgcgttttgggggaggagtgggtgggaagagatggtgttgaggtgtaggtgtgctgaggccttaggggaggggctggggagtgtccttgcttttcgccctgagccagcagaaaagtgatttgcttccctatcaaacccctgttgcagggctcatgactttcatttcataaagacttggtcctttggtttttggccacagtgtggctgcaggccaccagtatgcccctctgatgactaccaccaaaatgggctgaggggagagtctcttcccccagaccagagcaggtacctccatggtttgtctgtcttccttttccgggatggtgccattctgtgtagggaaggggaggtggtcccttcccttcgtaaaagcctgagcagcatggggctcactttcagcatggtagagctgctgtgaagagcacaaaaaaatgctatgtccaagtatgtgttcactggcccctagtgggaagaaccactcttgtgtccataactgcataagtggggtggagatgaccgctctctacatatcttccctggctatgggactgcctcctttagtacttggcaccttatctgtgtttcctttgtcccaacagggacttggtgggctgtgctcccctctcccttagaggtgtcccatgttgagagttaaatctccagggatgcagctgctccttggggcctacgagtcccctgcacctgccaaagtcagaatgggttgtggggtatgtttgcaagagatctagtggtacagtgactcaaggttggagagtccctgggcagggctgtttcccactatgggtgcattaccagtatggtgcccacagtctcagctcaggtgtgaggggagtgtgggcacgtctgtgtgagctggccaccaagttctctgtccctgagaagttctcagatgcccccaatagtgttgacctggatcacaagggcagaggggctcaccagcagtttaacagtcaggggatagtcagagaggtgagtggggcagagaagctctcccacctaccctttctgtggggctctgagcttctcaggggtcaatctctgccagcctcttgttgctttctttttctgcagctcagcttctttttgtgggcactctgacaggtcctggctcacttctttcagttttccattcacattttgtccattcactagtaactttgatcttctttctgaggagaactggctttcaatgtccctagtctgccatcttggagagtcctattgtgctcctttggaggcatcatatttccttgcttttgcacgtttcttgtgtctttatgttggtatctgtgcatctggtgtgacagtcacttcttccaatattttggatttgcttttataggggaggatgttttcctggagatgcatctgtgatgttggttgggtagggcactttggctctgattgtgggtgtgtgcagcggtgtagtttcctaatttgttcagctgtaaatagtgtcattggtgtccattatttcctcaagagcttagggtgtggttgttggtggagttgtgggaagttttgctggggacagggataccaggtgggccagtcctcaggccccgatgggaacagcagtgggccaagagtgcctgttcttaggccgcagggtggcatttgctggcactggtcttagcaggtctaggtgggtctatactggcagtggcagcagcaggtgggtctttcagtccctgggcagcagtgtggcatgggctatcatagtagcagttgtgggacaatgctttggctctcaagctgtctgtgctggtgttgacagtggctgtgatggctgggcaggccaggccctgcgcctgcaggttgtgtgtgcaggtgggtgccatctgtggtggtagcaacagggtgagtgagtccatcttcaggtccctggtggaagtgctcaggtgctaatgatggtggatgtggcagagtaatccccaagtccccagatggtgttttcatgcactgcggtgggggtaggggcagagcaaagccaggtgagcctgtcctcagaccccctggtggtgcctatcagcactggctgtgatgtgcaagggtggggtgatccctggactcctggaggagtgctttgataggggaggcggtagctgcagtggggccctgctgctggagaaggtggggttgcttttagtggctgcagctgtaggcaggcagctggggagcacgtgctttggccccagttggcacctatgcgttggggagcctgtccttgggacacttgtatatgtgcgatggtggcctgctgttagtggggtggggttgctgcagtggcttggctttggccctggcagcagcagccagctgaagcagcagctgcaggtggggtatggcagtggggctcctgggatgtggagatgcaggggctgttgggccccaaggcagggtgatgtctggtggaggctggctctcaaaatggcatcttgctgtagctgcctaggactcagggtggtgtttgggattcagcctgagctctggagcaatgccattgtgcggtctgcagacagctccctatgttggtctctgggcctgtgaggggctctctggtggctgggactggaggaatccatgatgggagtatggacgctgcaggtctgtcactcccctttccctgcattggggagcttctctgtgctcccagccagtcctggccaaccaagcaggctgcttctctttcctccccttccttgccctaggtgtttcctgttggttctctgttgaattccaatgttctgtctttgctgatctattcaaactgtgattatctactcgctgttttattcttctttgtggaggggcagctgatagatgcctctagtccatcatcttgaagccctgccccttgagaacttctaatgtcccctaatttttagcctcttctttctatatacttcccggtttttaccatattattttatttaccttgtccaagtttacattctattctgtacatgtaactaagtctttagtagcttgtctgtaggttcattctaaaaatttaaaatcagttaaatccatatgttaaataacatgattatataaatatttttattatgggtctaatcttagcatgtgatgctgagcacattccattttgccgtgtcccttttacaatttccagatgggaactgtcggtggttgtccaagcacagtctgatcagttcagggcagagtgtctgcagggctgtagtgaagcccaggaacacactggcctcttgggcagctaaatctgttgtcaactagtactgattttgtcaatgttgagaatttcaaacttaagctgaattctaattttccagagttgatgatgtcattgggaaagctcagatttggggaaggtcttcctcattttgaagtaaagtgtttctctgaagattccattctattggctcatgggcctgagcaggagaaacctaatcctccttctacatgagtcttccaatcatttgaatacatctacaggataaatgttccagttcttttaacatttcctcttagaacatgatttcaagacttttgccattctccttcctaaactctgaatgtgcatttttttttcaaactatctttggggaagaatacttttttccttatttccagtccattgctgacaaatacttctataaaatacaataaaatgaattaatagaaaaaaattatttaaattctataaaatgaatgaacagaaaaaaatatttaataagatacaccaagcacaagtccaaatttttaagtattagaagccacagacataaaattaattttcgataatgaaaatcagaataaacatgagagaaagaatagaattacccaaattgtacacattcttctttgtgtgtaggagattagtataatgaatcactagtatcactattatactcatagccttccttttgttgttctttagtcataagttttattatgactaaaattccctgtatttaagttctacatacacactttgaatgaatactgcttatgttagtatttaaagtttgtgacaatcagctgcttcttgctagttcacttagttaatcttggttggattgatgacaatgttgctttcagtgcctgttgtataggaaattttttcttttttttgagactgagtttcgctcttgttgcccaggctggagtgcaatggtgcgatctcagctcactgcaacttctgcctcctgggttcaagtgattctcctgcctcagcttccccagtagctaggattacaggcatgcaccaccacacccaactaatttgtattttcagtagagacggggtttctccatgttggtcaggctgatcttgaactccggacctcaggtgatcagcctgcctcggcctctcaaagtgctgggattacaggcgtgagtcaccgtgcctgacccctgtgaaactgtttttatgttttgcttttcagatacttacagtagaaaacaaatctaacagaggtttgttgagaatagattttaaagcaatttcaacaagctcaatatatttgtaggtaccttgtattcaaattaaacaattgtaatttcagctttccttttttttctgtttattttttcttaaaaatatttgatagagacagggtttcaccatgttgcccaggttggtctcaaactcctgagctcaagtaatccacctgccttggcctcccaaagtgctggaattacaggtgtgagccaccatacccgtctgaaacaaatgtgttttcaaaatccatcttcaatccttcatctgtcaacagttctattagtttattttgtaaaggtatagttatgtttaaatatgatgaaattcttttgaggaaagaaatgggttctggattttatatacttatttagattatagttggcaaaccagccttaaaatatcacatctgtagcctgttccttcagtgtacaacagatagcaactctcaccactagccacttaccacacaagtctaacaaagagtgaataggtacatacttcattcaaaaatggagtataggctgggcgcggtggctcacacctgtaatcccagcactttgggaggccgaggcaggcaggcgggtcacaaggtcaggagttcaagaccagcctgaccaacacggtgaaaccctatctctactaaaaatacaaaaattagctgggcatggtggcacgcacctgtaccccagctactcggtaggctgaggcaggagaatcgcttgaacccgggaggcggaggttgcagtgagctgaaatcatgccactgcactccagcctgggcgacagagtgagactctgaaaaaaaaaaaaaaaaaaaaaaaaaagggagtctatggtatttggatgttgcatcagtgtcaacttgctatagaaattgctaatatcttaccctcaatttctgaaatgatcttgttgggactgtgaacagcaggtgcaggagtggtaccagaatgtaagtttgaatagtgctgtccaaggagggttttgtctgtattaaagtttgaatcacagaactgaatgccaaacttcaggcttggtgtaattcgaaggaaatagagcaggacatcacctctctcattctaaatactttacttttgtgaatgcagcccaagtttgggaaggggggaatgggtgtgtgcatgtgcatgtgtatatttgtgctcatatcactgttgactcaacactttaaatggactaaaattccccggtgttttcatagttgccactattctatcacatcttcctttcattcctaacccctggctacaattcccttctctagaggtgatgagaattggcagttgcttgtgcatgtttctagagatattcttttcataaaggtacaaatggtactatactatgtaccattgttatttgtatagatgcactattaaacaccttactttcttcactaactgtatcttggagaatcattcatattggtatataaagaacttccccatttcatttcaagactacatcatattctatagtatggatgtctcatatttgtttaagaagttacatatcaaagaatattcatgtagtatgttgtcttttgctatattataattggataactacatattcctcattttctatatttagtaacctatcttatagatatatcctcaggactggaacttcagggccaaaagataagtgcatattaagttttgttatgtatttatgccaacaatttataccaaaattatacctgttcacattgccaccagcaatgtatgagactacctgtttgggggaatttctgagtttttttgttaatcataactgcagtaggtagaattaaccaactgatttttttattttataaaattgatctaggattgaaggaattaagctcaagccacaggttctctgtcctgatgataatcattgtacttttgagtggcaatttgatctcatgtgtatctaaatccataaaatagcaacagaacaggaatcaattgtgtttttaaaacgcaaacctttggatggtttcattacttaatgcagactcgtgcatttaaatgggaagctaaattgaatgccataatcatattgtttattaaagtttttgttaaaagtaattttgaaagaatcattttacatttgtcgcttcagtcagactgaacctaaagacttattaattataaaaaaattttttaagtgatccccatcacagtctatagggcctgccctctgtgatttcctctgtggaggtcagtcttggttttgctcacaggaagctttatgtttcttgtcctgtatgtcagtgtggtctgacagcaatccccaggtcctggccagtggtactgatgtcacattattttatgccgcttgcttcggcgtatccttgaggtagccatggaaccagaatccactctgatggctttctcctgataggtgaacaagtaattgcatttgcagtctgaggacatttatttccagaagatcagccctgtgcccctgaatcctgcagcacttaatcagagcactaagggagcgaccatccccaaggccttgtcactctggctctcgagtcctgcattttatacaagaaacagcttagggttcactgagctgaatgtgcctgaaaaagagaaacccaacttgctcacagacaccattgtattctatgaacacaaactgattttgtgattttcactagacataaatgttgatgcctaggtttaaaaagaaaacgttctttggatttgttagagaggattgttttggcccttttcttgaagtcagtgaaacattagtatgatattggggtagaaaaattcctcatagttgaaatattttaattgtgtttattggtcttgtggtgttggctgccagttgagttgtctactccaaattgacagtaactccataagtcacaagcatctgagatatattttgtgtattttgagggtctttagtgaatatataatattccatatggttttagaattctaaagtgattaggattaatttccatcccagcatcattgaatttaggacctcaattttctaaccacacatcagactgtgcagtcgaccctctgcatccacaagttccacatctgtggattcaaccaactatagataaaaaaatatggaaaaaagccaatacaaataacaaaacaacaataaaaataatacaaataaaaacaacacatgataacagttatttatctagcatttacagtgtatttggtattataagtaatctagagatgatttaaagtatacagaagaatatgtgtagcttatatgagaatattattccattttatatgggagacttgagcatcctcaggttttcatatcttccggggtcctagaaccaattccccaaggataccaaggaacgaccgtagtttccaagtaaaatatgccccaatttattatcacctttactgatactagttactctaattgagcaagtgagaagatattgtattatgatctgaagagaaatctgtaaactgttaaaatattgaatttgtgataaagtgtccttgactctacttttaaggaccgtcatttaattagcagcaacagtggggcttctctacagacatgactagtttagcaaaggaaaggggaaaccaagaccttgaaaagcaaaaggcattttacaaaatagattccataattagttgagttattacatctctgaaaagggcaggcttctctaactacatatctactctgtgacttttctttcaaattgatgcctgagacttccttgattttaaaaaagtcaccataatggaaaaaataagatgttatgtttcctataaaaaataggaactagtgtttcaggctatcctttttcctgtttccaagctgttaatggagagaaatttcttttaaagcccagttctaatgcaaaagaggtgactgcattttaactggcagcctgaaatgttatcagctcatttagatgtagagtctgttatttaaaaatattgtgtttctttttagtgctttttacctctaacatactatttttaataattttttttttttaccagttaactaggtagcaatactacagccatgctagttaacacgccgcttaatatttcttaatgtgaattcatgtattttggaacttgatgttaaaaaataattttaaaaatcaattttaaagatgctcatgcctgtaatcccagcactttgggaggccgaagcgggtagatcacctgaagttgggagttcaagaccagcctgaccaacatggagaaaccctgtctctactaaaaatacaaaattagctgggcgtggtggcacttgcctgtaatcccatctactcgggaggctgaggcaggagaatcacttgaacccagtaggcggaggtcatggtgagctgagattgtgccattgtactccagcctgggcaataagagtgaaactccgtcccgggagaaaaaaaaatcctcctttggtgcctctgtgggccattctagattatggtaaatagaattaagtacacaggtaaccttctttatgtccttcattatttttctgaacctaatttcacatgttatgttcttatgttgttattttgagacaaggtcatgctgtgtcaccaagtctggagtgcactgatgcaattactgctcactgtagctttgaattcctaggctcaagcaatcctcctatctcagcctcccaagtagctgggaccatagcacatgctaccatgcatggcaaattattttattttatataagatgggggtttaccaagttgcccaggctggtctccaactcctgggctcaagcaatcttttgtctcgatctcccaaagagctgggattacaggagtgagccactgtgcccagcccatattatattctttaagattattcttctaagtatgatactttccctctacttttaatcctcccacctaccaaatggctagttgtttctgtttcctttcttcaggttctttctgcgttgtctttatgagacaaggggatatgcaatgaatattggatattggaagtcaatgaatagttttatgcaatgatgtttttatgagaatattcctctattattcaaaatagcattgagggggcatctttattcaaataattgttagtgcctagctaggactctgagagcttactgtttattaaaaataaatttccgtatacaccaagcttgagaaagatagttctataaacatattctacatatggactgaatctactaatatgttatccaatgatttgtttttattaactctttccagtattccacacagaaaaggcttatgtgtcaaagtttccttcttttttctaacccagattttatattttatatcccttctctgtgttttttttttttttttttttgatggagtcttgttctgttgcccaggctggagtacagtggagtgatctcagttcactgcaacctccacctcccaggttcaagcaattctcctgcctcaggctcccgagtagctgggattacaggtgtgcgccactatgccccgctaagttttgtatttttgtttagtagaggtggggtttcaccatgttggccaggctggtcttgaactcctgaccttagtgatccacccacctcagcctccaaaatgctgggattacaggtgtgagccaccacgcctggccccattttctgtttttaagacacctaaattttcctgacataccattgggatttaataactttatgaggagactatagggaacttggagttaaaaatggaaggagtaattaacccaaccccttgtagtcattagcaggcaaagtcaatgaatttgccatagcaaatgcaggtgtaccctgttgacttctaatggtattgtcttcactttctgtaatcattttaggacctgctcagtgctgtagaagcaaaagaagctcttgaaagggaagttaagatcttccaagaaaggctgcttgctggccagcaggtctgggatgcctcaaagcaggaagtgagcctcctgaagaaaagctcttctgagttggagaagagtttgaaggccagtcaggatgcagtcacaacctcacaaagccagtacttctcatttagggagaaaatcgcagccctccttaggggcagattgagcatgactgggtccactgaggacaccattttggagaagattcgagaaatggacagccgggaagaaagcagggaccgggtgagtgggtcatggctgtttacagacatcttaagaacagtgagctcattcatttagcatgctcagtgactgtattagtctattctcacgctgctataagaaatacccgagactgggtaatttataaagacaaagaggtttaatggattcacagttccacatggctggggaggcctcacaatcatggcagaaagcaaaggaggagcaaaggcacatcttacgtggtggcaggcaagagagagagtgtgcaggggaactgccctttataaaaccatcagatctcctgagagttattctctatcacaagaacagcatgggaaaaagctacccccataattcaattacctcccaccaggtccctcccacgacacgtggggatgatgggagctacaattcaagatgagatttgggtggagacacagccaaaccatatcagtgacttatctcaattagctaaaagcatcacttaaggccaggcctggtggcctaggcctgtaaccccagtccatttggaggccaatgtagtcacttgaggccaggaattcaagaccagtctgagcaatatagtgagacccctctctctactgaaaataaaaattaagtcccagctacctggcaggctgaagtggaagaatttcttgagcccacgagtttgaagctgcagtgagctatgattgcgtctctgctctccagcctgggctacagagcaaatcctgtctctaaaaaaagtataatttaaatgtggttgtattaatttccattttaatggaaaggcatggcagtcccacaagccacatctaactgtgatgcaggttctggagttggacctgcctggtgctgaatcccgtctctgctgtacattcactcactgtccatgtgagcttgggtaggttcttgagtttacggcctcggagattttgttttcttatctacagaaaggggttagcacaggttccatgaccccttacctgaaactcttggggcccacggtgtttttgagttcagaatttttcagagcttagaaaggtaatgcagagtgcagccttacacagccctccactgtggtgtctgggacagtttcctaccgtcaatcacattcacaggtctgtagctaagcccgcgagcaacagtaagtgggataaatgaagaccgcaaatagcctcttgtcattttgggtcaggatttgctgcccagctgggtcaggtcaggccaagctttgtcagtaaatgagttatgaaaaaacctggattttggaattacagataaaagttcccagacctgtaatggtatctggccgatcaggttattgtttcatgtatgtattgaatgaaaaaaattgttataaagatcttaactcattgcctggcaagtcacaacaataaatattaactattgctgctgttgcctctccttcttcctccttctctcctttttttcataatgtgttggtggcctgaacagtctttcaggggtcctatctaacaaatggagaaaaatggtttaattcacgtatatgattgaggcttgtttaactctgtcatcttgtttctactatcaagaactctctttctctataaagctttacctagcagagtccacttcagtgcaggctttgtttaaattatcatcaaacctaaattatagaagtcctagttaatgagactttaaagtaaatgatctccaaagtccttgtataattccattatgaaatatttcttctattgctgtcgtgcttgcttgaaaggagaaaacgcattttaccatcttttaatgttactaaaaaactcagaagaatcactaactcaaagttcagggttgcatttgtcaatttcctttagtgatagtaaattccctttaaaaattctccaaaattcaagcttgcagtgagccgagatcgtgccactgcactccagcctgggcaacagagcgagactctgtccaaaaaaaaaaaaaaaattctctgaaattcacgcatactctaggagcaaccttagtggcccctttagccaagcacattttcttttcttttctttcttttttttttttttttttttttgagatggagtctcgctctgtcacccaggccagagtgcagtggtgcaaactcggctcactgcaatctccgcctcccaggttcaagcaatactcctgcctcagcctaccgagtagctgggactacaggcatgcaccaccacacccagctaatttttgtatttttagtagagacggggtttcaccatgttggccaggatggtctcgatctcttgaccttgtgatccacccgcctcggcctcccaaagtgctgggattataggcgtgagccaccgtgcccggctgccaagtgcattttctatctctttgtggagataaaatgtggagtgctcattggctgtcctccactctaatgtgtagaggtctctgcgagtaacttagtttttcttgtgactcagtttacatggaggtacttgagaaagaaaatgatttataggtttggaaataagcttcattaagtcatttccttaaatggtaacagatatgcagacgatttccagctcatgaaaatttaatttaaaaaattttcaacttgacgatggtgtgaaagtgatacacattcagtggaaaccacactttgagtgtgcatgcagccatcctgttcttcactttcagtattcaacaaattacatgagactttcaatactttattataaaataggctttgtgttagatgattttgcccaaatataggccaatgtaagtgttctgagcacttttaaggtagggtaggcgaagccatgatattcggtaggttaggtatattaaatgcatttctgacttaaggaactttcaactaacacgtctttgttgggacacaacctcaccattcgtcgaggagcatctgtacttcaatagctaattttttttttttttgccatttcattttattgctttccacttctatattttcaagtagtttcttaaaactactttaatcccaaacaaggcgcataattatcagcatgatgtatatgtttattttctaaagccaaatgatgtaaattggttaagctgggtatgctttctcccactccccataaaaattagaatgattcagagtctttttagtgcctttgtctgccattcctaccctgtaatttttttcaatagctgccctccctatttaaaagcctgaaatcaagcatatagctggtgtcttgtgtgactcatcttcacgtaaaatcaggagaaaatggatttcatatattgtcttagaaatgtttctaaagaatgggagctttacaaattgatgaatctgtttgttgaggaggctgcatgtccctgccagctgccatggctacgcacacagtcagtggctgagtaattctgatgtgaaggctccacggcgggttcaggctcagcttggcagattctccgcttcaggccggctcctgcttcccgaacgttgcttgtcttgtttacccctgtgctatccatttttcccctcctgtgtttgcaattctcagtagaattcaggacaccacccacacttttacagcacgtcatttctacttgttccttgcatatctgcttctggcaagatctaatcttctttttagaagctttactatatcttagagcaaggttttccatcctcagaactattgacattttggactggataattttttgctctgggggccagtcctgtgcattgcaggattttgagcggcgtccttggcctctacccgctagtagcactccccttcccagtttgtgacaaccacagatgtctttagagactgcctaatgtccgccgggggtcaaaattgcccccagttgaaaaccactgtcttagaggaatgttctactgccaggttcccacgaattctaaatgagtatttagatgttacttagccttggaatttcaggacaccatagcagttgtttatgaaataatgacttcttgcacaatgacagaaagttacgacattttcagattttactttagaattttgaggcaattttgttttcttcttcacctctatctggacatttttcctgttctgctttaggtacacctaaggctttatttccttccttgaggtgtttgctggtccaggggctctgtgggagctgtggggaccccccccgatgctataaagcaagggtctccaaccctctggctgcgcacccgcaccagtgcctggcctagtaggaaatgggctgcacaggaggaggtgagcggtgggcgagcgagcattgcttcctgagttcacctcctgtcagatcagcagcggcattagattctcataggaacgtgaacgctattgcgaactgtgcatgcgagggatctaggttgcgtgcatcttatgagaatctaatccctgatgatctgaggtgaaacagtttcattctgacacaaaaattgtcatccacgaaaccagtctctggtgacaaaaaggctggtgatctctgctgtgaaggactggagatgtgcttcacagccccctcctccccattctgatctcagagcccgattatcattctcctgctctgttcttaaccctgccacctactaaagtgagcatcttcccagaagcaccagcacacttccatttgggacgtttcattatccaaaattatgttgtgcggttgctccgggctacagaggcatctgagagagcgaacagatggaagtttcagcttttccagcctctccagttatatgagtttcctggggctgctacgacaaagtaccgcaactgggcggcttaaataacagaaagttcttgcctcacagttctggagatgagaagtctggcatcaaggtgtcagtagggttggttccttctgagggctgtgagggagagtctgtcccatgcctcactcctagcttctgctggcctcaggcattgcattctttgttgtagggatagtgttcttcctgtgtgttcacattgccttcctctatgcatgtcggtcttcgtgtccaaatttcccctcttataaggacctcagtcatctgggattagggtccaccttagggacctcgttttcacttcatcaccactctaaagacccgatctccaaagaaaggcacattctgaggtactggggggcttcaacatatcttttttgagggggacctaatttaactcaaaacaaaagttgagatgaacagaggaggtgggatagagttagccagtcaacagtgctggtcacacaagccgacagaagggaaggaggatttggtcgacactttctagtacctgataacttacatattccccaagtgcaaattatagcttgagtaattggaaaagagtttatgtctaaaaggaactggactttaagtgacccaaatggctctttcttcagtgtagaactttttggcttctatttggtttaattttaggacaaaattgtctctctggtgaaatcaatgcatagttgtccctggggagtgaattaaatcttttagggcattatgactttacttctaaaaaccatgcagcttattctttaactatattgtgctttttgtttcaaaaaaaaagcacaaacaaaaaaatatcttttttgtttaaaggtatgtattcttcacccctcaccctccactgcccacctctagtgttgaaatatctggtgcattttgtcccatagaatatcaggtatatgttaagaaatgatcctaagaaaaagaaaagaaaagaaagaaaggcttatttattgtttagactttttggtgtgaaaaacagcacaagtttacggttttggtggagcacatatgttcactcaggcactggcatttgatgttcccaagaataagtcagaatggaaagttaatttatttgaattaatttatctaaatttagttagaaaaaaacttagtggtgtcatgtgcactgacacctaaataagcttctgaagctacgttctgtgatctgatagagtgcaggagggctctcagctgttttcttctctctggacacaagaatcttggcatggcaggtatcccctgcaaatttcagcgatctacgtattagtggttttaaagtctcacttcgctgagtctcaaggctctgtagagcaccctcaggtccagatggggtgaagatgcaagagagaccttcttgcctttgattcaaacacatttgtcccttatttgttcttcctagaaagacttctagttgagagaaagactatgctgaaaatagtttgagaaacatgacataggacaattcctggagggttctttagctcctcatggcgacagcataggattgacagaaccagtacactggagcagtaaccctgatgacggaaatggacacgatgtgttgaacttcaatatggtgtgaaatactgtaaattatctaaatcagctcattgagtcttcatagcaaagtctacgaatttcagagagattagttacttgcttcagttaacctgctagtaagtggtacaggggaaattgaaaccagggctatctgactccaaagcctccgtcctgcactctggtctacgtcagatgcttacatcttcctttagggtcagtatcactcccttagtctaacttactgcagttactctgggcatcagcttcagaatggagaccatactgattgatgtctacagaaggcttgcttttttccagtaaattcggtggtgtgctgactatggctaactgatcacacagttctccctctctccgcttgaggtttattgaatcaattttctctttggtttcattctctccgctatgtcatttgtggtataggagacgttgaagggtcttcaggtagaaatactcacttcctgtttgcagtccaacgtgaaaccacatctcctgatgtgctatactcctaataatgcaaatcagtcccttgggaggcagcatcttgtggacatttttctgtagattacattatttgttataccaagataaacactgtttctcttgcgttaagatcagatttatctgctatattagtaagttatacttactaatatagctatgaatgtatcagtagattttttattattggtaagcaggaaaggtaggaaataagaaatgaggtttctcagagcttcatgttctgggatgacactaaaaatttccttggtaaatgtaattccttggatgtggctctgaatagcttaccatcaaatatctaatttcaagcacacacacagaagtgttaaattaattgaatgtctggaagcttgagagccatggaagcacaggattgaagagtttagagctcaggtggtctaaccttcctcatgtagcacttcaatctgcattgcaacattcttaattggtataagcatacctcagagaccactgcgacaaagcaagtgtcacaataaagtgagtcacacaattttttttggtttctcagtgcatataaaagttatgtttatactagactatgtagtctattaagtgtgcaataaccctatatctaaaaaacaatatagatactttaattaaaaatactttattgctaagaagtgctaacaatcatcttagccttcagcaagtcataatctttttgctggtggagggttttgctgtaatgttgatggttactgctgatcggagtgatggttcctgaaggttgggtggctgtggcaatttcttaaaataagacaacaacgtagttgaaaacaacaattgactcttttttttctcaaaagatttctctgtagcatgtgagctatttgatagcgctttaccaacagcagaacttctttctaaattgaggtcaatcctctcaaaccttgctgcttttttgtcagctaaatttatgttatattctaaatgtttattgtcatttcaacaatgttcaagcatcttcactaggagtaaatttcatctcaataattttctttgctcatccatgagaagcaactcttcatccattcaagtttgatcatgaggttacagcaattcagtcacatctttaggctccatttctaattctagttctcttgctatttccaccacatctgcagttacttcctccactgaagtcctgaacccctcagaatcatctcatagatgacacctatgatgttattttgacctcctcttatgatttatgaatgtccttaatggtatcaagagtagtgaatcctttccagaaggttttcaatttactttgcccagatccatcagaggaatcactctctatggcagctgtagccttatgaagtatatttcttacataataagactttaaagtcagaattattccttgatccatgggctgcagaatgaatgctgtgttaatagctgtgaagacaacattcatctctttgtacatctccatcagagttcgtgggtgaccaggtatgttgtcaatgagcagtaatattttgaaaggaatcttttactgagccataggtctcaactgtaggcttgaaatattcagtaaaacttgatgtgaacagatgtgctgtcatccagctttgctgttccatttctagagcacagtcagaatagatttagcatatttcttaaggggcctagggtcttcagaatggtaaatgagcactggcctcaacttcaagtcaccagctgcattaacctctaacaagagagtcagcctgttctctgaagctttgaaggcaggcattgacttctcctctttagctatgaaagtcctaaatggcaacctcttcccatagaaggctgatttgcctacattgaaagtctgttgtttggtgtcgccaccttcatcaatgatcttagctagatcttgtggataacttaccccagcttctacatcagcacttactgctttatcttgtacttttatgttatggagatggcttctttccttaaatctcatgaatcaatctctactagtttcaaacttttcttctgcagcttcttcacctctcttaggcttcatagatttaaggagagttagggccttgctttggattaggctttggcttaagggaatgttatggctggtttgatgtctattcagaccactcaaactttctccatatcagcaataaggctgttttttttcttatcatttgtgtgtgtcttagtccttttgtgttgccataaaagaatacctgaggctgagtaattgataaagaaaagaggtttatttggctcatggttctgcaggctatacaagaagcacagtgccatctacttctggcaatgaacctcaagaaactttcactcatggcagaagatgaaggggagcaggcatcacatggccagagagaaagaaagggagagagaggaggaggtgccaggctcttttcaacaaccagagctcatgggaactaagagtgagcagtcactcaattctgcaagaatgacaccaagtcattcatgaaggatctgcttccatgaaccaaacatctcccactaggcccacctccaactgtgaggatcaaattttaacatgcgatttagagaggacaaatatccacactgtatcagtgtgtttactggagtagcacttttttttttttttttttttttttgagacggagtcttgctctgtcacccaggctggagtgcaatggcgcaatctcagctcactgcaacctctgcctcccgggttaaagtgattctcctgtctcagcctcctgagtagctgggactacaggcgcctgccaccacgcctggctaatttttgtatttttagtagagatggggtttcaccatactggtcagcctagtcttgaactcctgacctcaggtgatccacccaccttggcctcccaaagtgctgggattacaggcgtgagccaccgtgcctggcctggagtagcacttttaatttccttcaagaacgcttcctttctattcccagcttggctaattggagtaagaggcccaatttttggccgatctcagatttcaacatgcctttcttactaagcttagtcatttccatcttttgagttaaaatgagagaagtgcgactcttcgcttttttttatttgagatggaagtctcattctgtcacctaggctggagtgcagtggcgtgatgttggctcactacaacctctgcctcccaggttcaggtgattctcctgcctcagccttccaagtagctgggactacaggcatgagccatcacgtccagctaatttttgtattttcagtagagatggggtttcgccatgttggccaggctggtcttgaactcctgacttcaggtgatccacccagtttggcctcccaaagtgctgggattacaggcgtgagccactatgcccagcctgactcttcctttcatttgaaaacttagaggccattgtaaggttattaactggcttaatgtgaatattgttgtgtctcaggaaatagggaggcccaaggagaggaagtggggtcagccagttagtggaaaagtcagaacgtacacatgtatcatttaagttcactgacttattatgggagtggtttgtggcaccccaaacactgcaatagtaacatcaaagatctccgatcacagatcaccataacagatatcatagtaatgaaaatgtttgaaatattgctagtattgccgaaatgtgacacagggacacaaagtgagcgtgtgctgtcagaaaaatgacgctgatagacttgctcaatgcagggttaccacaaaccttcaatttgtaaaaaactaaaatatctgcgaagagcaataaagtaagtgcaataaagtgagatgtgcctgtagttagccaatttccggccatcttcggtgactgggaatccactccctactggacagtgtctttacacagctgtaatcattgtaaagttttccctttcttctttattttgattatttattatttttaattttttttctcagacctcacagggaagagtttttcctttcttagaaaggaatgcttaagtgaatgatgacacattctcatgatgaattcttaatgcagccattaaaatgttaattaagaatttcaaacggcatgagaataattaggtaaaaacaaagacatgaaattgcatgtataatatttcaactatattttaacaatacacaaaaacaaattatttaaaaatattaatggcttttgcctctgggtggtgggatcacaggggattgttttttgcctgtttatactttttgtggttaaaagaaatttcatggggatatcttactttataattataggaactggggaaaacattttcctttcataaatatggaatttcttctctgatttatacctgttggttctcaatataggctccgagggtaactcagaacaaatccttttgttctcccatataatagcctttcaaaaagtttaaaggcagattacgtgtttaagcacggctgtttatagatgggcaaacagaaattgttttctttttaaaaatttagacagtaaaaatctgaaacagtcaggatgtttccatttctgtgagaatggtactgtactgttatgtaaatactatgttttccctcttctcttccaaaataaaccatcgaaagaaaacaaatttatcaccctaggcttggtggttttattgaattcaacattttatgaaactggatttagtaaaatcagtttgagttttctgagagtgtccctgaggtccttggtaaacttgcactcttggtttaagggaatgatcaggacaaaaagaggaactcctgggaaggatgggagcattgggcaaatcaggtgggttgtggagagcctggagggactttaacatgggacagtactcagattcccctgctctcttgtacattgacactgaccttatttagagtcaccatattaaagagatgttgacctctccaatgcaaaaatggtattactctataactatgtagtgtagagtcagcatccctggagtttagggcataggtaaccaatcttcaacagaaagctgaaaaaagtttgaaaaagcatatatctgtacatgaattccctgtaatacctcaatgttacctaccaagattatctcactgtctaatcttaagtcaactcaaaatggtgaaagaatttttctggggaatgactctttgtagatttttacagtactttttgtcttaattctttttcctactaaactttgaaactcttagcaatagttttggggtaagtaaatgttatccataaatttttattgattaacctgataaaagaattatataaaaattaaaaataccaatcgaaaaatttaattcaataatgaaagtagattatttcaaacagaggcaaatacagctatcaattacatattttaaatgggatttttacaaataatctggaagttggtatcataaacagttatgctgcttaggcagagcagtagatgtgaacacttccttgcatctgaaacaaggcttattcttgatctgtttctttgtttccagatggtctcccagcttgaagcccaaatatctgagcttgttgaacagttgggaaaggagtctgggtttcaccagaaagctctccagagggcccagaaagcagagaatatgttggagactcttcagggtcagctgacacacctggaggcagagctggtttctggaggtgttttgcgagacaacttgaattttgagaaacaaaaagtaatgacccgagggcatgtccatgagtggaagcatctgttgtagtataaaattttacctgaaaatatcctgaattttacagtatttagtttggttaagtcctggacttaattggttaagtcaatttcaaggaacaatgggtttggagcttccttgattcaaattaatttaattaaactcaacgagtatttattgaatgcctaccatatatgaggtcctaaaggtttggcaagctaaaatatgaataatacacagttcctgatcttaaaggctcataattcaataggggagacagatactcagataatttgctgtactataagtttacacatgttatatgtattgaattaataaagtgctgtaggaacttccagataaagggaagattttataggagaggagataattaagttcatttttgaaagataagtcagattatagtggagacaggagacagatactgtaggggaaacagtttgaagaaaggcatgaaatctggcaagtgcatagtatattcagaggacgcaaaatggtgaatcctccatggctggaacatgttattctcggtggatctgtggcaagagaaaagactggaatggcttagactatgaagatggagtgttctttactctgtagaatatgaagtgtggtaagtgtgagcattgcagtattttattttattttatgtttatgtttattatttctatttttttgagacagagtctcgctctgttgcccaggctggagtgcagtggcgtgatctcgactcactgcaacctctgcctcctgggttcacaccattctcctgcctcagcctcccaagtagctgagattacaggcgcccgccaccacgcccggctaattttttgtatttttagtagagacggggtatcactgtgttagctggggtggtctcgatctcctgacctcatgatctgcccgcctcggcctcccaaagtgctgggattacaggtgtgagccaccgtgccaggccacattgcagtattttagaaagatagcgtgatgtccccgtggagctgagattgtggcatggagggtctcggaaacaatggcactgataacccagtgggagaggagagttagacgggaagagaaggagcccgcactgaggattcgaatgtggggagactgtcagtgatctttgagaggcagttttggtggagcggtggagagcaaaagccagtttgtttgtgctgaggggatccttgagaggaaggggagcgaccttctagtagaccagtgtgaagtctggtgaccaaagagaagagaggcatgaggcagtggctgtgaaaaacaagatcaaagaaaggttttgctggacaggatggcggggaaagtatggactgaaagagtctgcaggagggagtgtgggaagggaaagggaggcacacaggcccaagagcctcgatgccaaatttggcatgaaaaatgccctaaagttgaaacatgtacactcaagtaacatattccttttcattcttctgtacttaaaacattgaggaatcatcatgcctgcattgaggttggatatgcaaagatgtgccaaaggtgtctgtggaaaatcaagtctagcagatgagacagggagatcggggcgtaatagtacaatagtgcaattagtgcgcttagtgcaatagtacaatggtgcaatagtgcaattagtgcaaatagtacaattagtgccatgatggagacaggtataaaatttaacagaaacctggaaaaaggagcaatgactttttttctgtgtggtaagtgagccatcttcacagaagaggggagcattaaagaatgagtaggaatttgtcaggcagaagaggtgggaaggaatttgaggcagaaagaatagcaggaacaaagaagaaatggaggtgtgaaaagaaggctcaggaaatgaatgaggtgcagggagcctgggacatgatacttggcgaaaccaaaggtgtgagatggcactggaggcagctataggaatgatcgagatgggtcagtctaatgactcaggcttcactgcgtaggtaatgggaagccagagaaggtttttgagtaaaagaaagatttccctcaagtcagactcgcttagagggtagcaggggtgtccaaccttttggcttccctgggccacattggaagaagaagaattgtcttgggccacacgtaaaatacactaacagtagtgatagctgataagctaaaacaaacaaacaacaacaaaaacacacacacacacaaaacaaacaaaaaacaaccatgcataatttttgaggtatctgccaccacagataagcaaaaagtcctcgccttccaagggttggacacagctgagggaaggtagggagcccagttggtggctccctgactggtccagttagatagtccagttcagactagcccagttcagaagataataaagatctgaaccaagtagtggttttgtgaatggaaataggggatagatttgagaagtctgggagagtgaagggagctttttctgttagatgtctgtaaaggtgtgatggtggaaaatttgattttgtaaagaaatattggctgggtttggtggctcacacctataatcccagcactttgggatgttgaggcaggtggatcgcttgagctctggagttcaagaccagcctgggcaacatggtgaaaccccatctctacaaaaaacacaaaatttagctgggcatggtggcacacacttgtgatcccagctacctgggaggctgagatgggaggatagcttgagcctgggaggtggaggttgcagtgagctgagatcataccacttcagcctaggtgacagagtgagaccccgtctcaaaacaaacaaacaaacaaacaaaaaaccaaaaacaggccagatgtggtggctcatgcctataatctcagcactttaggaggctgaggtgggtggatcacttgaggtcagaagttcaagaacagcctggccaacatggtgaaactccatctctactaaaaatacaaaaaattagccaggtgtggtggtgtgtgcctgtaatcccagctacccaggaagctgaggcaggagaatcgcttgaatttgagaggcagaggttgcagtgagccaagattgcgccattgtactccagcctgggtgacagagactccctctcaaaacaaacaaacaaacaaacaaacaaacacaataaaacaaccacgaccaaacaaaatgaaatattgcacctgagtatggtaatgtaaattggaagccatctaactgcctgctggacagcttcacctgcatggtccgtgaacaccaaaatacactcaaaactgaaatgacatctgctcaaatttgtccctctcctgcttcagtcatggtggtaatctgcctccatttgcccaagccatcttcaacacttccctctttttaatcaattcctaagcactgtaaatcctgtctccttactagatctccaatgcctcccccatctctatatccagcagctgtgctttggctctgagaattgtgctcattaacacggactagggaaacaacctactaactgagctcccagcattgttctttgtgcctcagatttactctcttcattgctgccagggaggtcttaatgaaaggtatgcctaatcttatctttctttatcttaaaactggtcagtggttctctggtgcccccaggatcaggtacagattccttctttttccatggccccacgttctgtgagctggccaggtggcctctccatcttccctctcccctgcaatttctcctgccagcaggggcaaactcagaagccttctgggagtggcaggaccctggtggggtctgcggtgattacggagcctaaagacatccatgcagatttgtagcagcactcgtctggcgtcctccagctgcctcctacattgcccactgctattttcaccgagagaatgttctccttacctccttcacctggcagcagcaatctcttcgagattcagctcaaataccacttcctctggcagtcttccctaagagacttacctatctttccttttgctctccaagcaacatgcatctgcctctctcatggtactttttaccattattggattgtttttaaattttttcttctccaaatataccaagcttcttaaggccagaaaaaatcattttttcctgtatttctccagggcctagagaaagagtcaataaatattatttgaattatagaagaaatatattaaaggcaagaatttcaggtggattggtatttcttcccttcccttactataaatgaatcattaattttaattgggattatgttcaaataactctcagttatgaaagcaaattatgtaagctaactctgtccgtcgtgaattttccgtcgctaactgcatatgaaatgcacgttctggtaaggatggatagtatcatgtaaattgaaaagcaaagttgcacagagtttaaatgctaaatgcaggtaatctggcagactcaaagacagtagaatgcagtttcttatttatgctgaactgtgattcaaatgaacaatatatacagtaatccttcatttctatgaagttaaaagtttctagtaaccttaatcttttgaaatagagacaaaatccttgaaatagaaactttctctttggggtctcggcttgctcttgtcttaatccctttttgcctgttgtagtcctggcctagtaaatggatgggtcatatgtagaaatagaaagaaagagggtttcataccgtcatgtaataggtacttatctattttatgtaaaatacaagcaatagcagttaggtcactttcatggacacaggttaaaaattaaaaattccagatagctgatacagcattaaacagtgataacctgaggatgtagagacaaaagcagtttatggtattgtagcacaatgcaataagtgatatttgcaatgactgtgacttataaagaagagataaaattgtattcatatgtatgctatttgccaaaattggaaaatatacacttataaataatttcatcctgataattaaaacatagctagttctgggctttaatctggtgtgcttcagttggcaggaagttgtacctatttaaacatttaattgcctgaataagccagatggataagttattgcaatcagaagaaaatatcaaagataaaacccaaatcataaaatgatgatatagaaagctcattgattgatttattcatccagcaagcacttagtaagcattgtcctatgtgtggacttgccagataaaccacggaaatcaagcagaggaaaacctttaaatagctttctaactgtagactgctaaaatatgaatcttgacttcctttatacagcgctgttttaggggggaggtgttcatttaacttggatgcattaaacaattttttttttttgaggcggagtcttgctctgtcgcccaggctggagtgcggtggtgcaatctcggcttactataagctccgcctcccaggttcacaccattctcctgcctcagcctcccaagtagctgggactacaggtgcccgccaccacgcccagctaatttttttgtatttttagtagagacggggtttcactgtgttagccagcatggtctccatctcctgaccttgtgatctgccctcctcggcctcccaaagtgctgggattacaggcatgagccaccgcacctggccctgcattaaaaaattttaaagaaattttctaaaatatcttaattaataaaaaagaccccaaaatgttgttcgaaattttgtttgtatggtgagctttgagtttggagtgctctgtagagcccaagaagagtaaagtggcaactggctaagttgccagtgacaaccggctaagttgccagtgacaacctttgaggccagggcccagttaggtgggaaaaattcccaaggaaggtgcatgggtgggtgtgttagtccattttcacactgctgacaaagacataggctgggcacggtggctcatgcctgtaatcctagcactttgggaggccaagatgggtggatcacctgaggtcaggagtttgagaccagcctggccaatatggtgaaaccccgtctctgctaaaaatacaaaaaaattagccaggcatggtggcacgtgcctgtaatcccagctacctgggaggctgaggcaggagaattgccggaacctgggaggcggaggctgcagtgagccaagatcaagccactgtactccagcctgggtgacagaggaagactctgtctcaaaataaataaataaataaacaaataaataaataagacatacctgaggctgggtaatttataaagaaaaagaggtttaatggactcacagttccacgtggcttgggaggcctcacaatcatggtggaagagtaagggatgtcttacatggtggcaggcaaagagagagaacgagagccaagcaaaaggggttttccccttataaaaccatcagacgtcgtgagacttactcactaccatgagaacagtatgcgggaaactgcccccatgattcaattatcttccactaggtccctcccacaacatgtgggaattatgggagctacaattcaggatgagatatgagtggtgacacagccaaaccatatcaatgggtggatcccaggggctagattagcctgagaggggcatggttgcagcaacaagttgtcgaagcagagagatgaagatgtcatcaaacatagccaaatgtgttgtttggcagagttaagaaaagtatataatattcgattgaacatgaacatcaagggctaggagagtcaagagcattcagacaaggggtaggcagggaactggcagggtggttcaggaatttattaccacatatgggtcagagtccgtgctccgttccatgctctctgcaaaggagaattacctgtaagcttgggagaaagaggaagagattctgtgagatcactcattaactttgactttcatgtcccatttttgtttctgttcttgggtttagtatcttaaatttctggatcagctttctcagaaaatgaagttggaccagatggctgccgaacttggctttgacatgcggctggacgtggttttagctcgaacagagcagctggttcgtcttgagagcaatgcagtcattgagaacaagaccattgcccacaatttgcagagaaaggtaggagatattgaaacttgctagtattgagagaagaaatttctgaaaaacccaaacattgaaaaataatgtactgccaccatgtttaccagtgtagctaggaaggctcttataaaaatatgtatttagaattggaggctcaatttcaagtctgaagagttggtaagtgtatctgtcacctaaggttgtgtttcactgtgtgtaatgggtacccacaatggcagtgacttaagcaagtaaaagttttttgttgttgttgtttgtttgttttttctcacacaaattcctggagacaggaagtttggggctggtgtggcaactctcctctgtaaagtcttcaaggaaccaggctcatttcagctgattcacttcccatccctagggtgatccttattctcatggttccaaatggtgcccagaaccattatatatctgtgtttgagatagaagagaagaaaggagtgaggaatagggctgcaaaagaacaagcagaggcatctttaaaaaaggcactcagaatttgctacatgaacttttgtttatatcccatggccagaatatgttttggtggtcaaacctagctgcaagggaggcttgcaaatgtaggctttactctgggtagccatttacctagctagaaaaaaattcacagtttctattactttgggagaagaggagaactggggggacatttagcagcctctgcatttgtaaactcagctgcactagaaattctagcagagagagaagggcttacttttcttcactcaaaggaagagttagaaacagtttatactaaatcaatgaatgaatagatgaaaggtataaaatataattattagttacataattattggtattggggaaagaaataggaaaacacagatgtattcttataatagttcttaggagagaaatgctatgatacaattccagtgtagatgctgtataatgagtcacatctgggctcccaattcggttccatcaagctgtgtgaccttgaacagattatatacctctctgtctctgtttcctcatatttaagatggggatgctatataccccaaggagttgttagtttttaataaataacattttcaaacccttggctcacagaatatgctgtattcatgtttggcttcttctccactaccatatcttgaggaatattttataaaagatagcatacaaaccctattaccattagagacattaaattcagctaccattctttccaaagttctgctcagataattgattctttttctcagtgtccaacaccattacttcttaataattatataattattaaacttaccagtttatagaatttaccagtgtaaaattgcaatggagtggaattttcttttcttttcttttttttttttgagacagagtttcactcttgtcgcccaggctggagtgcaatggtgcgatctcggctcactgcaacctctgcctcccgggttcaggtgattctcctgcctcagcctcccaagtatctgggattacaggcacctgcaaccatgcctggctaattttgtatttttagtagagacagggtttctccatattggtcaggctggtcttgaactcctgacctcaggtgatccacccgccttggcctcccaaagtgctggaattacaggcatgagccaccatgcccagcctggagtggaatttgacatgaagaagcttaagaaagggaatttgattagataaatattaaaaaggtcttgttcaaaaatgatctgggtatggacacagctgtcactgttaggcaggatactcaaagcagcatttcagtaagtctttccacctgttaccactttacaagtgcagagtagataattaggggaactttgatggtcttcagcttgaacacttgataatatatgattctgattctgatgtttatagcagatgacagaggtttctgtacttaatattccatctactaattgtgacatgtggagcctaggaagcttcttccccctctagagtccatagtcattttcttaaatatcactctaatttccttttttaggtttggttaccaatgataaatgatgtttgaggagctatcctctgcttagtttgtggaccttacaggccagacatataataaagaccaagaaaccttcttacagtcccttttatttctaagattttatatgtataagcaaagctttaaagcaaagcttacttaaaaatctccttggtatatcttactttaaaaatatatcaactctcagccaggtgtggtggcttacacctgtaatcccagcacttttggaggctgaggcaggtggacctcttgaacccaggagttcaaggccagccaaggcaacatgatgaaaccctgtctttacaaaaaaatacaaaaatcagctgggtgtggtggcatgcatcacaagtcccagctacttgggcggctgagaggtggaaggattgcttgagcctgaaagggagaggctgcagtgagctgtgatcatgccactacaccccagcctgcacaatagaatgagaccctgtctcaaaaaaaaaagttgatatatatccactctcatgttgggggccacgtgttccagttctaagggattgaaatgagccagtctaggtttacagtactcacttgcattgtatcttatttcagaaaatgccagtgcagatattgtggccgttagatgttggacaggattttgtctctctgtcttattacattctgctctgataaactcatctgaggagttttttaaaagtaattttacatttttatgatgatgcacataatgttagagagcatcagatgtggaaagctgactcctgcacattttctggggctcttttgtctcagattttaggtatgcaattaattcttggaaagggtatgagtaaaaaatgcaatcaggaaaaggaatccaatgacttttttgatggtttacaaattactcttattgaggtgtagatagagatcaacattatctgggtaactcatttatatttactattgttcaattattaaaaaaaaaatccctgtttgcatcaaaccagctaaagacacagaaagagagactggagagcaaagaattacacatgagcctcctccggcagaaaatagcccagctggaggaggagaagcaggcacgcacggccttggtggttgagagggacaacgcgcatcttaccatcaggaacttgcagaagaaggtggagaggctgcagaaagagctgaacacgtgtcgagacttgcacaccgagctcaaagccaaactggccgacaccaatgaactgaaggcaagtgcttggcttcattttgttgttgctttttgctggttactgtcaatgttttatgcaaaagaatgacagctttatcgggacacgccagaagaagaaagatgaaagcctcctctgattttctagaattatgggaaaaatgcaaaaatgacacaaatcagggtacatatccattcagtgtctcttcaatatctgaagtgaagccatcattgctaggtgaaaagtcagtcaaaaagtggtgatgtttccttttttaaaatttttttgaggaggagtttcgctcttgttgcccaggctagagtgcaatgacgtgatcttggctcaccacaacctcctcttcctgggttcaagcgattctcttgcctcagcctcctgagtagccaggattacaggcatgcgccaccacgcctggctaattttgtatttttagtggagattgggtttctccatgttggtcaggttggtctcgaactcctgatctcaggtgatccgcccgccttggcctcccaaagtgctgggattacaggcgtgagccactgcgcctggccttataaaaaattttttcgagactgagtctcgctctgttgtccaggctagagtgcagtggcatgatcttgactcactcactgcaaactctgcctgggttcaagtgattctcctgcttcagcctcccaagtagttgggattacaggtgtgcaccaccatgccatgctaatttttttgtatttttagtagagacagggtttcaccatgttggccagactggtccccaacttctgacctcaagtgatccacctgcctcagcctcctgaagtgctgggattacaagtgtgagccactgcgcctggccaaaaagtggtgatgttttaagtccagaaaagaaatacatttctccaaagtgttggtgactgctattagtgatgatgcagggattaatcacattggaatttgcttaggaagaaatgagaaaatgggcacaactgtttgctgaaaagagtcaggcaggcaagggtatttacgttgtgctctgtaggatacatcattaccaagtccagtggagaaggtcaccagaactggggagacagttcctatattcaaggtgttcaacttctaacgaaggcagagcaaaaagaaatggaaacttacaagaatttaatcaaaagatttacgtgtcatgcatgtgtgccactggcaataatatgtaacttaatatgcacacatcatcctcagcaggtgtgcaaatcgcaagtacagtggacaataacatcctggctctttgcagacaatgctctgaaactgctttttggaaggtttccgaatctggaaacagacaagcagggaaaaagaatctggaattaagccagcccttgaacatgtgtagtggggaccatgttttagaacatattttccactgtagtttcccttctgggtagttttcttttccctgctgaagcccttctgccattggggctagactgccaagttgaagtgtacttccttggagaaggggagaacgggcaccccccagagaaggacacatctgaatacaaggaaggggggaagcaagggaaagcatctgaggtggtgccatgggtggggaggaaatatcagaggtaaatcccctcaacagtccctttgcaacttgagactgacctttagtggggatttggaatagggtggaatagcatcagctgctctaatcctggctggaagaggctgcaaatggtgatgaatcttgggggcctagattgcacctcaattccctggagcctggagttccattttcactagtgagggatatggatgacagctgaaacgcaagctggagagctcattacaggagcagatgggggtgttcggttcaactgagggacaaagtgaccctccatcagaggccctggggtcatcacctaggctgtggcccaatagcagctacagccgagccttgaattagctgagaccaatgatgtggccttgactctggtgagagaccgtcacaaatttcacaagtcaaataatagatataggagagattcaggggcagcatgagggccagaatcactttttctaaaatcacaaggactttcctccacccagttatcatctcagaaagaaggaggggagagaagaatcccctaaagatggcattgtatgaataaaaacaaattttaaacccaaagaaatgcagttagctgcaaataccatctgctctaaccatttggggtgacggtagtggggagtttgtttcctgtatccaaaggactatgcagattatcctaaagttaatgtggctgggacattgcaccagctgctcctgattgtaggatgtgcgggtgttcatccctaggccagaggcactcatcccctctgacatctttgcttataaggatacaggagtactactttgttagagagaataaagggcctttggacacttccaaagaagctagaaaagaaaagttaaagaaatggaaaccagtggtaagacagctaatagttggagaatgtcattgaacaaaataggaaaaggaacctcaccattatagccaatgtgtgatgcacacctttgaaaaggaaacaaaatttggggctttagagaacaataaggagaatttgcagacctgatctaacacttttgaagaatttctcttacccatagggaggtgctttcatgtagacaaggatatggcaaaatcagagctgtacagtgtttcttgaactcagactgaaaaatcaaacagtcttctgtctttgccaagactttataaacatagattacctcctagtgctgtcatggtatttggtacaacattgcttctgatcaaacaacagttgtttggagtagaggatgaggatgagtgacagtcaatgcaataataggtgaataggaggtctggttggctgctgctgatgccttgacaatgtctgggagttggggaggggaagaagctgagcagtggacaggggctggatcacatggagccttatgtgtcacactaagatgtttggacttatcctctgggtcctgaggagccattggaggataaaattgtcaggaacgagactgagaagaaacagagagagagatagagagagagcagaatgaggctgtggtcaactataccaagtacagcagtgcgataatgactgaaggagtgtccactatacttggctttggaaaatctgtgagtcaagcatgtgcggatcatggtggtagtgggtgagggttctgagaataagtcagatttcagggatgaaagagaaatgaaaacaaagacagtgcaatacccttccgggatacttggatgaaaagaagagagttaggaaagtaaataaagttggcttgcgtatttacttggttgccttattttgaatagacagatccacatacttttacagataagataataggaaaggtataggagagacttggtttgactgactcaagaattactcgggcccctacacatttcaaaggaatgttaagtcttccttccagtgtagaacagagatctctctaacttgttaacacagtaagtgtcaacttcatgcatttatgagatatcaaatacagaatagatttttgttttgtatttgatacaaatccaaaatatcagacttctgaaatcaatttccaagacagattaccggtatcagctatccaccattgtacattgccttaagcttgtccctgtattaatttcactattcataaagcaatatttctgaacattagcaaaaatagctttactgtattagtttcttagggctacccaactaccacaaactgggtggcttaatactcaatcccgctaacagtccttggtttatagctgcataattccaatctgtgcctccccttcacgtgacctccccctgtgtgtctcttcttttctgtctcttataaggacacccattgttggtgttagggcccatcctaattcaaaatgatctcatcatgagactcttaccttaatcattacctgcaaaggcccttatctaaataaggtcacattccgaggttctgggtggacacagcttttgggaaggcactactcaaaccactacacttattaaattaacaattttaccactcttagagggacaatataaaataataatttgaattacatttctatggtttttttttaaatgagaaatatttacatgccataaagtttattttttaaagtgtataattgaatggtttttagtatattgacaaggttgtacaaacatcaccgctatctaataccaggactttgcatcactcctcccacatcctcccccaaaatcccacacccatccacagtcattcttcatttaccctttcttcaacttctggtaaccagtcatctttctgtctttataaatttgtccattctgtaaattgtatataaatggaaccatataatacgtggcctttgtctctggctttttgtattagtctgttttcctgctgctgataaagacatacccgagactgggcaatttccaaaagaaagaggtttaatggatttacagttccacatggctgggaaggcctcataatcatggcagaaggttaaaggcacttcttacatggcggtggcaagagagaatgagagccaagtgacaggggttttcccttataaaaccatcagatcttgtaaaacttattcactatcatgagaaaagttgggggataccacccccatgattcagttatctccaactgggtccctctcacaacatatgggaattatgggagctacaattcaagatggcatttgggtggtgacacagccaaaccatatcacttcttttacttagtatgagtatacttaatattttcaaggttcatcccatgttgtaccatggatcagtacttcattcctgtattggtcagtgttctccagaaaaacagaagcaattggtcagtgttctccagaaaaacagtgcgtgtgtgtgtgtgtgtatgtgtgtttgtgtgtgtatacagacagatatatgtagatataaatatctacatcggtctatcaatcatctctctatctatatagagagatttattttaaagaattggctcatgcaattatggagactagcaggatgggctgacagactggagacccaggtagagctgatattgtagtaaaaatatgaagactggcagattatccttgtgttgagggaagctcattgtcttgtgctgcttatgccttcaactgattggatgaagcttacccacattatggagggcactctgctttatgcaaagtctacccatttaaatatttgaccaagtatctgggcatgattgcccagccaagttgatacataaaattaaccatcataattcctttttatggatgaggaatatttcattgtatggatataccacattttggttgtccattcagcatttgatgagcatttagattgtttccacttttggctattctgaacaaggctgctatgaacatttgggtcaaagcttttgtactcgtttctatgtctgtttcaaaaccatgattgaagaccttgatgcctaggttatataaatcttctgttttaagacccaggctgtaaatttactcctgaattctagaccaagaaaaagtagacctttccagatactattacattttaatttggcaggcaaacataagtataatagaaatcctttttgcaagtaaaatgttttttcacgaattcccctacctgtattgagttaaaataattttattatatttacaatatacaaacttaaaactacatagaaatttcttaatcttattatgtttcttaatattatgaaatccatatcagttcaaaaatcaaaacaaaggataaaatagaattttaaaaattagggatattaattcaatgtgatagattattttactaaaatcaccattgatatggtttggctctgtgtccctacccaaatgtcatcttgaattgtaatccccatgtattgagggagggaggtgattggatcataggagcggttttccccttgctgttctcatgatagtgagttctcatgagatctgattgttttataagtgtttgacagttccttcttcacatgctctcactcttgcctgccaccatgtaagacatgcctgcttccccttctgccatgattgtaagtttcctgaggtctccccggcgatgcagaactgtgagtcaattaaatttatttctgttataaattacccagtctcagatatttctttctttttttttttttttgagatggagttccgctcttgttgcccaggttggagtgcaatggcacaatctcggctcactgcaacctccacctcccaggttcaagcgattctcctgcttcagcctcttgagttgctgggattacaggcgtgtgccaccatgcccggctagtttttttatttttagtagagatggggtttcaccatgttggccaggctggtcgtgaactcctgacctcaggtgatccaccctcctcggcctcctaaagtgctgggattacaggcgtgagacaacatgcccagctgggtatttctttatagcatggactatatactatccattaatggactaatacatccattaataagaatgtgtggtaccaactgctcatgatgcaagttcttttgagtttggcatgtttaaagtttattatcttttgagtttggcatgtttaaagtttattatcttttgagtttggcatgtttaaagtttgttttccctaagggtataggagttattgtaccatgtgttttattttaatactgcagatactttatttgtacctatgccatgacatagtttggctttcactttgcatgaacacattatttatgtattaactctgcctttaccattttcttattagcccaggataactactaattggcacaaacatagccttatacacaaatgcaaatgccaagtactgaaatcatggggcagaatggcagaagatgaagaaagtgctttgtgtaatttatatcatgctaggtgctttatggcctgcatcagttatcattagtttcagctcaatatattgaaacaccccatgatatcagtggcttagagaggagaggcatttattcccttctcactggaaagaagcacctggtgacctcagttttcaaccttctgcttcagtatcctagcaatagctttagtcctcaatgccatcttttaggccaagctagctgctggggctccagcttcactctagtcatcaggaaggagggacagtggaaggacaccctgtgtgctgctttccaggaatgatacaacacttcttatgtctccattggccagaacttagtaacttagtccctggacctcatttaagtgaagtcggtctgagaaatgggtctttattctgtacagtaagaaataaagtaagaatagctatttggtggagagccatcagctatcagcctatatcatgtggcccaaccttagtaaggagctatggccgaagatcagcagtcagacaaccaaaaactagtggaaagctcattatcttcattgcactctttcaaggaaacaccaaaagggattaacattcttcagccacctgtgaagttctctcccactttctaactctctttatatctcccacacaagacagcctctccccacattccttccccactccagaactttctccaacccaacgagtatagcctttcttaatttttttcccctgagctcccatctcatactcagctccgatgatgtagatccattggatttctgggactgctttgagcttttcccacttctgaacgtatacagcaagcagatctccagcaagaggcatgctcctgggggtcagatggtgaaggagtggaggggtgtgtccttattaggagctgagaaaggtgtgttggttaatggctacaacattacagctggataggaggaataggttttagtgttctataacactgtaggatgactatagttaacaatactttattgtatatcttcgaatagctagaaaagaggattttgaatgtttccaacacaaagaaatggtaaatgtttgaggcgatggataatgctaattgccctgatttcgacacgtgctcttacggtagggaaggaggggaagtgagcccagactgcaaatctgaacattcatctttgatttctgctacattcctgcttagttacacctttttctttcatttttagtttcacataacaactgtacatatttttgggatacagagtgatattttgatgcatgtatacaatggataatgaacaaatcaaggtaattagtgtatccatcacctcaaatattttatcatttattttagttggaaacattcaaaatcttctcttctagctatttgaaaacgtacaataaattgttgttaactagaatcaccctatagtgctttagaacgctaaaacttattccttctatccagctgtaattctgtatccattaaccaaccttttcctgtgccctgcccccacccttcccagcctctaataaccacaattctactctctgcatctatgcactcaacttttttagcttttacatatgagtgagaatatgtggtatttatctttctgtacctggcttatttcactttacataatgtcctctagactcatccatgttgctgtgaatgacaggatttcatgctttattatggtagaatagtattgatacatggattgaggatgcctcaagcctgtgtttgcctcagctctagtcaatgattggagcattgcctatcccaaatgggaaatgtcgcaaaggggatattctggcagtgtgggaggctagcaagggttcatgcccaggagatgtatggaacatacctcctacagtgtggtcctgctgaacagatgccattctgatttggcatttccttcagtcaggttaaagagctgtctcccctgtttgtctctggctgtcctctgatatatttttcccttcaggcactcaaagtagctgctttctgtgggttgaggcagaaactgtcctcttaccagggaacttaagatgttggggaagttggttgttcaccttgatcttactttttccattgtagaaaccatgagtctggggaggttttctgcacttgtggtgctgggaaggttgaggggaggggcattgtggctatggaagtctgattttcttactctctgtttagagttttttcacttctctctggctccaggaactgtctcatctttatatttgagttctgggctattgctggtgataatcttggtgctgtgtatttgtttttgtttttgtatatcttggggttccgggggacagtgccaccagcttgcttctatgccgccatttttttttttttttttgagacagagtcttactctgttgtccaggctggagtgcaatggcgtgatctcagctcactgcaacctctgcctcccgggttcaagcaattcttcttactcagccacccaagtagctgggattacaggtacgtgccattacgcctggctaacttttgtatttttagtagagacggggtttcagcattttggccagcatggtctcgaactcctgacttcaggtgatccacccacctgtgctgcccaagctgttgggattacaggcgtgagccactgcacctggcctatgccaccattttgaaaacaaaaacctttttatcattttgatgtaggcattattgctataaacttttctcttagtactgcttttgctgtatttcacgggttttaatatgttgtgcttctattttcatttgtttcaagaattttttggattttcttcttaatttcttccttgactccatttgtcattcaggtgcatgttgtttaatttccatgtatttgtagaatttccaaagtttctcttgtgattgatttctaattttagtccactgtggtctaaaaagatacttggtatgatttctattttaaaaaattcgttgagacttgttttgtgtctaacgtatggtttatcatggagaatattccatgtgctgatgagaagagcatgtattctgcagtagttgaatgaaatattctgtaaatgttaattaggtcaaattgttccatagtatagtttatgtccaagaattctttgttgatttttctgtctacaggatctgtgcaatactgagtgtgaggtgttgaagtcctcaactattattataatggaatttatctctcttgttatctctaacaatatttgctttatgtatctgggtgtgttggatacatatatatttacaattgttatatcctcttattgaattgttcttttcatcattatataatcacctttttcatctttttcttacttaaaatttagcttgttttctaagtatagctagttctgcttgattttggcttttgtttgctgaaattatctttttctatctgttcacattcagtctatgtgtctttacaggtgaagttgatttcttataggcagcatatagttgagtttttaaaaaaaatccatttagccactaattggagagcttagaccatttacattcaatgttattactgataagtaagatcttgttattgccattttgttgtttgtttgtggtggcatcagtagagcaggcatttgagacagaaaaatatcccctactaagtgtgggtctacgggggttgaccttggagagaaatgtattttcagtctatattttttaattgaggaatttaaactatttacattcaaggttgttattcataagtgaggacttactcctttcattttggtaattgttttctggtttttaatatatcatttgttccttttttcctctcttattgtttatcttcgcagtttgcagtttggtgatttttgtagtgataacatttgattcctttctctttcccatttgtgtatctgctttaatagtgagttttaactttcatgtgttttcattctggtaaatatctttttgcttctagatgtaggactcaaacatttcttcttgcgcttgtctaagggtgttgagttccctcagtttttgcttgtctgggaaaaagaataactttgttggctgtgtattgttgataggcattttttttttcccttttagcactttgaatcccattctctcctaacctgtaaggtttctcttgagaaatccactgttaatctgatggaagttcacttatatgtgactttatgcttttcttttgctgtttttagaattctctttttgtctttgacttttgacttttagactataatgtgcctgagagaggttttttgggttgaaactgtttggggatctttgagcttcctgtctctgtctgtctatatctctcacaagacttgggacattttcaactagtatttcattgaataggattttaatgtgttttccatcccttttccttctgtaacttccagtaatgcaaatatttgttcacttaatggtgtacctatgccacatagactttcttcattattttttcttttttggactgggttatttcaagagacctgttttcaggtttagaaattatttcttctgcatgatctagtctattgttgaagctctcaataatgtttttaattttattaattgaattcttcagttccaagacttaaccttggttctttttcttatatttatttctttgctgactttcttattcagatcatgattttttcttatttcattgaattatctcttttatttcattgagtttccttaagatcatgatttgaattctttgtcaagcatttcatagaggtccttttctttgggatttgttactgaagttttattgtgttcctgtggaggtgtacttgcttttttcatgtgtcttgtgtccctacatttgtatctgtacatctgttgaaacaaacacttcttccaattttatgaaaccgcttttgtagggaaagactttttcctgtagatatggcctatattgttgattgggtagggtgttttggctttggttctgggagggtaccgttgtgtagtctctgtatgatttctttagctgtaatcaatgttagcagtatctgtgagtacttcagtggcctagggtgtggtgttttgtggaggctgtggtgtggctttgctggggatggagatgcatggcaggctgttccttgggcctctggtgacacatgcagagatgaggtggtcccaccactggaagtggggtcagactgccagtggtcatggcagaaggccatgagtaggtggctgtcaggctctggggagcatgcactttcagtctcaggaagtgagtttgcctcagcataaatttcctctctggaataatgaggtcacatggactccaggcagctcattatactgcgcttgtgtcctgtaagggctgtggtctcctgtagctaactttataggtgtccatgatatgactgtggactgttagggatctcccacttacctttttccttcagtgggaagtctctctttgctccaagctgatcctggctgactgctttgctttcctttctatgctgccttcctgagtttttgcatctcagaaggtctttgtcacttccttgctgaattccagtgttcctccctagacactgtttgatgtgtggttatttgttgttttggtccttctttggggtagagatgagtgttggttgcctttagttagccatcttgatgatgtttgctacttagttaagtttttgtgtccttttcaaagagggacacagcatctattcgggccatcaaaagaatctcccactttgctgtcctatcccattcagagagcctgagttcacttcctggctcctactgggtggtgttttcaatgcagcttcctgaaaccttccagctggagaatttagatcctctcagggagccaacacaccaaaatttaaatttgatcatcttccctttctgggtctttggcccttataacatgagagaattgttcaccagattttaaaattcttttctttaaggaagcagacagtagatacagtgtttatgacagcaaagcacacttggaaccttctctgcccttgctagagtctgagtggcacatcaatcttgtttatgaccagttctgtcccactggaagaaaattaggggcacagtctctcgctgaactctgagctgggtctgaggagttcccttaggaagattaagaaaccgacttagtcccattccactctcaggaatctgttgctgggtttgaggctttcttcaccactattggctccctgttctgccctggtggcttggctcggagctccattacttgttcttgcttcctgggaacaaagattgaggcagccctgaggattctgataaagtctcatattttttagagattcttggcaacaaattcttctcattaggacttgattcatgagcttctagacctccaagctgtgttccatcacctttggtagatagcccactgtaaatgttttcccaatctgaacagacaggctgaatgtatctgttcttttataaatacaaggtttaaaattcaacataccaatcccagcaatttaccatttgccacatattttctttgtagcagtgagatagtttgtaagtgaaaggaatctctttgttttaaagggagatcactttgttttaaacattgatatttacttaatcaatgtaatgtccccattttataaaatgtttaatggtctacagaatatattattttgagcaatatgcttatgtaacttataattatgtatacatatatatcaaaaaaattctactagtatgatccatgatcaatacttccctttcccaacttcttgttttgaaaatatttaattgttttgaaaaatgtctaagctgtagaaaatggcaggaatagtataatggatactcttttacccttcacacagattgttaatattttactgattactatattttgcctggagagagagagatgttttatttttgccaaagcatgtgagagtaagtagcaaacatcatgacacttcacccctcaaatattttcccacgtatcacttaagaacaagggcattcattctgttacatgaccacaatacaatcagcacagatagatattaacattgagacaatgctctgatgtattggtatctactatgcagttcataatcaaataagggttttggtaacttgggatccataaatggtctgcaaggtcagcccctgtagacctgcacttagtgggtgccatttccctgtctcaggtgcctgctctactggtgatatttttcactggctctgttgctcacttagaattttttctcccagctgttgacattttattttctgcatagttctgaagctgcagcagttgttcttatgccttcttgattgtaaatttcatagaagctgtcaatttctaagggatttcatctcctttgatgcagccaggtcaatagctacaaacctatctgagaatgtctgccatcggcctcctctctgtctagaaaggtgtcttagtctctcagcactttgggaggttgaggtgggcggatcacaaggtgagaagatcaagaacatcttggccaacatggtgaaaccccgtctctactaaaaatacaaaaattagccaggagtggtggcgtgcgcctgcagtccagctactctggaggctgaggcaggggaatcgcttgaacccgggaggcggaggttgcagtgagccgagattgtgccacttcactccagtctgggtgacaagagcagaaccccatctgaaaaaaaaaaagaaagaaagttatcttagtctattaaggctgccataacaaaataccataaacgggatggcttataagcaacagaaatttcttacagttctagaggctgggaagttaaaaatcaaggtgccagcagatttgatgtctggtgagagcatgcttccttgttcatagatgatgccttcttgctgtgtcttcacatggtagaaggggtgaggcagctctctggggcctcttctataagagcactaatcccattcaagatggctctgccttcataacctaagcaacttccagaggtcccacttcttaatatcatcattgtggaggttagaatttcaacatatgaatttaggaggacacaaacattcagactgtagcaaaagaagttttgtgccttaagaagttctatgggttatagtaggtaaaaactgtttttgtttttgtttttttgcgacggagtctcactcttgtcacccaggctggagtgaatggtgtggtctctgctcactgcaacttccacctcctgggttcaagtgattctcctgcctcagcctcctgagtagccgggagtacaggcccccgccaccacaaccagctaatttttgcatttttaatagagatggggtttcactatcttggccaggctggtctcgaactcctgacctcgtgatccacccgccttgttctcccaaagtgctgggattacaggtatgagccactgcgcctggccaaaactggtttctagtttatgagttcagcagatatttgactctggattcctcaatttagtgatatcacacaaaatggtataaataaatctgattttttccatctggacatctatatcccaagcagtcacatctcctctagatcatgtcctaatcttagaacagttgctcccattcctcagactttctagtgggatagtgagagccttcagagtgtagaacaggctcacttgtgccattattcagatgctcagccacagtgaagatgcactctatgcccaaccgtagggagagatttcaatctctgacagtagtctccacatgtcatcaacgtaagtcatagtcatctcaaagcccttcagcaatacataatcaggaatcgagcaactaaataacagttgtttgttttattatcatcagtaaaaaaatacaaagaaattcattcattggggcagcaacattctcattcccctttctctctcattacattgctgcacaacaccaatgccttctcacagttccctcttgcatgattctaggtttcgtcaggaaggctttcctgcagcctagttagcatagacttcatttttctccccacttctctctcagctgtttaccgtgtaggtcagtttagcctccctggcttgcttccttcctgacaatctccccctttacccaaattctaccctagaagcaattagataaaaatagatgcatcaagaaaacatcttttcttcttaggaaagaagggatgggagggaaggaagaaaacagcaaatacttattatttggtgtcttttattctgttactttcttacttgtttttttttaatgatctaaccacaaaacgaaaacacaaaataatgctttttctttgagaatatacctgaacagtttacctcaattgtcaggaagcgcaagactaaattcagagctgtactggtctttgtttgctttgtttgctctttgtctattcattccttactgatatgtttatttatttatttcaggttaatttattttgatccttttaaagagcttccttgtaaatgcactttcaaataagagttttattaagatacagttgatataccataaaattcactttttaaaagtgtacaatttaggctgggtgcactgtattcccaacagtttgggaggctgaggcgagaggatcacttgaggccaggggtccaagaccagcctggccagcatggcaataccatatctctactaaaaatacaaaaattagcgggcatggtggcgcacacctgtaatcccagctactggggaagctgaggcacaagaattgctcgaaaccagaaagcagaggttgcggtgagctgagattgtgccactgcactccagcctgggtgacagagcaagaccctgtctcaaaaaaagtgtacaatttagtgatttttagtatatgcacatatatagcaaatggcaccactatcatatttcaaaacattttcatcccctccaagagaaaccctgtacccataagtggttgctccccattctgtcctcctactagcccctggccttttctggatctttcatataaatgggataatagaatatgtgtttttttgcaattggcttctttcccttagcatgatgttttcaaggtttacctatgtggtagcatgtcccagtactctattcttttttactgctgaatgatattccattgtatggctataccacattttgtttttccatttgccagctgatggcatttgggttgtttctactttttggtgattacgaataatgcttctatgaacatttgtgtacagtttctgtgtgggcataagttttcagttctcttgcccatacgcctaggaatggaattgctgggtcatgtggtaattctatgtttaatattttaaaaactggcaaactattttccacagtagccacatcattttacatacctaccagtagtgtatgagagttctagcttcctcacatccttgctaacacttgtgattgtctgtcttttttattttagccatcctttgatatttttaatgatcagtgaaaacaatttgtgtctgtgtgaagttgcttcaaattcttttttttattgtggtaaaataaaaataacataatatatatcattttacccattattaagtgtacaattccatggtgttaagtacattcacagtgttgtgcaaccattatcactatccacatctagaatttttctatcatctcagactgaaactttgtgcccatcagacaatagctctcatttctcctcttccccagcccctggtgacttctatcttacatacaattcctatgaattagcctattctacgtacttcatataagtggaattataaaatattagtccttttgtgtctggcttattttacttaggatgttttcaaggctcatccatgttgtagttgtagtatgtgtcagaatttcattcattttttttttcttgagactgagtctcgctctgttgcccaggctggagtgcaatggcgcaatcttgactcactgcaacctctgcctcctgggttcaagcaattctcctgcctcagcctcccgagtagctgggattacaggtgcctgccaccatggctggctaacttttgtatttttttttttttttttgttagtagagatggtgtttcaccatgttggccaggctgatctcgaactcctgacctcaggtgatctggccggctgggataataggcatgagccaccacatctggccttaaattctttttgtaagtaactctggcctaatcttaagtaataagctaatacggagaatgtgcctcaccctccagcatactgtgtgttttggctttaagatcttgggacagcttctcagaggaagacaccactcctccccacagttgcagctgttcacctcccagactcactggtaaagttagaagacgcttctgaaaaactgcccatctatattttcctcacagcagttgtgaagacttgctgaggtggatttaaggtggggctctcatgggatacagcattagaagaggggacattttgctcttcctaatgtttatataccagcaatgtcccattggtcagggcagaaagttgaaggtgcttttgcttatggacctcatagagtgtgtgtgcacataccagcaggcttaattttaaaatctgaccccagaattatgctgtctacagttttatctcattgatttttcaaataagggtactctaatgtgttgtttttagctgtaactgtcttaagacatgtttgtccagcacatatgcttagcaaaatctctaactgtttgggatgaactccattctttattcataaaaagggtatgaagtgaattccattgacttctgatttgtcatgtttatacagttttcctaactaaatacaaaaggagttatcagcattctcttgactttctagattaaaactttggaacagactaaagccattgaagatctaaacaaatccagagaccaactggagaagatgaaggagaaagctgagaaaaagctcatgtctgtcaagtcagaactggataccacagaacatgaggctaaggagaataaagaaagggccagaaacatgatagaagtggtaaccagtgaaatgaagacactaaaaaaatctctggaagaagcagaaaagagagaaaagcaggtgggtctaaatctggtgatgaaaccttgtttaggaaatgacaggacaattcaagagcttgatattaatacttattcatgcatttctttttaaaaaagtttggactgtttcatgaatttgtatgtcatcgttttacgagggccgtgctaattttctctgtatcgttccaatgttaacacatgtgctcccgaagcgagaactagtcacatatttattcaaaagcaatttacaaagctttctatatcttttcaacatatccacctgcccctccagcatctttttggcattcaagtaaccactatgatttaccccgctaagaaaaattattcacatttccatggcacaaattgtaggaaaggaaaagacattcttattcaagcagcggaagggttttggtgaaaaaacaggttctggttctggggaggtttttgttatgttaggtgatcgcctctgaagtttgcatcatcatagagctcttaacgttaaccagggctttggcctcaggagggaagccttatctgtagcagagatcagttgcaggaaacagccccaaatctcaaacagtggcacccagacttgatggccgaccaggcacagatgtaagccataaaaaagtactcatttgcttgctggctacaagaaggagcattttatctagtgagtccatcaggaggtcaggcgtaaagaaacatgtaccgggcagcttgacctccattgcttttggcttttgtctctttctccttttgaagctcaaaagggcatagagtggactctgatcctaggatttttttttccctgctttggctgcctctgttttggttcatgtgtcaagcagagacggggaaagccaaacgacacaatgagcgttctcagaaaggaaacttcttcggaatgaaaagctttggccacattggaaagggtagaagtctgagagaaactttttcatcagggagactaggtcggtgtcttagtcctttcaggctgctgtaacaaagtaccatctactgggtggcttataaataatagaaatctctttctcacagttctggaggctgagaagtccaagatcaaagtgtctggtgagcacagcacagcttcctggttcagagtcagccccttcttgctgtgtcctcacatggtggaaggagcaaggcagctctccggggcctcttttataagggcactaatcttattcatgagggctccaccctcatgatctaatcacccaccaaaggccccacctcctaatagcttcacattggtcattagatttcaacataagaattttgaggggtcataaaattcaaactgtaatagctaaaaaccattcccaaattggactctgcaagggaagcgggttgcagagcaaatgagcctggggtgggactgtttgggtggcattctcttggatgtaactgtattcagtttggatcatcccttttctaaaatggagggtgcctttaatgaggtgttggccagatgccctgatttatctgcttttgcattaacctagaaccacagaaaccagcctatgagaatttgaagggatatgaggcatatttcaaccattgtccccagcccctacttttctttcttcaatggacaaatagaagtcccagagcagtcccatggaatatggcttgtgaaatggcaatctgtgtgacatgacttgatagtaatttagaagtcctcctgttttcattagcttatactttcttgctgtttgttctttttttttttttttttttttttttttttttttttttttttttttagtgtaagaggttatcagccagctaaaatcccaaagcatgtttaccatccatgggcacaaccccaccaacatttgtttagttcttcctagtatgcagagcacacacacagtcaccatttcatgtgatctgaatttcagggcagcccttcgacgtaggtgtatggttaatcccaacctggagatgagaaaatgaaggcttagtgaggtctgggtctcattcatggttacttaacttggattcttgacttagtagccaataccacatcagttggctcatcagaaaagtgattgtgaaatctctgaaggttggcagttgatgtgacttatctggaatctggtattttataagtgagagaactaggaagagagtagataatttccctacctcatgcaaacctgggttttctacaggttttttgtttgttgcatttggctcagcagtagttgatacattttgttctcccagttaatgagtttctgtttgatattgcagctggcagacttcagggaggtggtgtcgcagatgctaggcttgaacgtgaccagccttgctcttcctgattatgaaatcatcaagtgtcttgaaagattggtccattcacatcagcatcactttgttacctgtgcctgcctcaaagatgtgactactgggcaagagaggcacccacaaggccatttacagcttcttcattgaacactgtatctcttgagagaggtggccataagacatggcacacaattcccaatttcacaaattcctcatgtctttgagatttgatcagtttgtgaatattttatgctttgatgatatagtgagaatgcatcacttgcaaaaacgatctcaaaagtgtcagccttagataaacgttcagcattaaaaacgcctattatttcatttactagcattttaggatccagaagaattccaccagattgcatgagttagattgggaaatgggagtgggagataatattgggaggtatctattttaagtcaggggctttactagccgatttagttctcacaataaccatgtggagaagctgtgacatttttaatttacaacctttctggggctcagacataaagttacctatccaaggttgcagttgggtagtggtgggaccaggatggacaactcattggccctgcctcaaaagccatacctcttctcctgctatgcagaatctgtttctcctgaatctctgtgatgctggtgggaattgtttgcatagaggaaggacaataaccctgccatcgtgagttaatgtccgggctggtcacagtggttcatgcctgtaatcccagcactttgggagtccaaggcaggcatatcatttgaggtcaggagtttaagaccagcctggctaacatagtgagaccctgtttctactaaaaatacaaaaataagccaggtgtggtggtgcatgactgtaatcccaactactcagcaggagaagcacttgaacccaggagacggaggcggcagtgagccaagattgtgccactgcactccagcctgggcgacagagtgaaactacatctcagaaaaaaaaaaaaaaaaaaaaaaaaaaagttaatgtccaaaaatgacagatttacaagtgtaagctatatgatttcttcaaaaagcaaaagcaatatacctaattcatttggatcaaacttacataggtctcaggtcctgtaagaaacttgcctgttctaactgttgctaccagattatatctggtggtaattgttaatgtttcagcagggctggtctcagtcctttaaaatggaaagctttatttggagcccaaccctataagatgaagaaatcctatatagtcttattcaccaatatatccaatacacccacagcaatggtacctttttaagatcaggattttattatgaattcctgtcactttctgttttccatttaaatttctattttacaaatttttcagggaatcatattcttaacttcactgagaaaaatgtgttactcttttggacaatttatcttatttctatcatataagatgtatttttttattgtccttaaaagaagctctagcatgaaattaaaggaaagggaaagaaatagatctggtgcacccgaacattaggagaaaatgaaaaatatacaaccaaccgttcgtgagtcatcaaaaagtcaaagtcagcctggccaacatggcaaaactccgtctctgcaaaaaatacaaaaatgagcccggtatgttggcatatgcctgtaatcccagctactcgagaggctgagacacgaaaattgcttgaacctgggaggcggaggttgcaatgagccgagatcgcgctactgcactccagcctgggcaacagagagagaccttgtctcaaaaaacaacaacaacaaaaagtcaaagtcataataagcaaattattggcttctttcttctagactaaaagaaattaaagagatgaaacaatcaattgcaagggtcaaaactagattggatcttggtttgaatgaaaaaaagcataaaatattcttgcaataattgtaaaaatttgaatgtggactaagtcctagattatattaaaatatttttaattttttaagcttgacaaatgcactgattgttatactttaaataactaaaaatctgagaatccacagtgctacagacaataagtgataaaatgggaaaaaatagtgaagatcttcttttaggaaaactaccaataaatgtagaatggatgattccaaaaaaaaaaaaaaaaagaagaaagagagaaagaaagaaacagaaaaacctaaaagaaagcgaatgaatttgacacctgttggttggatgacagaccacacagagggagagtgaccaggctttgcttgtggagcgggcatccctgcctagctatctccttcatgtgcaaggacagtataagtagtattttgcatgtgagtaaacacacctgcgcagccctggctgaggtcactaggctggccagaggcaggacaggcagtcttgaatttcctctaggggaggcctgcagttttccccaccaaccccttttcacatgctccaaagatgtagtagtgtctgctgttttggatcgaaaatcaccttgagtggaggaagtgacttcactgggtctctggaggctctcggagcttgagtggctctgccccaccctgaatcatgcacccataaatgcagttatgggtggatgtgggtgtatgagagtggagattgtttttgtacattctctttgttttcattttccaaatataatctttaataaacttgatttagtttcttgggaaatttattttctacgctattcaaagatattttaaataatattttaaaaacatgaaatttttttttcatttttgatttgatatcattaattttatatcaggattcatgtaagagactaaaaatgatccatagtggttagtactgtaatttctgtttattacatgaaattacattccatttatccaaatatatgtttatataatatttccactgtgtgactctagtgatctttaacatacacagaatgatctacagtgatctttaacatactcagaaatatgaaaaatgtttgaatatgatctttagggacttctaatgaaaagggtatatgaaatgggaacaataaattctgtacatgtatacagtccatatacacattaagtgtttgtcatttggacaaattgaaaacttttaataaagccattttcttctttgttaaaatgccagttggttgttggatttccctttatggcaatcattccagagttggcaggccagctttgaatttttaggttagattttgttcttctataatatccatgtatattttatgctgtccaataaaatgcactaggttgatatgatttttacataaggctttaaaatatttaatactaactcttctgtcaaatacacttgagtgatagtgattttgcactgaggttattattctggtcactgtctgagacatctaaatcgatgcataaaaacatctcatttagggaaaacaatttaagcttgacctatctaaaatttccagttttaccttacagtctgttttacaggttaacagcaagtgattcaaggtccaggggtggcaggctgaagctgttaaagaaatctacattattgatattgtcataatacttacgactcagaaatggagtctcattttaactggggaagcatttcatggttatgtagcctttggcttggaaagtctcacccagttgatgcagtagtgattttatccacattattggacacttcacttagcttctcattagcaagtggggtctgtatgcttctctttccgctatgtgcttccataccgtattcctctgcctttgtataaacacatggttcatttgaggctcctgctagctgatagatggataactttcttctagacctcattggggttacctactaaaagcctatctattctccctgctttagacttttgcaagtggttcataggtgtcttcactacccccaccgggtgctgccttcatcttgggtagctttaatgcccataaagccaactcatgtgacatcatacctttttttttttttttttcttttttgagacagagtctcactgtgtcaccaggctggagtgcagtggtgcgatcttggctcactgcaacctccgcctcctgggttcaagcgattctcctgcctcagcctcccgagcaactgggactacaggcacgtgccaccattcccggctaatttttgtatttttagtagagatggagtttcaccatgttggccaggatggtctcgatctcttgacctggtgatctgcctgcctcggcctcccaaagtgccaggattacaggcatgacccaccacacctggcctatatctttagttccttggccttctcagtgcccatacttttacctcctgttgtttcagccactcacatcctagactgcagcttatagtaatccaatttagactaccttaagctgaaaggagaattttgggggcttgcttgaaagattcaggggtagactagcttcagctttgttagatccaggggttcagaattggtgtctgaattctttctgcttctatccatctctcatgttgacttgattttgcttgtctttgcatgttggcctgactttttccttccgcacatgggttcctccatgctaccagaagagatgatcacaagcagttgcatgattgttacaactcatgtggtcaggcacgtggctcacacctgtaatctcagcactttggaaggctgagaagggcggattgcttgagctcaagagttcaagaccattctgggcaaaaaaacagaacaaaacaaacaaacaaaaccaaaaaaacccaccatgagtcgagaaaaagagacaccccctgtctccaagtgtccatgccaaaaatattagccgagaggctgatcatctcttccaggtcatatacgtatccttgaaccaatcactgtagccaggtggatgaactcactcaccagcctgcattccatgccaaccactgttagtgaggttggggtcgggtgacgctctaggattacctgttcaaccaggaccacatgtaatgacagagggaaagttccccaaaggaagggcagctggtgagacacacacacacacacacacacacacacacacacacacacacacacacacttctgtgacacgtggcctgtcaggactaacacctagaacttatgcatctctgaaatcttaactaaaaagctctacaacctcttaccatcccaaacctttatctcttactcccaaatagctgtgctttgagcctttgagcctttgcgtttccctggtcctcctattttctccctcccagtcttgcccatcctcgttccatctggagccagcctagatattaaggttcatttcttcaatcattctcttcctaacacctttaactcgttgttcccttgcccttctgtcctcgactttgaattactcccaactatcaatgtttctgctgcttttcctgccccactgaatgaagctggagaaaatcacatgaaatcacagctaagtggcatcccaaattcatggtttttgatcttatctgagcctcctgtcctaactggtaaagctgcactgttttccctgttacatctcactgttattttccaaaatgatttttgcaaatattcttttttcctttgaggctctcatcctgtgtcttccctcttcaccctcagcagacaatctcatctcctatttcacccagtaaatagaagtcattataggaaacaccttcaatatcacatcctaatacagccttatatgtgtccacacccccccttccctccttgcctctccctgtctcagctattttctctacctgggcacttgcatccacagcaacttagccccatcaattgttttcctctctttccagtgttgtcaacctcaccttcataaatgacttatttccatcagcatttaaaaatgttcaaatctctctcatctcaaagacatccctctctctactccacagcaacttctcctcagagccctacctctgtcttcttctccccagttgagccccttggaagtgtcctgtatatgctgtctttctggtctcaccttttattcatgccatcatccgttcaacctggcttttttcttcattcttccagtgttctcatttttgtgagcaaatctgtgttacttttaaagtgcttatcttcaaaggcatggtatcaacccaaatgcccatcagtgaaaaactgggtaaagaaaatgtggtacatatacaccatggaatactatgcagccataaaaaggagtgagatcatgtcctttgcagggatgtgggtggagctggaaaccatcgtcctcagcaaactaacacagaaacagaaaactaaacactgcatgttctcacttataaatgagagctgaatgatgagaacacaagggactcagtttgaaggcacaagagggttttctctgatatcctaaggctggggtaggtaacccaactgggggtttccatggcatcttgtgtgtagctagaccaacgcttatttacaacaacttcccatagtagcatctccttttgtggacaaagaaaccctgagactcggagaaatgaagcttacagccacctaaggtaaaatagaaatctactctgtgttacttcaaagtccacatgattcacatcgagccacgctgcctcctgtaggcttgttcatcacatgtctagtgcttggcccatagttggtgagcatttgttgaatgtctgactgaatcagctgatagaatggagtttgaatattcaggtggattggatcctcctctctttatggaccaggacttttaaccattatctgtatagagatttgaatggattctcaatgcataatttacgtaattacaaagtgggcaggtgaccaataatgataatagcttacagatgtattataactcttactacaatgttctcacatacattactttttttgatctccacaataattctgatagggcaggcatggttattcctaggaaatgaagaaagaaagagtgagagaaagagagagagagagaaagagaaagagaaagagaaagagagagagagcgcgagagagaatgaatgaattagccgaactgagaacaggctccaggtttcctaactcctggtcccatgaactttccatttcacaaagctactttccctgcaatcccttgggtaatcctgtggttaattcttgacttagcagaaagtagggaagaggtagtataaaaaaaagccactattcaagtggtaacgaacaataaatataaaaggagagattgcacccgctgttgatctggaaattgaaaatagggtcaaagcctggactcatgctctctggctccagactcactatgttctatcagaaaatcacgcgtagctggagtattgctaagtggaagaggggttttgttgttgctaccatgctgaaagtcatttacatactcagaacaacacctttccagttttcctataggactgtgaatgtcttcccaaggcatttaggaagctataaagaaatgataaagaggaatgcttgtctgtgctcagcagcagatgtcgtggtgtaccccagtcctgctgtaggactgaagcacttgttctctagctgcccagagcaaatgacttctgacaagccacatctgggtcccttccaagttcttgcccttggatgaagggagctatctcatcctgggtcgcagaccctttccaagggcaactctcatccagtggctagccagtgaaggggtacacagccatggcccttttccctccatgcaggaccactctgaagggtcatctcagtttccaaacccctcctttcttgtaagattggggaggcctctgttgcaactgcatgtcagggcagccagtccctccccatcctgctcttttactttcttgcaggtttagctcctgagtgtgcgattcgactaaacttctgcatccaaatctccatctcagagtcttccagaaaacctacaacagattaattccttctctctgcaattggttatgaagatactcagccatttttgtgacttccatcatatggttttatcaatctgtcagtcataagtactttttgatcacttggtgctagaggagtcacaaaacccaaaaacaacaaaataaaccccaaaatatctgtgttcagttttcagcttcttttcagaattatccaatagaaatttataactgagttccagtataatgttgagtaccagaaaaatatttagttttttctttcctgttaattgcaacagggtacagtaccagaataggtgctactcctagtggcttaagcaataagggatttatttatttttattttttatgtttttttgagacagagtttcgctcttgttgcccaggctggagtgcaatggcatgatctcggttcactgcaggctccacctcgcaggttcacgtgattctcctgcctcagcctcccaagtagctgggattacagtcatgcaccactatgcccaggtaattttgtacttttagtagagacagggtttcaccgtattggtcaggtcaggctggtctcaatctgctgacctcagatgacccacctgcctcagcctcccaaagtgctggcatgagccacctcacccggcctaagaagggatttattatagggtactaggtggcttacagaatcatgtgagggctgaagaaatgaacttgaggttgagctttccacagaaattcccaaaggcccaccacagaactaaaccaccaagagagctgctgctgctacgcctaggtggatgcagaattgcattgatacgaccctaatcctgaagccaccgctttcagggtgccttccctcctactgctaattctagaaccctactgcacctgctgctatctggaccacaaaatgtgtgccttttaccctgcctctcaggaaccacagaatagtgaccatattctgcatcctctgctaatgatgccacagaagtccaagagcatccatcagaaatagctgtggcagtagaggtgtgaccactgccatcgtccacatctcacactcgggcatctaatggctaaatccaaatcacatctggaatcctttctcaagggattcctggaatcatagcattcagcttcccaatgatggaggtacagaaaggcatgctggaagagtgttttccaaaagttctgacatattctactgtagaatcattttcctcacacatacatacagtcacatacgcatctacctgaaataaaagattcacaagacagttgaggcaccctgatggtttcaattctagtctatgctgagcagtgctatgctattccatgctatttcattccattaagaaatgctggtcttgacccactaagttggtttcgtgatggactaatggacgataactggcagtttggaaaaacacttcacaacaagaagggagaaatggatgttgagtgccaatccacaatatctacgatactattttatactattccttcccctgtcctgaattgacagaaagaattcaaggctgctcacagaagggactcagtgatatgataaactgcatagtgaactgaggatcaaaagtagcttctagtccatggaccagcagtttatttgtttgtaaatgagagcgttgtgatagttctgtgttgtaatgaccggattgacacctacctagtaggaaaactgagggaaatgttgaccagtctataccttgtaccttttactagaggatggattaagcccacgagggagttttgatggcaaatgcactatggtgtgcctttagaagcaactgttgtactcctgaaaaatattagttggctttagtccagttcctggttttgcatgtaggtgtaaaactaatgattcattctgagagcatgggggtatatattgaatgtgagaagcatgactcattcacctgccccatgtttgaaaagcaattgttaattacactgttaacatttgttaagactttaatttcttcatgtagagcttttaggtaaaagcttatatttaccaataactggggctttcaatgagaacttttttcctgatgcagtgctggttggaaggtaattggtttcaaaaaagaaaagcccattgagaaggcagaacaaagaaacgtttaacacatgtttcatctgtgccaaatagtacaccaagcatttccatgcacaatcactcgtgtagtccttacaatagctcttaatgaagaaattatgattttcctttttgtagatgagggagaaaggcttaaagagattaaaagggattcacccaaggtcattaaactagaaagtgaaagcatggaattcacattcaattttggatgactcacacctcctacttttcctactgttccaggatgtctctgttgctttcattatttgttcaaggtgaatataagtcaaaacaaaacccctcaacacaaactttattagcaagacggtaatttttatcttttggaaaaaagagaccttctaatgggtccttcagctgcccatttcatctcttccttagccatattttcctctttttaggaccctgatatctaaaagcaacagagaattgaacagatgatttgtgggcattattttggtttcatatcttttatggttttcttttggttgtgattgcatttaaggaaaccggaagaatttgtgttaaggaaagaatatgtttccccaaagttcatatgttgaagtcctaacctagatgtgatggtatttgaaggtggggccttttgaaggtaattaggtttagaggaagtcgttaggaagagcccacatgatgaaattagtgcccttataggaagaggaagagactggagagcttgcgctctctctactgtaaggagacagcaagaaggcatctatgtctctgcacgccaggaagagagagcaccagaacccaaccacgctggcaccttgattttggacttctagtctccagcactgtaagaagaaaatttctgttgtttaaaccacccattttatagtattttgttatggcagcctgagctaagacagtaagtaacctaaaacacttccctaaacacctctataaacttaacgcaagtgccggtcatgtttatgacactttgattgtgtatggttgtagcaatgtgaaaaatgccaaacttgtaaaatatgtgaaaaagatctgcaaaacgttcatgcctctttaaacacttgactcttaatatttgttttcaaattttttctcttttagcaaaaatacacaaaattaagtaaaatactaggactaaaaggaacccaattcaatgtgattcttcacccatgcaatctggttaccctcagtgcagaggttgagctgacatttgtacctactgacaggatataatttgtgactttggggaacatggttgcacacttttgagaatcacttttttaatgctaattagcttatttaaattttttttttatggtttcttatatgtaagccaatatatagtccgcatggttctgctaatagtccttagaagctggcaatgatgtccttcgcagagatggtagaatcctctgtgtgattctttcagagtgtgtgatgagttacaggaaaacggcagtttccaaaacagttctgcaaaccacttcatcgtaatcttcataatagtcaccatttatttatgcaccagagactgtgttgaaaactttgtaagctttatgtaatttaatcttcccctaaccataatcttaatgataatagtcaccatttatttatgcaccagggtgtgtttgagcacactgtaagctctatgtaattgaatcttcccctaacccaccactggctggtctgaccctgctgtgctctctctctcccatgctattctgcctcttctttggaggggcccattgtcaggcctgaagctgggtatctgaccaggttgtgccctgtcctacacgggagtgggaactgctctgtacctaggcgtctgccactgactcagaagtccaggtgagttggctgaggaggaaagacgcctgccaaacagagagctttgtgtttgtgggagttcactccgacttcctggtttggggatcaggctgattggcttcaattgaatgttaaagctgaatttttaaagccatgcctctttcactacagtggggacctctatgccattctgcataggagtctgataacatgggtattaagggcatggaatttctaggtgtactcactggcctctaatctgaaccccactttggctgtttgcttctacctctgggcattggttctctcatctagaaaatgaaggttaacaatggtcctaatctcctatagttggtcggaggggtaagtaaaatcatagatatgaaaagtttagtcctgtgcccagcatattatcaaatcaatatgtataagttattattaatattaatatgaggcccttaataggtccaatcatcatgtattcatatttaatggctttatctctagactaaatcactgtaatcaaatacttatcttttcctccctctgggatagactgttggatggtcttcagtgagtcataccttccagtattgatgtccttttgcaatccttccccaacccacactgactctgggcttggccaactgactggctttgggcaatgggacattggcaagtgtgctgcaggcagaggcttggtaagcccttgcacactggggcttgccctgtggaatgcagatgccatgcaagaagagaagactgggctagtcttgaagagagatcctaagaccacatgcagtaagaggctggtcatcccagcatcccactggagcccacccctgagccaatttttcagctgaatgcaaccacataagggactccagttatgaacagaactgcccagtcgacccacaggatcatgacaaacaatgcattattgttgttttaagccactgactttttggggtggtttgctgcgtagcagtagatggctgaaacaccctccataaaatagtgtgagacataaccttataccaaaataaaaatttagcacggatgctatcataccaatggcaaatgaacagttgtgggaaaacagtagagctttcaatgagctcaaagtagcatatctgcatcaggggcccatgccttgttgccaggaagtccatcagaagaaacctagggagttttcaggagtcctggctgctgggaaagccagcactgcagctgttggcctgtggaaatgtgaaaaaaagaaagaaaggaagaaaaaaaaaacccacaggcactccaaccgcttcaccacaataattgcaactcttatttctatttgccagcaaaactagtgtttacaagagaaaaacaagacgaattatatttttagcaataaatgttttatttggaaaatgtcagtgccagttgcaccctaatggtgtttttttccaaaacatgtggttagtaagaagagtggagtagggattcaggttattttaagagagctctgagagcttgactagacagtattgaaccggactgtattagaagggatatgggcctgtttgcactgtagctgcagaatatatctgacatgaagcatctccttgctttgtgggatggctttggtacatgcaccagcactgctgtgtcccaccgactcagcttccctttcctgaattgctttttgttcattgcattagatgaaatgaattgagtggtttggacattggagaagattatagatcttcaaggaaaaatacattcagtacatgattagaggctagaatagataagaaatcaatttggaatgagcagtttttaaaaaataaactttatattttggagcggtttttggttcagagcaaaaccaagtgaaatgtacagagatctccctcatactccctccctccacatatgcgcagcctctcctgtcaaaatcctgcaccagagtggcacatttgtgacaactgatggacctacagtgacacaccaaagtgcatagtttacattagggttcacttttaatgttggaaattctgtgagttttggcaaatgtatcataacatgtatccaccattatagtatcatacagagtagtgtcactgccctaaaaattctttgtgtgctgcctcatcatccctctccccctcctacccctgacaaccagtgatccttttactctccacagttttgccttttaaagaatgtcatgtagttggaatcacacagtatgtggcgttttcagattggcttctttcccttagcaatatgcaattaagtttcctccgtatcttttcacggtttggctgctcatttctttttaaggctgaatcatattcgattgtctggatgcaccaccatttatttatccttttgcccatggtaggacattttaggtgcttccaaaatgaggcaattatgaataaaactgctttaaacattttcgtgctttttgtgtggacatagttttcaactcgtgggtaaattcagaagcatgactactggatcgtatggtaagagtatatttagttttgtaagaaactgccaaactgtctcctaaagggacatttccaccaacaatgaatgagagttcttgttgctccacatccttggcagcatttggtgttgctttggactttgatcattctaataggtatgtgtttgtatctcattattgctttaattttcagtttcctaatgacatttgatgttcagcatctttctatatgcttaactgccatctgtatatcttctctggcaaagtgtctgttcagatcttttgctcattttaaaattagattgttcattttcttgttgttgacttttaagggttctttgtatattttggataatggtccattatcagatatgtcttctgcaaatatttcctcccagaacagtttttaaggtaataatgtttgagagatttaaattaatctgagcattgtgtaaataaaaaataagtttaaaaaataaacagaaatatattagctatcatgatcaaatgtttgaggaagaattattaaattattgatgctttaacaaatctgtttttttatgtgagggagagcatataacaaaatttctttgtgagttgcaaaattgtagttaggaaaattaccaaagaatacatgatctaaataaaggctgagaaataggaaaagtctgtaaagaagggaacctgttgatgtattctcattgttgtccttctatcttattgtgttatggttattcgtgtttctgttcccttactagcctgtgagttcctaagatatagtatcttcctaatatttgaaacttggctgcatctgggatgagacatagtagaccctcaacaaatgtttcttgaatgaataaatatatggatggctgcataccagtttaaaaatattctcaaatttctatgaaactggatttgtcagaaacaatcttaagtgttgttagatgaccagctcgtggcactaacacatttggggccatattatgtagtagtccatccagtagcttgggctttggaatcagagagatttagccctaagtcctggttcaccattgtcaagccgtgtgatcttggccaaagtagctttctaaatctcctgtttatcagcagtaaaatgggagcaaaagtaatgcctgtctcatggggtacagtagctgtaagggttaaataagaatgcaagtgaaaactgcttggctatggtagggttcaacaaatgtttgccattattacatcaaacaaatgcacgaacgataaagtcgtgtttgcataaagcaagggaggaatgccagttctccctggtagaggcagactaacccttggaatctagaggcacgattagagtaagactatggtgctaagagacaggagtgagctatgcctttgtccaggtgcactgggctagtgtatctttctgctgatattctttctctgtactgtggctgacctttgaccaaggacgcttgctcttaagggttcctggtgggacaggcatattttgagcatacccagggtagggtgggtaaagggccaagactgtgggttggcttcaatcccagatggccacctgttatagaccctacaccaggcttcagtggaacctgaatcaccaactcctgggatttgaattgattcaaatcagtgatccatctcttagtttgctagctacagccatagaacccacacactaagaagacattgttgcttacatgattcaatcctgctccaagtttgctctatgatctaatatggaagagagtgctaaggctgacaagatgttaactatgagttattaaagtttttcagggaagtcaaaacatggactcttgctgccattaggaattgatgtgcacctcataatattaaaagacttcactaaagagatatcaggagcagatggattgtgagggcagataaataaactatctcatcttcagtaaatgcgacccatgaaagtgaggctgcttgagtggaaaagaattgtcatatggcctagatgaggttttgttctaggcatggtcttctcagaatgttttatctaattatgagtctcaaggacagagacatctaccacattcaaagaatgacagctcggttctcacaactcctcatgaccagtcatttccttttgtaaaactcgcttggaaaacacagcaagttcttctatctgatgcttagtctgggtgccactgacagcaaattacaaaccatagtgtaatgtgtactttgatacatctggacaattactgaatatatatatatatatatatatatgggtttcttgcctatatatatatatatgtgggtttcttgtcgatctatctatatctatattgtctatctatctatctatctatctatctatctatctatctatctatccatctatctatcctcactgaaccctctcttattattgaaagtttattggaagtaggtgctctatgcattctttttttttaaaaaaagttttttgggatggagtttcgctcttgttgcccaggctggagtgcaatggtgcgatctcagctcactgcaacctccgcctcctgggttcaagcaattcttctgcctcagcctcctgagtagctgggactacaggtgcccaccaccacgcccagctaatttttttttttttttttttttttttttttttttgagacggagtctcgctctgtcgcccaggctggagtgcagtggcgggatcccggctcactgcaagctccgcctcccggattcacgccattctcctgcctcagcctcccaagtagctgggactacaggcgcccgccactacgcccagctaattttttgtatttttagtagagacggagtttcactatattgtccaggctggtctcgaactcctgaccttgggtgatccactcgccttggcctctcaaagtgctgggattacaagcgtgagccactgcacctggcctatgtattcttttctgataactgagcagttattttctgttgaattagtagaacaagaacccccagataatgcaatttctttgcaaccttcatctttgaaggagtttatagattgtgcatacataagatgcgcactatttgtgaaccctcaaatatttattacccaatagaccatagggagaaagaagagaattgctaccacttcaatttaaaacacacatgcacatgcacacacatgcacacacacacacatacacacatacacttcatgaaaataatatatgaataggttcttcttctgaatattaacaaaaaatgaggtaaagtgaaatcactagccctattcaatttcccgtccatgtgagaaaatcagtttctctactaacaattgatatcaaacatcaacaacagttaaatgtttcactcaggctgctgtggagccctggagctgaagtctcctctcagaggagtcctatatctcgcaggaatggatccatataaatagccttgctgtgtttagtcactggcttgaagcagcccctgggcagcatggccttggggtgaacacaggagtgctttcgattgtcagggtgtctgtctattatactcctacagcaaaagatctcagtggtgcattctcccctcccctcccctcctcccctcccctcctgtcccctcccctccctccctccctttttccttccttccttccttccttccttccttccttccttccttctttctttcttccttttttctttttttttgagatggagtcttgctctgtcgcctaggctggagtgcagtggcacaatcttggctcactgcaatctccacctcccaggttcaagcaattctcctgcctcagggtcctgagtagctgggattataggcacctgccaccacgcctggctaatttttgtatttttagtagagacgcggtttcaccatgttagccaggctggtcttgaactcctgacctcgtgatctgccctcctcggcctcccaaagtgctgggattacaggtgtgagccaccgtgtcctgcttgagtggtgcatttttatggccaccacttgtattcattgatcattgtatttcttctgtaggacaggagttggcaaacttctgtaaagtaacagtaagtattttaggctttacaggtctgtcacaactactcagctctgctcttgtagcagtaaagcagccatcggctgtatgcagatgaccgagagtgtgttccaatcttcacaaaagcaggcaatagccaactatgctgttgtttcctgaccccaggactagaaaatgtctgtttatagcacctgtctcttgaaaattttgtagaatttacctataaaactatttggaccctgtgcctttttttaaggagctagactttgactaattttctaacttattctatggttaactggtatatttaagtttatttattcttgtgctaatattgaaattcatattgtttttagaaattcaaccatattacatagattttatgtttcttgctaccaatttttacctggtctacccttattttcaaaatctctgtatttttcatatttttaaatcatacattttaaaagttgatgttttattttggatgatgtgtgtaattttttaaaaagcctctattatgaataagtataaatcaaaataaatatatagaactcaaggttatatcaattcatatgtctaaatcttgatgttctgtgaatgaggaaaagcaataccagctatgatgacatgtgatcaattcacaatagttagtcgtatttgtgaatatttttctttttaaaagccacacataaataaatcatttattgagtcaaaatatccttctgccatctggattcatgtttgttgttgtttagattactggggttacttatagtggctaagcatatagattctggagctagagggcttgtatgtcaatcttgactcccacacatactagcattgtaaactagagtaaattaactaagtgctctgccccatgtccttatttggaaaatggagccaataatagtacctactgtgcaatattatgaaaattaaatgagttaatataagtgaagaacttacaatggtgtctgatgcacgtaagtgctaccaattgttaatgtaagtattcttagtgtcatgtgcttatgtgcttgatttgttctgcagctctggttgtaaaggttttactctttatgctttggttttcttgagtctgtctttgatgaattttttataatcactttactttttgtaagattcttttgtgaagttcagaaaatgatggctcatgactgtgtcaacaccagagattactgtgatatctgttgcttcacctcagaatcttgggagaagcaggctcaacaatgagggaatcatccatgacacccactgtcccaatgaccatctttgcctccacctgtttgtgccctttcacaatcatcaagatattgtgatcttgatttcgattcttttggatacatatcctgaagtgggaaggctgggttacatggtaataagagatatcagcacttccatgtttatagcagcactattcacagtggccaagatatgaaatacggtatatgcatacaatggagtattatgcagccatgaaaaagaaggatattctgcttcttctatcatatggcatgacattgatggacctttaggacattatcctaaatgaaataagccggtcaaagaaagacaaatactgcatgattccacttatataagatatctgaaatagtcacattcatagaatcaaagagagaaatggtggttttcaggggctggaggcaaagggaaacaggggagttactaagaaatgggcataatgttccagttaaacaagttgaataagctcagagatttgatatacaacattctacctagaggtgacaatgtacggtgcacttaaaaatttgttaagggggtagatctcatgttaaatgttcttaccacattaagagaaaacaaacaaacaaaagatactgtagtgttggagaattctcacaatggctgaactggtctccactgagcctggtggcaaaagcagacgggggaggctcctctctcagatcagttttgtagagttgagggaggggcaccttgaatgaacataatacttggagagagtgttgcagttagaggacagaaaacaaaagcacatcatcaagagtgcctcctgctatgtttatgcctattttactgtccttttcaaagaaaagctttaagtttaattgatcaacaatttttgaatttttcttttagttgtgttttcaaatttattgatttctgcatttctatttatttgttcctttgttatgcttttttggggggggaggcttattttgttgttctttaatttcttgagttgaaagtttatctcatttatttttagtctttttggtttttaatgaatatatttaagcctctgaattttttctctgaatactgctttagtggtattgcactagtttttttttaaccccttgttcttggtttattaacagccttttcagcataattcaatgcttataacactgtctacatattgtttttaaaatggttttgaagattagtttttttaaaactaatttctttcttttatttatttatttttgagacagggtcttgctgcattgcctaggctggagtccagtggcgtgatcatggctcactgcagctttgactccctggcctcaggtgattctcccatctcagcctccagagtagctgggactacagaaatgtgccactacacctggctaatttttatatttttgtatttttgttgttgttgttgttgtagagatgaggtttcaccatgttgcccaggctgatctcgaactcctgtgcttaagccatccacataccttggcctcccaaagtgctggtattacaggtgtcagctaccatacctggctaaaaactaatttaaaacaacgtcattatggaaatacaatttacactgcttacagctcactaattaaaagtgtgcattttcatgttcttaaaagtatattcaaaaagtttgtgaccatcaacacaatttcattttagaatgcttttgtcttttctaaaagaaacccatccttttcctcccacaactttccctacctttaagccaccagtaatctactttttgtctttatgtatttgcctattctagaaatttcatataaatggaatcatataatatgtcgccttttgtgactggctgctttcacttagcataacttttttgaagttcatccatattgtagtgcttcagtccttgttatgggggaataatattccattgtatggatatactacatttaaaaaatctatttgttattggtaaacattagagctgtttctactttttggttattatgagtaatgctgctaaaaacattgtatacaagttcttgtgtgaatgtgtgcttttatttgtcttgttgatatacctaggagtggaattgttaggtcacatagtaatgctatgtttaccttttgagacattgcaaaacttttttccaaagcagctgcaccattataaattcccaccagcaatgcatgaggattcaatttctccacattgttgtcaacacttgttactgtctggagccagcctagtgggtgtgaagtggtatttcattgtggttctgatttgcatgtctctaataactaataatgttgagcgtattttcatgtgctcactggccatttgtacatcttctttggaaatatatctattcaccccttttgcccattttaaatgttgtattatttttctttttattattgcattgtaagagctctttagatcttctagatgcaaatcttttatcagatatatgatttgcaaatattttctactgttctgtgtgttgtctttcatttttaaataatattctgtgaagccaaaagttttaattttgatgaagtctaaattatcattattctttgttttgttgtttgtacttttggtgtcatagctaagaaataattgcctaatccaatgtcatgaagatttatgtctttctttctttttctttccttctttctctttttctttctttctctttctttctttctttctctttccccttccttccttccttccttccttccttccttccttccttccttccttccttcctatctcgcgctctctttctttctctctctgtctctctcttttttttaggcaaggtcttattatgttgcccaggtgggtcataaactcctgggttcaaaagtgatactttcatctcagcctcctgagtagctgggactacaggcatatgacactgtgcctggattaagagttttataattttagcttttgcccttaggtctttgatctgttttgagttaaaatttgtatagcgtgaggtaggtgtccaacttctttcttttgcatgtggctatctagttgctccagcaccatttgttgaaaaggctctctttctcccttgaattttcttgttgcccttgtcgatgtcagttgactataaattcctgagtttatttctgaattctcaattccactccactgatctaagtttattcttattctagtagtcaccattattttgatcttctttctgtgtctcagattttttccccctgtagaacatctccagtaatggtttacataagtttgtgattagtgatgttatagtgtgataatgtgtttatttgctcttacactttggctgagcttagaaatatttgtattttgacctttgatacggtttggatatttgtctcctccaaatctcatgttgaaatgtaatcactaatgttggaggttgggcctaatgcaaggtatttgggtcatgggggtggatccctcatggcttggtgctgtccttgggatagtgaatgagttctcatgagatctggttgtttaaaagtgagcggtacctccttcctctctctcttgctcctgctctgccaagtgatgtgcctgcttccgctttaccttccaccatgagtaaaagcttcctgaggcctcaccagaagcttagcagatgcaggtgccatgattcctgtatagcctgcagaactgtaagccaattaaacctctcttcttgataaattacccagcctcatatatgttttatagcaatggaagaatggccgaatacaacctttgagatgtctgtttcactgtcatctttgcttcagagttactgaagaaaagtctgatgatctcattctgttttcttagttgataattggtttttattttatctctttctctgcaagactttcagattttctctttatatttagcgttctgaaatttttacagtactgttttgcgtgattcattttttattcatcttttgtcttttcaatctgaggatttttgtttgttctggagtatttctttattattgctttgagtactgcctttcttccattctattctttccttcaggcactcatattttcaaatattagaatttttggatctggtctaaaaaggaaataaaaaaatctataatcagactagaatagaaggggtacccttgacagtccaagaaataagagaaagccctgacatgccaaacagatgttacgagataaacttgtaagacagaaatactgcagctggggcgcagtggctcatgcctgtaatcctagcactttgggaggccaaggtgggtggatcacttgaggtcaggtgttcaagaccagcctggccaacatgatgaaaccctgtctctactaaaaatacaaaaatttgcctggcctggtggcgggcgcctgtaatcccagctactcgggaggctgaggcaggagaattgcttgaacctgggaggcagaggttgccatgagctgagatagtgccactgcactccagcctgggtgacagtgagagactccatttcaaaaagataaaaaatgacacaagaaagatgatagaaatgacaggatgtggagacacaactcaaattctaggttccagatcttgacatcttcccactgtcttactgctctgcatcatgttagcttagaaagttactcaacctctttgatctttggattcatgatctaaaaatggagtgttggggggcgtggttaaagtgataattttgaataagtcttcaaacccaacatgtcatgagccttccttgaactgcatcttcatttatagattaaacgttttgataaattcactatgggctcttaactgtattattaaaattgtggtgacaaccagctgttattttatggtagaacataagtatctcttttcattgccattcttcactaaaaggatactttgtccccctttttctttttccataggttattggggtacaggtggtgtttggttatatgagtaagttctttagtggtgatttgtgagattttggtccacccatcacctgagcagtatacactgcaccctatttgcagtattttattccttgccccctccaacccttccctccaaatccccaaactcctttgtatcattttatgcctttgcatcctcatagcttagctcccatataacagtaggaacatatgatgtttgtttttccattcctgagttacttcacttagaataatagtctccaatctcatccaggtcactgcgaatgccgttaattctcttctttttatagctgagtagtaatccctagtatatatatactacagattctttatccactcattgattgatgggcatttgggttggttccacgattttgcaattgtgaattgtgccactataaacatgcgtgtgcaagtatcttttttgtataatgacttattttcctctgagtagatacccagtagtgggattgctggatcaaatggtagttctacttttggttctttaaggaatctccacgctcttttccatagcggttgtactagtttacattcccatcagcaatgtagaagtgttccctgatcaccacatccacgtcaacatctactgttttttgattttttgattatggccgtttttacaggagtaaggtggtatggcattgcggttttgatttgcattgccctgatcattagtgatgttgagcatttttttttgaatgtttcttggccatttgtatatcttcttttgagaattgtctattcatgtccttagcccactttctgaagggattttttaaaattgctgatttgtttgagttaattgtagattttggatattagtcttttgtcagatgtatagattgtgaggattttctcccattctgtgggttgtctgtttactctgctgactgttctttttgcggtgcaaaagctctttagtttaattaggtcccggctatttatctttgtttttattgaatttgcttttgggttcttggtcatgaaatccttgcctaagccaatgtctagaagggtttttccagtgttatcctctagaatttttagagtttcaggtctgaaagtccttaatccatctagagttgatttttgtataaggtgagaaatgagaatccagtttcattctcctacattcggctagccaattatcccagcaccatttgttcaaaagggtgttctttccccactttatgttttcatttgctttgttgaagatcagttgactgtaagtatttgggtttatttctgggttatctattctgttccattggtctatgtgcctatttttataccagtaccatgctgttttggtgactgtggccttataatacagtttgaaatctggtagtgtgatgcctccagatttgttctttttgcttagtcttgctttggctatgcaggctttttttgggttccgtatgagttttagaattgtgtcttcaagttctgtgaagaatggtggtattttaatggggattgcattgaatttgtagattgcttttggcagtcattttcacaatattgaatctacccatgcatgagcatgggatgtgtttccatttgtgtcgtctatgatttctttcagcagtgttttgtagttttccttgtacagattctttcacctccttggttaggtatattcctaagcattttatttcatcttttgcagctatcataaaagaggttgagttcttgatttgattctcagcttggtcactgttggtgtatagaagagctactgatttgtgtacattaatcttgtatccgaaactttgctgaattcttttatcagttctaggagctttctggaggagtctttagggtttttgaggtaaacaatcatattgtcagcaaacagcgacaatttcacttcctcttcgtcaatttggatgccctttatttctttctcttgtctgtttgctctagctaggatttccactactatgttgaagaggagtggtgagaatggccatccttgtcttgtttcagttctcagagggaatcctttcaacttttccccattcagtattatgttgcctgtgggtttgtcatatatggcttttattatattgaggtatgtcccttgaatgatgattttgctgagagtttttatcataaagggatactggattttgtcaaatgctttttctgcatctgttgagatgatcatatgatttttgtttttaattctgtttatgtggtgtatcacatttattgactcgtgtatgttaaaccatccctgcatccctggtatgaaacccacttgatcatggtgaattatctttttgatatgttgttggattcagttagctagtattttgttaaggattttagcatctatgttcgtcagggatattggtctgtagttttctggttatgtcctttcctggttttggtattaaagtaatgctgacttcatagaatgaattagggatggctctttctttctctattttgtggaatagtgtcaataggattgctaccaattcttctttgaatgtctggtagaattctgctgtgaatctgtctggtcctggacttgtttctgttggtaatttttaaattaccatttcaatctcactgcttgttattggtctgttcggggtatctaattcttcttgatttaagctaggaggtttgtatctttccaggaatttatccatctcttctaagttttctactttatgtgcataaaggtgttcatagtaggcttgaatgatcttttgtatttctgcagtgtcagttgtaatatctcccatttcatttcttattgaggttatttggattttttctcttcttttgttggttaatcttgctaatcgtctatcagctttatttatcttttcaaggagccagctttttgtttcacttatcttttgtatttttttgttgttgtttcaatttcatttagttctgctctgatcttggttatttcctttcttctgctggggttgggttgggtttgttcttgtttctctagttccttgagatgtgaccttagaatgtcagtttgtgttctttcagtctttttgatgtggatgtttagggatatgaactttcctcttagcaccgcctttgctgtatcccagaggttttgataggttgtgtcactattgtcgttccgttcaaataattttttgatttccatccgatttcgtttttgacccaatgatcattcaggagtaggttatttaatatccatgtctttgcatggtttcaaatgttccttttggagtctatttccagttttactccactctggtctgacagagtgcttgatataatttcagttttcttatatttatggaggcttgtttatgacatatcatatggtctatcttggagaaagttccatgcactgttgaatagaatatgtattttgtggttgttggatggaatgttctgtgtatatctgttaagttcatttgttccaaggtatagtttaaatccattgcttctttgttgactttccatcttgatgatctgtctagtgctctcagtggagtatcgaagtcccccagtattattgtgttgctatctatctcatttcttaggtctattagtagttgttttataaatttgggagctccagtgttagatgcatatatattttcctgatggacaaggtcttttaccattatatactatccctctttgtcttttttaactgctgttgctttaaagtttgttttgtctgatataaaaatagctacccctactcacttttggtgtccatttgcatgaaatgtctttttccaccccttactttaagtttatgtgagtccttatgtgttaggtgagtctcttgaaggcaacagatagttggttggtgaattcttatccattctgcagttctgtatcttttaagtggagcattgaggccatttacattcaatgttagtattgaaatgtgaggtaccattgcattcatcatgctctttgttgactgtgtaccttggttttttgtttttaaattgcatttttattttataggtcctgtgttatgctttaaagaggtttctgttttgatgtgtttccaggaattgtttcaagatttagggctccttttagcagttcttgtagtggtggcttggtagtggcaaattctctcatcatttgtttgtctgagaaagactgtatctttccttcatatgtgatgcttagtttcactggatacaaaattcttggctgataattgttttgtttgaggaagctaaagatagggccccaatcccttctagtttgtagggtttctgctgagagatatatctgctgttaatctgataggttttcctgtatagattacctggtgcttttgtctcacagctcttaagattatttcctttgtcttaactttagataacctgatgacaatgtgcctaggtgatggtctttttgcaatgaatttcccagttgttctttgtgcttcttgtatttgcatgtctaggtctgtagcaaggctggggaagttttcctctattattcccccaaatatgttttccaaacttttagaattctcttcttcctcaggaacatcaattattcttaggtttggtcattcaacataatctcagacttcttggaggctttgttaatattttcttattctgtttcctttgtctttgttggattgggttaatttgaagaccttgtctttgaactctgaatttctttcttctactgttcaattctattgctgagactttccagagcattttacatttctataagtgtgtccagtgtttcctgcagttttgattgttttttctttatgctatctatttccttgattatttctcccttcgcttcttctattgttttttggatttccttgcactggggtttggctttctctggtgcctctgattagctgaataactagccttctgaactcttttttcaggtaaatcagggatttcttctcagtttagatccattgctggtgagctagtatgatttttttgggggtgttaaagagccttgttttgtcatattatcagatttggttttctggttccttctcatttgggtagcctctgtcagagggaagttctatggctgaaggctgttgttcgtattcttttatcccacgaggtgttcccttgatgtagtactctctcccttttcctatggatgtggcttcttgagagccgaactgtagtaatggttatctctcttccaggtctagccactcagcaagtctaccaggctgtgagctggtattgcgggttgttggcactgagttctgtggtgtgaactgtctgtgtgtctctccgccatggacacctgcacctgttatgggggaggtggtagaggggtgaaacggatccctggttcttagctttggtggtttaatgctctatttttgtgctggttggccttctgccgggaggtggcgctttacagacagcatcagctatggtagtgtggagagggactggcagtgggcggggtcctagagctcccaagaatatatgccctttgtcttcagctactagggagggtagggaaggaccatcaggtgggggcagggctaggcctgatctgagctcagaccctccttggataggtcttgctgtggctgctgtgaggggatgggagtgaggttcccaggtcaatggaattgtgtacctaggaggattacggctccctctgcggagtcatgcaggttgtcagggaagtgggagaaagccaacagtcaccagcctcacccagctcctgcgcaatccaaaggggtggtctcacgcccactgtgtccccgctaacaactctgagtctgtttccaggcagggggtaagcagggctgagaacttgccgcagtctgcccacctcccagtggcaaaagaaaagggctttagttcttccccagcctgtggagtctgcacgcaggattcgcaccctcccccgtgttatggccaggaggcttcttgaccggttcaaattgttacaaagttcagctggagacttccttcttcctgtggtgtttccgccgtgcctctggccaccctcctgaaggatccttgtgatgccaggcaggagtggcctgcttggggacccagcgagctccccaggcctttccagctgcttcctctatccctgtgttttgcttgtctatctaaattgactcagctccagataaggtcagaatcttctcctgcaaactagaacttcagtttccccataggaggtgtgcgttccagggcggaggatctccctttcccacttccgcagttggggcactcacataatttggggtgtctcctgggtccagcaggagcagtccgcttccttcagagggtctgtgggtcctcctgggattcctggtttattcctgcagttgttctggagctgaaattcacaatgtgagcctctgcacgctgttctgtgcgtccgagtcgaagctgccatctagttttgcctcccatccgtgatgatgatctatgatctctacaaggatacatttgctagaaatatttgttctctctggccgggcgcggtggctcacgcttgtaatcccagcattttgggaggccgaggcaggtggatcacgaggtcaggagatcgagaccatcttggctaacacggtgaaaccccgtctctactaaaaaatataaaaaattagctgggcgtggtggcgggcgcctgtagtcccagctactcaggaggctgaggcaggagaatggcgtgaacccgggaggcggagtttgcagtgagccgagatcgcgccactgcactccagcctgcgcaacagagcgagactctgtctcaaaaaaaaaaaaaaaaaaaaagaaatatttgttctccctaccctaaaagggatataattgaaatacaaaaaaacaatatggagaggtaatttctttctttctttttctttttcttttttttttctttttggagacagggtcttgttctgttgcccaggctgaatgcagtgggacaatcacagctcactgcagccttgacctcctgggctcaaatgatcctcccaccttagcttcctgagtagctgggactacagatacgcaccaccacaccagctaaggtttaaaattgtttttaatagtgagagaatttcacaattttgccaggctggtctcgaactcctgggctcaagcaatctgcccacctcggcctcccaaagtgctgggattataggcatgaaccactgcaccggaaccttggagaggtaatttttaacaaggccatcttttctctaacagaggagcactaagaagtcagatttcatcctggcatgtgactgtcacacaagcaaatgactgtgctgattagaaagcttgtgtagctcagaaatatcacataatatgcagtctccgttgagcaacattgcagcttatgttcattaggtaaaaccatagtaatctgaaaatattttaggtatatctgccattattttatgactaaacaaggagatgattttagtattgattactttcatgcacatattttaaaaactcctgattttttatgttggaaacattccagttctttttttttttttttttttttttgagaccggagtctcgctctgtcgcccaggctggagtgcagtggcgggatctcggctcactgcaagctccgcctcccgggttcacgccattctcctgcctcagcctccccagttcttttcttatctagctattttgaactatacatttgattgtattccaaaaatacgtacaactattatgtatcaataaaatgtcctaacttttttgcatagtgaaaggtttgttcaggttgtagtatgagttgcagtcatcctgtttttggcatgggagggagatgtttctaaactagccagttataggtgtcacctaccaatgttctacaaaatgtggaccaggcagagagaattacagatgctgggtggaaactttggttctgggcctgattctgcccctaacttggcatgaagcctcagtttcttcttactacagcaggaaaaataatacttgctttatctgtttcatgtgtctgctatgatgataacaaatataatgtatatgagacaatttaaaaacttaaagcattttaagttccttggtctttatgggagagggaggaccatcatttctttctcttttttctttttcttcttctcctcccctttcctcctctttttttcattccttctttttctccttatctttctcctcctccctctcctccttcttcttcctcctccaacctcctccttctcctcgcttcttcccttctccttttacttccttcttttctccttctcctccattctctttctcctcctccttcatccactccttcttcttcttccttttgagatggaatcttgctctgtcacccaggctggagtgcagtggcatgatcttggctcactgcagcctccacctcccagattcaagtgattctcgtgcctcagcctccctagtagctgggattacaggtgtatgccaccacacccagctaatttttttttttttttttttttttttgagacactatttcactcttgtcacccagactggagtgcagtggtgtgatcttggctcactgcaaactccacctcccagattcaagcaattcccctgcctcagcctcctgagtagctgggattacaggtgtgcaccaccatgtctggctaattttgtatttttagtagagatggggtttcaccatgttggccaggctggtcttgaactcctgacctcaagtgatccacctgcctcggcctcccaaagtactgggattacaggtgtgagtcaccgcacccggtcctttccttcttcttcctcttcttcttcttcttccttcttttctctgtctccttctcctttttttcctccttgtccttcttctgtctgatgcatagtcaagggtttgataagtgtctgctctgtgctgacagtttcaggagcagtacagaaactcctattttgtactccaaataatccacaagaattaattggatcacctcgaaggaggaaagagaagctcaaagagatcaggtaagttgcacaagctctgaatcccagcacaccgtgaaaacgggcttcaaatctggtctttctgattccaaagtctatagtcttacctgtgattcactttcctgatttgttaaaaaaaaaaaaaaaaaaaaggatgcttcatttgcttaagtaaaattccagggaattttcagcagaagttttaaatgttggtagagaattttcttgaggcaaaactgataatcataaagcttgtctggctaccaaaattgatctggtagtcaaaacttcttggtaaagttatcagtatagagacccaagagaaacaaataagaagaatctgctactaaattttggcggagttgagaaattttttaatttgagctttcactctaagagataagagtctgtgaccaattgtattgtgtgttttgcattgctatgaaggaatgcctgaggctgggtagtttataaagaaaagaggtgtatttggctcagagttctgcagcctatacaagcagggcagcagcttctgcttggcttctggggaggcttcaggaagcttttgctcatggcagaaggcaaagagggagcaggcatgtcacatgagagggagcaagagtgggggaggaggtgccaggctcctttaagcaaccagctcttgcatgaactaatagagtgagaactgaatcattaccatgaggaggacaccaactcattcatgagagatccgcccccatgacccaaacacctcccaccaggccccacctccaacactggggatgacatgtcaacacaagatttggacgggacaaatattccaactattcacccatgttccctaacttgaagggagttcacattaggacaagttcactgaaatctttgttttggaatggggatggataagacatcatttattaagttatggtttttagtttctggctttggctaactcaaacaaaaagggaatatttcagactggtgcttggtaaatcatagaatgacaaacaattggaagaccaggttaaaatgaacttggaggacattaagtgaattaagccaggcacagaaagacaaatactgcaaattctcacttatatgtggaatctaaaaaaagttgagcttatacaaacagagagtagaatggtggtcaccagaggctggggaaggaggagttgaggagatatcggtcaaagcatacaaaatttcagttaggcaggaggaataaattcaagagatctattgtacaacatggtgactgtagttaataacattgtgactgtattgaattcttgaaagttgctaagagagtagattttaagtgttctcacttaaaaaaataagtatgtgagataatgcgtatgttagttagctctatttagccatttcacaatgtgtatgtagtccaaaatcatgttgtacatgattcataaatacatttttatttgtcaattaaaaataccctggaatttgggcaacaaaagctatctgcccaggtgggaacaaatcgcctctgagcatctttccttcattgcatctctaatcaagatagaaagtccctggagagagggtctgattggacaagcttgagtccgatccctatactttggctatgagaggaatattcttgctgaagtcgtctgtgatagaccctgtggatgcatttggcttggaaatacgaaagcgccttgatttagaatcccctcaagtctgtctgttcacagtgggataatttttattctcttcctctccagaaggaatcaaggggtgtcataaaggaggtatgtctgctaagcagaactacctcccctccccaaagaaagtctgttaccatgtatacttttaaacattttattttaaaataaaattagactcacaagaagttacaaaaacagtacagaattgccatgtaacttttacccagctccccacaatgataccatcttatataactctagtacattattaaaatatggacattgacaccggtaaaatactattaacagaaccacatactttattctgcttttgctttttattttattttattattttattattttttgagacagaatctcgctctgtcacccaagctggagtgcagtggtgccattgcaacctctacctcctgggttcaagcaattctcctatctcagcctcccatgtagctgggattataggtgcccaccaccatgcctggctgatttctgtatttttagtagagatggggtgtcaccatgttggccaggctggtctcgaacgcctgacctcaagtgatctgcccgcctctgcctcccaaagtgctaggattacaggtgtgagacaccacgcccagcctgtttggcatttttttaatacgtgctctataatattgatttttgtgtaaacatgtgtttgtatatatctataacgagaactcaagtcatactgtaatcctattttgtaaactgacttttttcctttatcagtatatcaagattattttcccacatcatttgacattttttctacagtgtaatttaatggctacattgttttctatcctatgaatatatcaaacctatttcttaaaaaccctactcagggattttaaaaaataaaaacgatgttttaatattataaagattcagtgaggtatattcttatacgtacacatttctaaggtttgagttcttacaagatgctgaactagctaagactactggttctcatctgtcacatagggaaaaattatagaaggaaaacatcaagatttggaaaaatctgtgagaattgttttgcattagtgtgtaggtgtgtgtgttggggtggtggctgcagcttggggcagaggcctcaggtgtggctgtggagtgatcagatagagtttttggagttcggcttttgccccaggacacttggtgcctgcccccagagctgcagcccagaaggccgttctcagaggtgaagtccaggcagtgaggagctgtctgccagtaggcagttgaagaaaaaaaatgagctagaggaaaaaaacaaaaaaacaaaatctccttctaatgctgccaggctgccgggagctggaaatgaagcactgacaggagtgggtatttcatggtgaagggaataatcaactggtttttttggtacccaagactttccaccttcacacacacacatgagatgctttgaaataaagatagtcacttgacttagtaaagtttgttgacataaaaatatgagaaataccaaagaatacaaaaaggaaaacttcgttaatattattcagacttaaaattccagattgtatcaacattaagggggttgatgaaaacatgggagaaagccaagggacgtgagatcgggctcaattcttgacttgctgggggaaggtatcaacacagaacttttaagaattagaaggcattaaaaagaaatagaaatcctgaatcaaattgaaacagtaaaataaaatagtccaaagatgtgtaaatatatcactatcacaataactataaataggttaaatttgccagttgaaagaaaggaactattaaatgagattttaaaaatttggatatatgcttttcatgtgaacatacctaaagcatatacacaaaaccagaaaataaaaagatggaaatatccacagagtgacaaaggaaagctggtgcatttgtattagtatcagataaagctcacatttagataaaaaacattatagtaatagagaaagtcacaaggttaaagtttcaattcaccaagaaatatccattctaaacatgtatacatacccaattaagctgcctcaaaatatatatgacaaaaattgggagaactataaagtcagatataaggattgaaaagaaagaaatgaaactaattattttcagatgatatacacgtttacatgaaaaaactccaaagaatcttcaggcaaattattagaaattgtaggagagctccgcaagagggctggatataaaattaatatacaaaagtcaatgtcatttcactataccagaaaaaagacaataacattagaaaataaatctaacataagatgtagaaaaacttcttagaggaaaaattttcttgggaaatattaaagaagatctaaataagtagaattacataatattcatgcataagaaggcaacattttgaagacgtcttgttatacataggcctaggaataatatagttttaagctatattattttgaactgtagatgaagaaaagctctttttttccttgagtattttaagattttgaataaagtcatattgctctaggaatattttatacttctgccagcagtgtttgagaatgcctacttcctacattatcaccaccataaatgtttaaaacctgatagcacacagtttaaaaaatttgtaattctccaattaacagtgacctttaaaaattatgtttactgatctctattattttgtcctttgtaaatcttttattagtttttatgttcacatgttccgttttaaaatagacttttaagagctctttgtattaagaatattaaggctttgtccatataattagtatttttcagaataccctttctaggtacagtttttcagttccagtgcacagaatggaaacttgctacctgctacaccacattttcactagtatgtgatgtattcatcacaaacaacagtattggccaacattttccctcactgtgaagtgcacatttgacatcctttagaaaaattactgacggttttgagacgattgttctgtgctttctttcagtcagcataattttcccgaaagcagagatgactcttccagacttgctaccaatgcttgaacaaactgtgtaagcttagtccaaaaaaaatatttgattaatagattttattttggtagattctaaggttccaagcagtcagagaaataatcgcagagcctcaaatatctccaaaatctgataccaatccttttgattgtgaattatattctgtagctaccaaagaaggtaagtttttattttttctactctattaactttcccttggacaactgaatattaagatgactatgtaaggaggttatcagaccaaggcctcacacatcaggataaaagcacatgccatagaaagaacatttgtgtctcaaaaggtgataccaagacaaggctgtgggatatatatgggcacaatggttgataccttcaaagacttcatacatggtgtggaggtttttggagattttaatttataatgacaatctttccagttaggagaatttttggactgtaaagttagccaaacaacttttcaatgataataaatgtctatatcttacacagggggaatacagtttttgtttgttttagttttttctctgtctattcatataggggcatcatatgtctttatcattaaaaactgatttagataggcagttgtagagaaatttaatgtgtgggaatttaaagttttaaaaagatgtagcaaaatatagatacatttaagacccactgcaccaatgaaaaagggaaattaattaaactagataacttttatgggtactaaccattaaaattaaaattttagtcattgtaaattacattacattataatagttttcaatctattgttaagttaaatattttgggtaacaattgtatttcacagttgttcacactttgcataattttctaaggaaaatgagtcccttagggagaaaattgttcttaaattttattgttggataatgttgctgtactaacatggtttactgaagtggatctaccatgggtgtttaggtttttgttctttacaaaatgtattgggtgaaattttccatatcactggtgaacttttcatgctaattttccagtcccttagtttaaatattatgcattttttcctgcaaatctatcttgaatctgaaaaggccccagaaggaattagcgtgagtccagagtagatggactgcaaatgttacacatatttcaatatgtatccagctttcaaaaatagcttattgaaatcaaggttgaaccacatgaaattttgggtttttttggatgtaaaaaatggttatatattggcattttcatatcatccaatctaatatcttcctctagtgaggttctggcaaaaaaaaagtatgatgaccagagttgttcactcttttaagctttatgtttcaaaatatttttaaaatttaaaaccatctaagtgcatcccaaaaaacattggaaaattttgtaggctagttttgtttaacgatttttcttctatagatttatttttatgctatgccttactctccaattagattttagccatccaagaaaggtaccttgtacttctaagcaattctcccatcacctggacgttaactgcagcccacactgcagtgtcttgactgcagtaggcactcagtaaatatttattgatggtcctgattatgggatgatgaaatatgctaaaggtaacttaaacttttgtcaataaaaccgagtttcaggttagtttgaccttttccgtatctctaaatattttctttcatgtcatttttgtgaaatagctcacgaaagtacttattgattctgaaatccttttcccctctggtattcctgagctatcctcactcacacacagcacaccagtgctattgtttgctgttttgttaaaatcattctcattaatattcctcattcaataaaaatagttgattcccacttatgcaccaaactctattctaaagactgctgtttattttatggagtcaatatcatcattttgttttccattccacataatagttggatgccaatatgaagtgtatatttataaataatatgtgcttttatttatttgtttatttttattttactttaagttctgggattaatatgtgcttttaacattattgtttaaaaataacaggagatatcatatcttagcaccttctatattctgggcactgttctaaatgtatcaaagttatcatctcatttaatccctccacacacctgagggaagagagtattattccttatttacagataaggaagctgaggcttggaagattcatatatctaagatcacaaagctagtaaagcagccaagtttgagtctaaatccaggttttaaatatcatattgcatgtgggcatagatgagcaagaacaggttttcctgaagatggccagtctaaggcttagaagaaggaagctcggggagcctaaaccaagatatgctaaggcaagtttttttgctcgtttgtttttgagatggagtttcgatcttgttgcccaggctggagtgcagtagtgtgatctcggctcaccgcaacctccgcctcctgggttcaagtgattctcctgcctcagcctcctgagtagctgggattacagtcatgtgccaccatgcccagctaattttgtatttttagtagagatggtgtttcactatgttagccaggctggtgtcaaactcctgacctcaggtgatccgcccacctcagcctcccagagtgctgggattacaggcgtgagccactgtgcccggcctgctaaggcaagtattgaccattagaggagatgactagtcccagtggcaggcctttcctactgggagtcagccaagagctccccactcttctggttccattgttcctcctgcaaagttccattcataaagtggtttcccatttgattgtccaatgatgcaaatctccagtcctttttagcactgagtttctcatagccttttaccattgagtttctcatggctaatgaatgctaatgaattggcattccgatttatctataggattccatgagtcagcctcatgaaagaaggttccactccctcactgtgggtaccgtctgggaattagacccttaataggagtaattcagcaggcaatgtcttctctaataacactccagtctcactgagagcttctattcaaaacaacaatctaaaggtctacagtgtgactttcaactaaactgaaaaaagaatagaaaatgaatgtatgtgatgtacacattcattcaaatgtttatccctaaaattcatagcagattatgactgatcattaaagccaaattaagggggcaaaatgtataaaaacaaaaggaactcttaggcataatagtctttaaagtaaaacattactactgacagttgcttgtgtgaaagatatctttatttaatatggtaaaaagaacacaggaattgctagcacttaccgtatgtccattttatgtccaccttaaaatagatatgtctgtatagtcatcagattagcactttagaattcaataatttcaaagaaatcagaatggacattcattacatgtgcttatctggcaggagaattgaacaaatcctttctataggaaaatgtaaaattcctaataactccacaggattgtaagacttgggctggtaacttcagtgaatacagcagagtttgggcgatgggaaaaggtacagttgtgttcctaaactcttaactttgtgaggcagtgactttatttcttcttcatgattttgcagtaagttcagtacagtggttagtttcagtatagttcagtggctaagcttttgagagggacagttctatgttctaactcaacttctgccacttgttagaaagtgactcttgtcaaactattggccctttcaaacctcagtttcttcatctgcaaaactttattcatggggttgttgtgagggttaaatgaaaaatatgtaaaactcatcaaaattttaagcacaaaataccaagtctcagcagaacacatacagtaggagtccagccattaaaatttgaaacaggcagaggcaaaaatattttgtttagaagtacttgcattttctagctctttggctgagtggacaacattttggtgttctttttcttattgttattttttaaagcatacgtatatgttatgtagactcttttgtatgtatatttaactcacaataaatatttataaatagaaagaaagatatcacatatatgtgcacatacactggtaagccccaatacactgcctcatttctaaatgactctagcatttgtaggacagtgcttttaaacctttcgcactcacgagatactctggggagctttaaaatatatgctgatgcttgggctccacttccacatattctgatttaattgattaggggttcggctcaggcatcagtatttgtaaataaaagcttcccagctgattctaatgtgaagttaaaattgacggatactgataccgataaaagagtgagtgcaatagacacaaaacaaaataggagatgtgtctcaacaatggtaagattgttttaaaaattatagtacaattaaaaaaataatgtaatgcaattatttagaaaattcttacaattttgtattttgaaagcaccatgtggatatcatggggaaaaccagaactttgttggatttccttaacaaagattttgcagcttggtatcatttccattttgtagtattttgatatccaggagatgaaagtgggaagtggacaattgcctataaggccatgctttgcaccagggtgtccagatgagaggcaagtggagggtaaagtttagcctgcattctgttccctaaggtacatctcctggtgaggggtggcttctaatcaggggaagaagtcctatgtcttgtttcctaatgcacgcacaggttccacaagccctcactttgttctcaagagcatagcatttattttggtgcttaagactgctgaatgtcacaaaataatttttcccagcacaaacaaatattcaaaatagttatgtgcacagcctgtttgagcaccaataagttttggctctgtggcctgtttgggcactgacatggtttggctctgtgtccctacccaaatcttatcttgaattgtgatccccacatgtccagggagcgacctgatgggaagtgattggatcatgggtgcagtttctcccatgctgttctcatgacagagagtaagttctcaggagagctgatggtttaaaagtctttggcagtttccctttctctccctctctctcctgctgctatgtaagacgtgccttgtttcccctttgccttccgccatgattgttttaagtttcctgaggccttcccagccatgtggaaatatgagtcaattaaacctcttttctttataaattaccaagtctcaggcacctaaaccaattagaaggtgtgccattggcacacagcagggtcctggtgtctcccccaccatccagccaccactctgccaggtgtgaatgtattaactattgctggagtgaggtgaaaggaggcagtcctgcagaagggccactgccactgggatggcacaggagggcgctcgagagactcaccttagtgactctatcaactggtgaaaatatttagatattttcacaatcgatatggccttgcttgtatatacagggtgattataaactctcttgccacttatcacagaagtcgaagtttcatcatttcttttcctgtatttggtttatgtgcaacaatataggtttattttccagttctggaaaataatcatggttaatactgactgagaactgatcatttcctttcctctttataccaaccaatggggcaggtaccattattaaagggggaggaaatagaggttaaataacatgcccccaatcagtagtggggaaatgaaagaatcaggattcaaagccaggtttgtctgggtcttgggaccagctcagcgtctgtgctgtactgcccgggactcctgctgccaattctttctacctcattatccctcaaccctgcaccagcaaatccacagggcgtgagatgaagagaagagaggaccacaggcgagaaagtggcagcagcaagagaagatgtaccatgaggaagttctgggaggttctgcccgtctttctgagaacaggggagagacagagctgagttacaactgcactgcttcttagcttcttagtttctcttcagaattagtggcaaagaagagttttcgaagtctttagcatgtattaaacgaagaattttgtttataagaaaaaattgtggatcgttcccatgtttgtctggaaaactcttgttaaacttttgtgcagctagtaaattaagtcactgtttattctgtgtagtggaaagcatgcttaaactctaactcaggagacctgattccaggaatagttaagcctgagttcattataaaccacttaagttatctgtgtcattattctagtctgttaaatggagggcttgagctggtttcttgtaaggtgggatttggctaagtgctcttggatacagttgctcacctctttgagcctcagctttctttttggtgattatttaatcgcatgtgataacaaatacagggtgttttgtgtaatgcctggaatggcactgagattgtctccactacagtaaggaggtggtttagaaattagctaatttattaattaatggcctatagagcttcatgtaggttggtacttcaaagtcccattcatatggatcatgttcatatttatatattcatcacttttatttcaaaatctctttttctgctgagatcaactgagatttctagaaagcagtcctattgtcagcactttgcccagtacatttagtaagaacttgactagcattgactcaaacagttctcttagaagggctggcaccttttgtttcaatttttttaaacattaactgcccataataattgaagcatgaatgcactttctttggattatgaaacaaatcaatcacagacatgggaattaggtgtgttctcttgctttgttcaatatcatgcattttttttgtctgagctttcactgtgtccccagaactgtgcttggtgctaacagtggccccacagagtacggctttatattcaaggagatgacaatcttgttggaggaaaaaccttatacatagaacaattaaggaacaatgcaagggaaacacacattgcaagttttgattgtacctattttatggctatggtataaaacaaagcacctgttgttcctgagagtgaagggataagacaataactacaaaaaggtgaaatgagttaattcaaaagggaacattgagcatgtcattttcctattgaagtgctattatttggtatcggcttcctttggtggtgttggtttttgattccctctgccccggactctgttgtttaaagatgttctttctatgagggatcttggatgcattttagcagtgtttccactgccctttgttttatattctttgatgccatcccaggtacatcacattcttgctagatgagtaaaggtaagcatacttagaagtcaaaaagaaaaggctgaagtggtgacttagacttgagaaattatagattccatggagaaaactgtgtttaaatcacaggacaggctgaaaactcacattaccacctgatggaagtgaactctacttttataggttactaggagaaggtcagccttctgtaaaagcagataaacaaggataccattaccagagtttcaagtaatttaaattaagaactgaacattgatactgatatgatttctagtttattatctgtgacagaacccagtagcttattgaaaaactatcatggaagaaataactaagaaataaccatttaaaatatatcaggatataatgaggatgaagctttagataacacaaaaaggcaatttctctttaggctgaaaaataccagacacagatatatcgacagagtgacctgccagaatccctactttccagcccatctgataaaggtcaacgattgaacacccaaacacgttgatacacacagcacctgcctgatgaaaaccgttaacagtgtttttctcagcccagagtgcactgttttcttaaagttttgaaaacagtaatctaaatttccctattccatgagtaaagttctacttttttctttttcacactaaacagcattcgatgttttagctgaaagtcaattaagaaaaatgtattgtgtctgtgtttttcttgctttcttttaagcacctctaaaagaacttgttcttcttcctgaattgagaacgaggtaggaatgaaagactgaaacggtaactctcatcataattttattattatgacaagttgggtttatgaagtatttttccaattactgcctccaattgttaaataggtagataacatgccagctttaactgccaaaaacttgtagtccttaaaatattttttgtagtattactattagtatcatgaacagaaatagcagtgataaaaatcaaatcaagttttgtgaacaccaaaattccatttgcctgtgtgtggagggtggtttaggattggtagaattaatattctttgcaaacggctgcacctagcatggtcgccttgaagccctgggagttctctaattttcctggctcgagagacttccattaaacaagaaaatgaggtgggaaaggtcagaggattcacagggtaacaggaactggacctgaacctgagcttcatgcagtccgcagattttttaagtggtttgttttttagaagtgtttgtcacgacctctaaatcattgttaatttcatcgttaaactggcctcagagagattttgttttaaagagacaatgcagttagaggatcgtgatctctgaactcagaagcccagaactccaaagctggaagccaccagatcctagcaagtgaagctctgtcaatctggagccgcagattttgaccacgtgtgcacagccttccatctgggcaagcccttttctctccaccactccactccacagctgctgtttcttttcttttctttttttttcgctgaattcatcatccctccctttcccatgccgagacttaaaaggtttcaaatacttcaaaaatcaatgatttctaaatcacctcagatgacttacatacaatgttttattacattttcccagagcagaatggcatattaagaaatggttttattttcaactatattttctcttaggaatatagagacattatctcaaattattacctcgaagagacagagacaagaattttgcaccattctagttctcaaatcattttaggtattttatttcattttgcctaaatctcttagacggttatttcctcgtatcacttaaaaattacattttacttgggcagggcctaaagaattacattgaaaaactaagaaattattgggaaaaaattccattagcacaactatcatgatcagaagaaattggctaatttcagtgtcttttctttgggctcttcatagaaaattgttgaaatgtgtctttcataagtaactggcattctgaaattgatttaaagctgtagaggggaagaaaagctacattggaaaaattaaatcttaggtttggagatattttaaaaaactcaacaagttccatgcccagaggagtgcagacactgaccctctttttcagctattagaggtgaggaaaaaaagttgtgtggttggtgtggagagagagagacacacgcacttcctttagccatcatcctactaacaccttcacagtacattttcttgctaataatcccaaccatttctacagggaaaagtgcatgttcctgttctctggtagaagggccacccaaggaattcaggttcctggtgagtaagaatgacagaagtacccacagctcctgggccattggtctcctctatccagcctccactgaccttgctgggtccactgcagttttcttcttgatttaactctatgagctctctgttccttcaaagtactggagcttctggccttagcacatctgtttctgcagccagagcaccttcactgagaagcagacctctacttggctgggttcttactcaccctattggtgcctcttccccatccccctcctcctcctcctcctcctcctcctcctcctcctcctcctcctccagggaacatatagttggcagcaagggttgcagaacgaatgaaggcatgcatgaatgcacatgttggaggacgaaggttctgtttttactctcagtgcaccaaaacccagcagagttaaatagtggaaggttcttaagtgctcaagtgagtagatggaggtcataaggcaagcagagtgggaagggctagaaggagaagaaaggagaaagggaaggcaggagaggagagaggtggggaaaatggaagggtagttgaatgtcatagcaaattagagttagaagaggagaattagtagaaaacagagctagagtcaaaaacagagtgagacagacagaaattcatagatttgctgtctggcccagatctcattggataactagagcctcccttcttcctttgggttgaatggtctttactcattctttatgtagaccatcctttacttccacatggagtttgtatgttcccatagacaccaatactttacatatcagaacacttgtcattttattaaaaattgttttttattagtttcttttcccactagacagtcaatgtcatggatgcaggactatagggtcttatctttttcatcacagtagccctcgaacctagcacagtgaaagttgcccataatacattactaaatatttgttgaaagcctaaagcactgggcaaatcattttgactttccagacttcaggatccccatttgtgagggagctggtctatttgatacctaagactcccctccagcacaggtcttctataattttgtatctacatggcttcctgcctgatgccaggaacttaagatttaactcaagaagacagggatgttgcttgcaaagaccctgaagatcttgtcatccaaactgtgactgcctggagactgtttatacaggatcttgaactgggctaggagagtgcaatggatggtagtcccagtccttgtttgcagggagaggaagacagcgacaaagcatttctatggaaagaaggagttgctcataagtctactatggacatcaaaatatgctgatgagccacagcaagttcattacaaagggatttcagatagaagcctcctccttcagagtgaggaggaagaatcatccaggaaagagagaaattatgtgtatttcatatattgctgtatgtacatattaatcagccagcaaatattaagtgcattcatgggcaaaatgccaaagagatgaagagaaaaatcagactccaaggatcatataatctgattgtggaagaaaggcatattcatcatgaaaatgtagcaaagatgttaagtgagtgtcttagtctattctgtgctgctataaaaaatacctgagactgggtaatttacaaaacaatttatttctcgtggttctggtgactaggaagtccaagatcaaggcaccagcagattggttgtcggatgaaagttcagtttctgcttcatgcatggtgcctccagaggacaggaacactgtgtcctcatatggcagaaggtagaagggcaaaagaggaaaaaccctttttttttctttttttttgagatagagtctcgctctgtcacccaggctggagtgcagtggctcgatcttggctcactgcaagctccgcctcctgggttcatgccattctcctgcctcagcctcctgagtagctgggactacaggtgcccgcccgccaccatgcctggctaattttttgtattttttagtagagacggggtttcaccgtgttagccaggatggtcttgatctcctgacctcgtgatctgcctgccttggcctcctaaagtgttgggattacaggcgtgagccactgcacccggccagaaaaactctatcagttccctttataagggcacctaatttcattcatgagggaagggccctcatgcctaatcacctcttaaagccctgcctgttaatactatcgcactggcaactcctgagttttggagggtgcacattcaaaccatagaagtgggataagccagacacttgggtttcctatgggtcctctccatttggttttcctgttaaagatttaaaagagcagaaacactactttattagagaaagggcatttgaacttggcctttgaacatggcaggatttggccacttagagattgggggtgccattccaggtagagagaagagcaaggagaatggagagcacttggcatttatgagaatagtgagggttcatgtcaggttacatgaagctgactcatgacaaattaatttggaaaggcaggttgtgaccaggctaaaggcatctggactttgctctagaggaaatgtgaaaccattgcagatttctgagcaagctgttggccagagccgtgcttcggggcgactcacaacagtggtaggaagctctttgggagctgggagagagagagagagagagagagagagagagagagagagagatgggaatccaggggagaacagaacaagtgagaaagcagctgcattgcggcccaggctggggttgctggtttctggaaagggggtagtgttgggggagtggggagaggggttaaatgtgagcttctgaggaagtacaggaggggtgaattccaccatggagaaagtattcaataacaagcctacagagaatttgaggaaggtggaggagtaaaggacaatgatgtcctcgagaaacctgctcatgaaacctgctcaagaaacctgaggaggcaaaagcctgattctaaagtgtgagagagcaacagcacaacctggggaggtggggtatcaagtccgaaccaagggtgaagggcagggactcaggtgctggagtgtttcaatgtggatcttggggttggcacttgcttgctgagttaccttgggcaagttactatgtggtcttagtttctgtaaaatggagatcatgatgtaaccacttggtagggctgttggaaggatggaaggagttcagaaacagaaagctcccagcacagagcctggcccgtaataaacagtctatgtgtttgctatcacgagggtacttttaaagaaatttagtgcagatgagtataaatgagacgtggagtgagtagcagaatcaacacaaggtttttcttataatggatgagagattgtaaaacacatttgcattggggagaaggacacatgggagagggaagaaatggaagacacggaagatttgttggaggcaaatttagatccacgacaaaagtacgggagtaagtgcatggggaaaacttagtattggagggaggaaaaatggcctcactttgcacttcgaataacatctactttctttacctggtcctccaaaggccaccagggccagcctctggcctgtttctttagccgtaactcctccattctcccccgctgccatttgcacatcttgcattttctcagagctgccaagatggtcgtggccgggccttcctctagctagcctatcttcctgcagagcccttccctcagcttcttacttggctgaatctgttgtcttacccagctctcactttaaattccgaagtccttccctgaccgtcaggtccaaagtagccattcaacattccttacattacccgtttttccatctttacatggcattgatcttcacttggtgattccttgtttatttatttattggtgtactgcctgcctctcttcaccaacgtataagcttcattacagcagagacctcttgcctggtcatcacagtatccttggctcctggcacatggtaggagcccagttaaacgtttgttgaataaataaatgaatacatccttctgtaatatgtgagaaaagtgggaggcaagtctaggtgaagaaggcacttaaaaaaaaatttttttttgagacagtcttgctctgtcacccagactggagtgcagtggcacgatcttggctcactgcagcctccacctcccggaatcaagtgattctcatggctcagtctcctgagtaactgggattacaggcttgcgccgttacacccagctaatttttgttttcgtttttttttttttttttttttttgagacggagtttcactcttgtcgcccaggctggagtgcagtggcgcaatctcggctcactccaatatccgcctcccgggttcaagcaattctcctgcctcagcttcccgagtagctgggattacaggcctgcaacaccatacctggataattttgtattcttagtagagatggggtttcaccgtgttgaccaggctggtctcgaactcctggccccaagtgatctgcctgcctcggcctccaaaagtgctgtgattataggcatgagccactgcacctggccggaagacagattttgaagtggagaggagttagaggaaattgagtcatacttaattttatctgaaaatcatgaagtaaaataatacatagaaagtgaaggggtgaacttctgggtgtatatattcaatggaaataaaatcagtgtcaaaggtttctctgcacccccatgttcactgtagcattatgcacaatagtcaagatatggaatcgacctgagtgtccatcaacagatgaatggataaagcaaatgtggtatgtatacactgtggaatactattcagccttaaacaagaagaaaattctatcacttgtgacaacgtagatgaacctggaggacatcgtgctaagtgaaaggagccaggcacagaaagacaaattgtgcatgatctcacttacatgtggaatccaaaaaagttgaactcgtagacacagagaggagaatggtgggttgctggggaggaaatggaatgcggcagaaaggggagatattggtcaaagggcacaaagttttagttagataggaggagtaagttctggagacctattgtgcagcatggtgactgtagttaataatgatgcactgtatacctaaaaattgctgagacagtagaacttaaaagttctttttaaaatttttattttaggccaggtgtggtggcttatgcctgtaatcccagcactttgggaggccgagatgggcagatcacctgaggtcaggagttcaagatcagcctggccaacatagtgaaacctcgtctctactaaaaatacaaaaattggccaggcatggtggtgggtgcctgtaatcccagctacatgggaggctgagacaggggaattgctcgaacccaggagatggaggttgcagtgagcctagatcatggcactgcactccagcctgggtgacagagtgagactctcaaaaaatattattttaatttttataaataaagacaggttctccctatgttgcccaggctggtctcagactcctgggctcaagcggtcctcccacctcggcctcccaaagcgctgggattgcaggcgtgagccactgcacctggacaacttcgaagttcttaccacaaaaaaatgataagtatgtgaggtggtagatatgttaattagcttgatttaatcatttcacattgtatgtgtgtatcaaaatgccacattgtacccaaaaatatatgcggtttttatttgtcaattaaaaaaaagagaggggactataggcacacaccaccatgccaggctaatttttttgtatttgtatttttttttttttgagacggagtcttgctctgttgcccaggctggagtgcagtggcaccatcttggctcactgtagcctctgccttccaggttccagcgattctcctgcctcagcctcctaggtagctgggattacaggcacatgccaccgtgcccagctaatttttgtattgttagcagagtcggggtttcgccatgttggccaggctggtctcaaacttctgacctcaggtgatccacctgcctcggcctcccaaagtgctgggataacaggcgtgagccactgcgccaggtcatttttttgtatttttaatagagacgaggtttcaccatgttggccatcctggtcttgaactcctgacctcaggtgatccacccacctcggcctcccagagtgctgggattacaggcgtgagccaccatgcccgccctaaaccttttttaaaaatatgttttaacattctttgtgctcaaattcatgatcaatttttttttttttttttttgagatggagtctcactctgtcacccaggctggagtccagtagcacgatctcggctcactgcaagctctgcctcccgggttcacgccattctcctgcctcagcctcccgagtagctgggactacaggcccccgccaccacgcccagctatttttttttgtatttttagtacagagtttcaccgtattagccagaatggtctcaatcttctgacctcgtgatccgcccgcctcagcctccaaaagtgctgggattacaggcatgagccacggcgcccggcttcatgatcaaattttgtaaatggttgatggatagatgaaaaaaattctctaattgaaagacataaggatcactgtatgatcagcaaatgtagataaatgaatataatattgattcacttctaaaagaaatatattgatgtctcccactataattaaattttaatcaagttcttggacttctaaatagtttttgccttatatatttggctgttttcacgtttggacgcttcactttattaattattgtatctcctttgtaagagtgtaccattcatattacataatctctctatcttgtttggtcaggttttccacaactaatcaaaatgccttggtattaacgtgactctttttcaaagtagcgtggacaattttgctgtcatcatgtagtcctgggtctttgggttttatctttctaagactgtagatctcaatcttgagtttatcaatataatctataaaaaattccaaattaagccaggcatggtggctcatgcctgtaatcccagcactttgggaggccgaggtgggagaatcacttaaggccagaaatttgagatcagcttgggcaacatagtgagaccctatctcaacaacaaattaaaaaactgctggatgtggtagcgtgcaaatgtattgccagctactcaggaggatgaggtgggaggatcacttgagcccaggaaattgaggttgcagtgagccatgattatggcattgtactccaggttggagtacaaactttcagcttgtcactgaaaaaaaggacactccatatcactttttgccattttgtgtgtgtttacacatctatctatccacattgtgcttaatttggactttacaaccaagtgatttttctccattataaaagaaattgcatcattttcttttttttaaaattttactttaagttctgggatacatgtggggaatgtgcaggtttgttacataggtatacatgtgccatggttgtttgccgcacccaacaacctgtcatctaggttttaagccttgcatgcattaggtatttgtcctaatgctctccctccccttgtcccccaccacccaacaggccctggtgtgggatgttcccctccctgtgtccatgtgttctcattgttcaactcccatttatgagtgagaacatgcagtggttggttttctgttcctgtgttagtttgctgagaatgacggtttccagcttcattcatgtccctgcaaaggacaggaactcattcttttttatggttgcatagtattccatggtgtatatgtgccacatttcctttatccagtctatcattgatgggcatttgggttggttccaagtctttgctgttgtaaatagtgctgcaataaacatgcgtgtgcatgtatctttatagaataatttataatccttttagtatatacccagtaatgggattgctgggtcaaatggtgtttctggttctagatccttgaggaattgccacagagtcttccacaattgttgaactaatttacactcccaccaacagtataaaagtgttcctatttctccatatcatctccagcatctgttgtttcctgactttttaatgatcgccattctaactggcgtgagacggtatttcattgtggttttgatttgcaaggaaattgcatcattttccactgaacctaagttgcagttccattctgcctaagaccaccaaactcacctgccccactgttataccttctggatgtcagtgaaagttcatggacaagagaatatttgtaaaactgcattggatttctgttgagaaatgctatgttttcaaaaggtgaaaaaatgtagacatgtattttcagaccttttatttttcaatcatagcagtggaattccttgatggtttatgaaaataaatgtttttctcactcctaggccatttaaaaatatataatatggagttgaagttattaatagaaataactaagggtgagagagaatggcacttgtactattgagtacaatattagaagcaagtgctgttatattgccagactatataaaataacaagtgtttctagtgcactgagtgaatgtatggtttagaaaacattactaattacgtgcgtattcattgatttattcactaagtactcactgagggtctactgtgtacctgagtctagccagaggcttgtggtggagagctgagcaggtcaggtccaaacttatgttcttgctatttctttgggtgtgggtggttggatggttagctcagtggtctcggatgctggaatttgttctaataagtttctgagctgcttcataaaccaagagggttaggggaactatagctgagtcatctccttttcctcctcttcctccttcttcccctcctccccaccgtctgttactactattataggaaatttgaactggaatgaaaaaaaaatcagtgttacaaaaatggtcacattttggaataactctacacttacatagtgtgttctagtgattagaaacaaaaaagccatcattttaggctagatttttcagaatgatcacaatgctaccactgttttgcacttaccttaaaaaataaagtgcttcccctaagtttgatcatttgcttgttagcataatttggccattaaacattaagcattgtttgagacccgtaagtcaagccaggctatggtgaaacaaaattagcaaaattcgaattgatgccggaaactggtgaagccgccatagatttaaggaccaatttgccaggttaccgtctgcaggttctgctatggaccaggtgggggcagcagagagctggctgtggtctccagaagggaaggccagcacctgcctgcagattccaaggcacaggtggaggtggtaatgagttacgaggtagagtcaaggtttggactgcatctgagaagggaggaaagcaagagagttagaaacaccataaagatgagactgcagagcaagccagaatggaagtaggacaaagaactggtgtaagtcaaagagcaaaggtgcaggggtcacagggaggagaggttgggtgggcagacaggaggtgcccgaaggaggccagcctgcttcactagtgccccttccagtaccttcccaactcggtgagccaggtccatacttggttctgtttggtcttccaagggctatgaagggacagggatgtgagagacaccagccatctctctctcctgagctattaataatgaaagttcctgttttatgaacaaatactgaaatgaatggagaacactcaacaatttggtagcaatcagagtgtggtagtgaagcattgcctgggcttttccttctggttcctgcaaaggactaaggtcctcagcagcctctgtccatcttttcggagatttttcacaatcaccaaggaaatatagttcagtgctcctgtttacttaatggtcggctacgcttgaaatatcatgctctccctgtgtggtcttgtcataattattttcaaatggtgctaattagcagacccaacacatgggcagccttccttccccagacttggcaccctcactcgctgcatttagcacccctcatgggaaggcatcctggagatcccttatctgcaccctgtctccatctaccccttcccactcgcggaagctgcctcaccagagaaactgctatctgataaagaacatcaacaagtcctagcagatggctgcttatctcaagacacatatattcaccaaaatcctagcagaagaaaaagctgtgtttggatggtccctgagagctaactataacatgttcaaactgtgtaacgcagtttggagatggagacagagtatggagaaagaaagacaaagggagaatacccaaaagaggttttggaaaagaagaaaaatttgttctttatacatatatatccataaagatgagggtctcactctgtcatccaggctgatctcaaactcctgaactgaagggatcctcctgcctcagcctctccagtagctgcaactacaggtaccaagctgagcaagaagaaaaatttgagttaggctttagaacatcaaactaagactctgattttcttgagaaagtggatagaaaatttgtggttagagatgacaccagtaacgataggtttctactcttagctatgcctggggcagcttgaccgccactttgttgatcacattaatttacctcttcctgcctttatttccctttctgtaaaatgggaattaatgtgcttgatgacaatatctccaaatgatttttaaggcaagaagagagaatgttactgacaggcccatggttctctgggtgagagggtcactgtgaatgaatgtacacacagagccttttattagtgaggcttagggtgtccggtttttcttggcggagtaaacatccacccagtagtattcactcagtttgcattgttctgtcgcattgtttgtaaatcttttgagtgattacgcagcatttgttccctattgttcataatactctttaaaaagctgactataggactccagtccccactggtttgttctttgccacttggcaaaggttgattgattttatttttcctttggcctgtgcttcttagtggcttgaaatgaacacggctttttttcctgtttacccctttgcccacattgtcaataatagagtcgccctgggaagcagagtttgcaaagggaggagggtttggtataaatttggaagattgtattgtttcagatttattttctcaaatgctgaaactgcttctcaggggttatacttctttactcatgaaaactcacacattctcttaggtggtactgttaaacatgttacatttgtaaaaaaattaataaaacgtaatgaaagaagcaggaagcaagtgtatacacatggtggcctgagcaattggctgtcatggtttggtttgattataggtgtgtgaggcacatgtatggtgttgcgtggaacagatggatagaagtggtaaaaaagatgaatccaacctagtgcttttcaattctccttgcacatgagaatcacctggagaattaaaaaaaatacattgatgccgactgggcacagtggctcatgcctataatcccagcactttgggaagctgaggcaggtggatcacttgaggtcaggagtacgagaccagccgggccaacatggtgaaaccctgtctctactaaaaatacaaaaattagccaggtgtggtggtacacgcctataatcccagctacttgggaggctgaggcaggcaaatctcttgaacccgggaggcagaggttgcactcaaccgagattgtgccactgcactccagcctgggcaacaaagcgagactccatattaaaaaaaaaaaaaaaagttgatgcctgagtctctccccaaaaatcggaacatctgtgggtgtgggttcggcatggatatttgtaaagtctccgtagctgcaaagccaagttgggaaccactgataaccaacagaaaaatgcttctggaagtgtttccggggaaggagtcctagcctaggatcagacacctgtctgggctcaatacaaaccactggtttttttttttttttctgagatggagtcttactccgttgcctgggctggagtacagtggcgcaatctcagctcactgcaacctccacctcctgggttcaagcgattcccctgcctcagcctccagagcagctgggaccacaggtgcatgccaccactcctggctaatttttgcatttttagtagagacagggtttcacactgttgaccaggatggtcttgatctcctgaccttgtgatccacccgcctcggcctcccaaagtgctggaattacaggcatgagccaccacacccagccaccactgggttttataaactctcagtaggcctcctcttctggcctggtcccatgctatctgacccttcttgacattcaaaaaaagtatttttctttagttgaactccaggaacatgaagtggcattaaacagaagtatgaattgcctttattaaaattgcagtggtctttttcttaccaaaggtcctgacccagttgtggaaaaattgtttcttgaatgtgggtgacacatctgtttcatatctccaaggcaatgcctcagagccaactcctcccccgtgtgactcaaggatgccacgtgtcccacatgtggcctgttttcttctcttaacatggcctaaaaggcccttattgaactcccgttagctttatttatttatttttgagatgaattcttgctccgtcacccaggctggtgtgtggtggcgcaatctcggctcaccgcaacctccgtctcccaggttcgagcaaatctcctgcctcagcctcccaagtagctgggactacaggcgccttccaccacacccagctaatttttgtatttttagtagagacagggtttcaccatgtcggccaggccaggctactctcaaattcccgacctcaggcgatctgcctgcctcagcctcccaagagctctccttagctttgaaagtaaaagccaaccccttttggctggcccatgaggccccacacaccttagcattcctgttacctctaccacctcctctcctaactctgccctttgctggtgccaatttgactgcactagtgtcctttttgtgactgcagctgtgcctgggacactccggtctttgctcttgctactgttctgagctgtttatgtccagaatgctcttccagcagttagctacttgtttcctctgagtcttcaggtagctgctcaatatcagcttctcagtcaccctgtctgatcacctggcttataagtccagtccctacccttgtactccccatctctaatccctgcttaatcatcgccttagcactgtcaccatctgactttctttctatatatattttatttattggttagctcggctgcttcaacagataccataaactgggtggcttaaaatcagacatttatttcccacagttctggagggtggaaatctgagatcagggtgccagcatggtctggttctggtgagggcctcttccaggtgcagacagccaccttgctttttttcttttctctttttttttttttttttgagttggagtctcgctctgtcacccaggctggaatgcagtggtgccatctcgactcattgcaatctccaccttccaggttcaagtgagtctcctgcctcagcctcccgagtagctgggactacaggtgcacaccaccacgcccagctaatttttatatttttagtagagacggggttttgccatgttggccaggctggtcttgaactcctgacctcaagtgatccacctacctcgacctcccaaaatgctggggggtcgtgagccaccatgcccggccagatggccaccttctccctgtgtcctcatgtagcagaaagagatcaaagagctcttttgtttcttttatgagagcactaatcccatcacaaggccctgacctcacaacctaatcaccttccaaaggccccacttcctgtcgccatcatattgggggtttggatttcagcatatggattttggggggacacaaatctttcagtccgtaatagttggcctcctcccttgttccactagaatataagcttcaggaggtcagggatctttgtctcttttgtttacagctatgttcctaacacctacaacaatgcctggcacatggtaggtgctcaggagataattattggatgaaaaaaaatgaaccggtctcctccttaacccctgaaatcctgttcgagtcgctgggtttgccttgctccactgggatgaagtcctggcttggtgtccttgtctcccaggggtagacgccccgtctctgggaggacttgaggctctcctggcctgctgcttggcctccttacctgttctgcccactcagagccctgccagctgcctgggatggctgccgggcacgtccttgttcctgctcagtcaaccagttggggccttggtttggaccttcacttattcttctgtgaacctacctctctggtccccagctcgtcttctgaaattttgatgtgttggtcaagcccagtcttgtttgcacatccctgtgaatgattcttaattatatttctggctggctctgtgcagtagaccatagaaataacgattgtttctggggttgcgctggagtgtgaacaggtggggaaaatgcctcaggacgattggaccgaggagactctgagatgactgatgaaagcgacagcaagagctttccacgctcctgatggcaggaggggacggcggtgctgaggggtgggggaggctcagggggagctgttgagggtcccgtgctcgtcaattctctagcttctcaggcgccttgatcttgtcatttagaagcctctggaagcacagggactgtggaaactggaagctgttcttggactatttcgcaacacttttctccaggaaaaagaaaaaataaaaaaaagcctcattctcttcgtccccaatgttacataatcgaacatttcccgtcctggttgaaatgaatatcctctttgcctgaataaataatgcacagattcttcgggacaggctgcttcctccaggccgccgcttccaagggatccggtcgctttgtgggtttagtggtggcccacagctggacgcggggtccagcttggggtgggggaggcggtgctttctgccaaaatgtcttttaaacgtctcaacaagtagcaaacaaggccccacctgcgacagttgtagtgattccggaagacctgctcaccacgaggtgctggggtcgcttgcagctggcagtctccggtggctgcagtttaaataaatctcctaagtgcagaatcaccacacagggcgcggagaaactgaaaagttaaaacatctggagttacaaacactcacaggcctatcagctgtctgagtccccgtaggaaaactgtttatcggatgctttagtattcaaccttttatttcctagcacaggttttttgattttcacatggagtgtttgattattttcccatgcccaagtcactgttttcatagcctgttgtttaatctgtgtgcacctttgttttcactctatttcctttgctttcctatatgagaaaaataaatggcaccattgaattgcacggtagaggctgatgctattccaggtgctcaggttggctttcccatctttcgtttcctcctgtaggaagttttttttggtataaagggaaggacagaattggatctccctggagggagtttcatgtgtttcttattctgagctgccgggagctggttcacagcacaacttgataattgctgagtagacctaaagttttgaaaatcaagatctctttggagttttacaagtaaaatttcaaaaatgagaaatgactatcccaatttattttagaagaaaggtgcagcttgtaaactttcatgaatttggtaaaagggggctaatttgaaaaggaaaactaataggcaatatttacaaattgtgaaaaatatcagaatagtatacgtggaagagttattagacattccatttgcagtggtaaacccattcctttgattctgaatcttgtttaggtttccttaagaatttgatgaagttttcagactcttccttcagaaaaatgcacatattcttatgtacctaaatgtttggatatgatttcaggggattccaaatcccctggggaccccccatgtggatgtttgtgatgcagaatggggtaagaaaaccaggagagcctacaaaaattttatgaaatagaaatatgaacatacagtactgagccaaaatttagttgtgaggaaaatgatgttaaatgcattcattttctaaatgatgacagaaaattagactcatattactatccgggtgaagcatattttgtacttatggtgacctagtgatccaaatgcctgctctttggtcttatcctcttatcttccttatgtcaatactgggctgcttaaatatgtactgtctccgatgtcattatctagttttgttctttgttttctatgttttatcttttacttcttgttcctatttcaaatactttgacggtattgggacttggggacatgtcctttccagtacagattttggtattgtagagggaggtttacaagcccaggtgggtgtacttggggactgaggctgctcagtagccctgtaaatggtcagagtctgctgtttctgttgcttggagagcaaggtgaatgcaggtctctttggatattggggatgatagagggatgtggattggagaggaacaggacttcctgccccctcaatttaaatggagattcatttgatcaaaaaaaaaaaaaaaagcacatatattcaccaggccctgtgtgaactaccaccttggatgtaggtggagtaagccatattcccaggtagcctgcaatcaactgcaatccattggtggtaggaggcatgggagatacagaagtaactcaggactagattgaattggccacttatctaagagtgttatcaagtgttctgtaaatgtgtgaattctgattagttatcaggttgtcatacatttttttttctttttttttttgagatagagtctcactctgtcgcccaggctagagtgcagaggtgctatctcaggtcactgaaacctccacctcccaggttcaagcaattctctcacctcagcctcctaagtagctgggattacaagcatgtgccaccacgtctggctattttttttttttttttttttgtagttttagtagagatgggatttcaccatgtggccaggctggtttcgaactcctgagctcaactcatcagcccacccctgcctcaaaaagtgctgggattacaggcgtgagccaccacacctggctacgtgtcatacaattcatttgtctcccttcctagacacaagctcctcaggatcatatctgttcttccttgctggcacagaggagatgcttcagtagtgcttgttgctagaggagaagggtacaagtggcatgtggagagattcagagaagggtagaataggatgatgttgggccatcaggaaggtctccatggagaaggtgtgctttgagatgaacactgaggaagtggtgggatcacacctgacctagatagagaaggggctgaaatccaagcataggatggtgggagcagggaaagagaggttgactgaagttgaaggctggagaggttggctggagacgggtgatcagggatatggtaagtggtttgtgcttaatttaatcttgcagtaacacggtgaggatgattaatcgggaacataatctggtgaaggtatgttggacggattcgaaatggtagaggctgtcggcaaccagaccaattaggacaccattgcaaaagtccagctgagagctgaagaggatctgacttgtgacagggagtaggacaaacaagggatggaggctggaggtattttggagatacagcctgcagttcttataatccaaacttccccagaatatctcagcccaggaataaaaataggatgaaaacaacaataacacaataatattttatctctgctttctatcaactgtttgcaacctgcaattctttctggttcttccttcctgcggggccaggtgaacaggcaggtgctgaatatcactgctgggctcacagaagcccccagtgctggggggccaaggctgcggctgctggtgccaatcaaaggcacccataggcaggaccctcttccactaggtttcattgcaaacgggaagcctcaaggcaggcgctttccactgctaatcggtacctggtacaggaattaaggcttcactttgtttgttctgaggggtttacagagatttttcttctgtaaagccactgctcctttcactaaaattccggagtttgtgcaagctgggaagttaaacttagcaacagagtctctgctgtatttaaatatcatttttgtctgacactggcctctttttttttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccactggcctcttgtccttagaggaaatatgtgaatttctcctttctgctcagaagtacaccttagtagttgacaaacgtaaactacccgaagggccagccttctctggatcctacttgagaccttgcttcctgctgagaagtgtgtgcatttgtgtatctggtgatcgagatgtctggaagagtggggagaagactgaggggcagatggggagtaagaagggtcagaaagctattttggttcagcagtatcaataatgtttttgctttaaatcattgtcttcttcaatgttgcttcctttgtcactcctgtaaatatgatagcccatttattcttctaatagaaaatttttcataattatttcctcacataagatgtttatggctttatatatatgtgtgtatataaagaggaggcacataatttatgaaagcagattttaaaagcctttctacagatgaaatgtaaagttcaattgcattttttcttttggagatgggtcttactctgtcactcaggcaaaagtgcagcggcacgaacgtggctcactgcaacctcaaacagttctcccaccacagcctccaggtagctgggaccacagacatatgccatcacatccagctaattaaaacaattttttttttttttttttttttttatttagagacggggtctttctacattgctcaggctagtcttgaacttctaggctcaaatttcttgatttcttccaaaagtattttctgcttgacattgtcatttgaagaaagatagttttaaaaaaatttgaagaaagagactatttttatccctataagcttgaactagggctttcatactgagtaaaagacagtatacagtgtcattgaggatgggtcatattatggctccgttgtcgaacactctagatctggacactgaaaagtggactactgatggattttatgcctctgctataaaaaccagcacctggggctggacgcagtggctcacgcctgtaatcccagcattttgggaggccgaggcggccggatcacgaggtcagcagatcgagaccatcccggctaacatggtgaaaccccgtctctactaaaaatacaaaaagaaattagccgggcgtggcggcgggcacctgtagtcccagctactcagaaggctgaggcaggagaatggcgtgaacccgagaggcggagcttgcagtgagccgagatggcgccactgcactccagcctgggtgacagagcaagactccatctcaaaaccaaccaaccaaccaaccaaccaaccaaccaaccaaccaaccagcacctaggccctggatgcatgtttaaggtagctaaacactcttaggttacactattctgatgggaaagaccaccagaggtgcccttggatacctggtaataagggctatagaagaaattatggaaattctacaaccctgtcagtgactatagccaaccatgcggctatagccagaccctgcaatgtgctcatgggtccagagccccctatgtgttatctcagctcatgggctttctctgttcctgcataacttcacttgctaggaggctttccttactttggcctccatgccaccctgagacatgcccttgtcctttgcggctcatgacctcagtgcaggtttccaaattcataccctcagagcttgaatgattggtccagttcatctttttcacatttggtcatgtcctaggtcactggccagtctatagtttggctgatctttggttgggtgtctcaccatggtccagttagctgtgatctgaagtgggcgtagggtggggaggttgtatgaacttgagttggttgttcaagtaacaggagctgagagcatggcaattttccttagaacgatagtgagtgagtggtcaggtactgattgatatctccaggtaagcagagtttcaattttggttgctcttcacgaggaaagccagaagcccagagctgttttgctagagtgatagaactgagatagtgttttgagcagtgcccagtgggaacatctttgctgagaagaacgaataaagaattttggcaattaactatgtaactgagtcccagactctgctatcatctggggtggcagataaaaacacacagtccaaataaaaaacctgattttttattttagcctgaatcacccagatcacagcaggattttgcttgaacaacccagacagattgcatccattttctgctttactgtgcttgtggaagccaggctgttagtggtttcttctggaatgggagaatgtatcacaaaaaggttggaacctgaaaaatttctagaatttcattgttctgtgcttcttaataaacaatgtgacactaccaaggaatgtgtgttgaccctctttttttaaaaaaataaagatgtagtggatagcacgattttgatgaaatgtcaggctttatttttcatttgaaaaatgtgtgtgagggaatcaggtgtaatggcatgatacatctctttaaattatacttacgagattaaatttgtcctgtgtttcaattacactgtattatactgcttcatttaaattgttgttttcttcttttttaattgttcaacctaattgtctaatagtgatgaatgcaatttaattagacacttttccttgaaggatatatatatattttccctataataaagcacagaatagtttaaaaaatgtattggtccaagcacacatttttatttttagtgatttcattagaacaataaacttcaaaatgattcataacaacctttctggattgatttgatggaactgtttttacccattcactgataaacctgtcaacagtttcctctcatgacacatacaaagcacgtgtgttcccatagtgtgtccttgtgtgtaattccttgtgctggttcagattctgaaatggagctttaaaagcatggaggcttgagttggtccatgtgagtttgaaccctggccgcagctggtatgggtacttaatctcagtatcccacggtttcctcaactgcaaaatgggtttttagtagtacttacctcactgggttgctacaaagatacttaaactagtatctgacatctagtacagccagccctccatatctgtgggttccacatctgaggattcaatcaacctctggttggataaaaaatatctaggaaaatagctgcatactaggggaaaaaaaaaagaaaaaaatatccaggaaaaaaattgtgccagtactgaacatgactttgctcttttcattctctaaacaatatagtataacacatatttacttcacatttacattgttttaggtattataagtaatctatggattatttaaagtatacaggaggatgtgcataggatatatgtaaatactatgtgattttatatcagggacttgtcctggaaccaatatcccaaccctaatactaagggatgactatatatgctcagaagacatttgttgtcatttttattctcttgcactcaagaaagcacatattggaatgcaaacgaatatcaataatagttttttaaaggataattaagttaatttataatttacatacaatatacattgtacatttatattttctaatgaaaaggaaataatctataaccttcagttcagaattcattagctgtcctattttgagaactgttgctctatgtaattttcatctctgtattgatgtgtaaaactggttttaacaggtagctaaatgctgtttgaaaagcatacttcacccattctggcaactaaaataattgaaagatttaattaatttagaaaaaatatttcgctttcaaaacacttgaactgttcagagcatgttattcaataatctacctttcaccagaaatcataataaacacaataaaaatgcttacagaacccccacaatgcgttagtatacatgattattccttgtgtaagtgaatcttgttgagattttatgttcagtcaattgcaattaaatactttacatattaactaaaatgtgtcctgctctatgtattctggagaagttactctcagacaaatttacatatttaaattattttatgggctaactgataagtatagagaagactgaagacagttaagatcattgatttcaaaatgttttaaagtgttgattatttattttggttttctttctttcccatgccagttttgagatgcacctcttacttggcaggtgttcctctgtactgggtactgggacagagagaaatacagtagcaagagggagatcctgcctccgccccattctaccattctcactgccagaaagccagccttttttcaaggcttgtagagaagaaaaagagaaaatatttttaaaaattcatttaaagtacctactgcataaaccacaccagacatgatgagatattaaaatgtcaatattattaaaaatttttaatatgattttacagcccctttgctactttaaaatgtttatcttagtgttaaacaaacaatcaataacctcataaacttaaaaattgctgcaggaaataccggacagtttatggaaggatcatatgacagaaggaagggctgaagagtgtgagaagctagacctctgcaggttaccgaagtcaagaacctcattaatcggtaacaagaagtgcagagcgggcttttgagtccatgcctgagtaagaaagtcccaaaaaacactcacagaagatatttccttgcccctgcttttagtttagctgtagctaactttggattaacaaaatttatgtgctgaatgatgttttatttttttttccaactccacatgcctgtctagacttcaagctttattacgaataaagagaaaatcggctggatggcataaaaaatatttcaggcagattaacacatgatttacctcttcttgaacatccatcttaatggaagtgctaagaaagttagattcgggcctggcttggcaaaagcaaggccaccccctcctctattttttcaatgagattttccaatcctagtcaaatggtggtgctagttctttatttttgagttactgcatttcctaatttcatggtcataacagcctcctgtctaccgactcagaacggattttaccaaaactgaaaatgcaggctccatgctcagaagctctttaacaggctcgaaaggtccatgctcctttctcctgcccattctatagcataagaagacagtctctgagtgataatcttctcttcaagtaggtactcctatttcttctcaatttattttttcctttttgatataatgtgctactgtttacaagcatattgtaacttcagagcttacctctcatctttaaaaaatgttcatttttttgtctttctgctccaaggatattttgcaaagttactggcaagtattcctgggatgataaaatgtgaaatctaaacttggtacagtggaaattcacttctagaataatatttagctgaggcagagggcaatccgactacccttttcttagtacagcacacacaggctgcctgtctgttccagataacataaatgtattggatctagcactagctaggagacactgtattgttgaactgtgttagaattttataagctcttaattggacaaatctcagagtagcatgaacacactacctgttttctgaatctttggagccataacttacgtgagtttgaactaagcgatgtgaataagccattatttgtttcctaaaggcagtcaagttttctgaaaagctacacatttagcagcaaaagaacgagcccctctgtcttgaaatgggcctctgattttaagcaagctcttttgagtcctggtgtcccattttctcagttcctttttgcctcacaatggcacatacataatgactccaccacatatagcagtgggctactcgggtaatgatgtggcagtcacaagacagggcagaatactttcattttggttagaggaatgccacatgtcttaggaaatgctcgctgaactgtaagtttcatactttgtcaagaagataaccagtattctctcaaacaagtccgtaggagccaacatgattaaaagattttaaagcaatttactcgatagaagggttgggcttaatcaggacttgtgatcatggcaatggttcctgcttaaaggtgccagatttttaatgcctttatgtgccagatctaataggcttacagagcaactccatgtatatgaggttgctgggaaactcatctggttttgaatgtggtatatacatattttaatattgagagtaaacaggaagaccaggtagaagtatttgaactgaattctgaaacgtacagagaacttaaattggatgagaatgtttgagaaccatggatggttcagggtccatttgtataccataaaatcccttcctatttctcaaaagcaaatattttctttgattttgttaatatcctgtgatgactgcccactaggccttggaatgcatgcagataatgctgtagcagttggataaaatactctagaatgtcagattttcaaggaaattacaaataaaaacaatgtaggtaaaagatacgacatgtaggaaaaaagcaaaattttccttaagaatacaagcgtcgtatttacgagtagaagatttttcttggacatttggagatacgtgtttcattttattgcttgtgacagtcaaggaaaggaataaagctcttgtgtcttaaacttgcagcaagaacaaagtccaactatctttcgtttctgataactctgtgtctttttgttcaatattgggtttagagctagctaccatctaccttcccttcaaacactcactctaaacctccacacagtgtaagtatttacatcaggcatctgctaaacattttcacatggttatctgcaggtcttctctgagtctgtctgcattcatttatcctagttgctcagaacaatcgcttgggctgacggcctggtggttgagtttactttgctttgaatagggaacagctgtgctccaggactgcagattggctattcggaaaaaagggcaaggaagagagtgacccagctctgggtagaccatccacactgtaaaaaaaaaagtcatagcatagtcttcatctatggcagtggagatatggtcctgtccatccacctctatcaggagagggtctccattgttaatctccgagaaagaggcgccatctgtgaaacctcctgcatattgtctaatgaagtgctattttgaaaggcgtgcactgtacaggtaagagtgatgatggtgtgcctgccttctgggcaacatctcagtagacttcctctgaatcattcccactggacccaacagcaaaagcgtacacatcattgagttttatcgttctatctaaggcgtataacatttttctctctgaaagtctgtgattctttcggagaatgaaggggcttaccctatccatctgcccctaaaaatattcgctggaaagctgatacctctgctcaggttttccacagcagatcactcttcagtaagaattctgatattaagtagtttaattcagatccatggaaaatgactgagtaccagccatagctcccaccactctctagctgtgcaatttagaggcagattatttaacctcatgccttgaatttctcatctgcaaagtgggagtactaacagtagctaccagatatattatatggaataaatgacattaagccactcattaaactccttgcagtttccaagcattagaaactcagtatgaggaagttatttctattctaagcctagcacagtgcctggtactcaatacatgttggttgaatcagtgaaataattcaaggtcagcaccaaagctgctaggaatttatgaacatctgatcataactggaaacttgatctaaaaagcaaagggcagtcaatccaatcaactgagcgtaccatctgttgaaatgctgctgcttctgtaatgagtataaagtgttggaagagaaagtccaggaacctccatcattcttccatcattcctctcctttgtgactatctttgtgatgagaagggtaacaaaaaaatcttgctgagatgagcgtgtcaaaaacgtgttacaaatgcttcacattccctttcacatcaacagaagcatgttgcttcattgttgggcaatgtcttagtccatacacacatagagctctatgctgatttttttttgagatggagtctcgctctttcaccgaggctggagtgcagtggtgctttctcagctcactgcaacctccgcctcccaggttcaagcaattctcctgcctcagcctccagagtagctgggattacaggcatgtgccaccatggccagctaattttcatatttttagtagagacggggttttaccatgttggccaggctggtctcaaactcctgaccttaagtgatccactcgccttggcctcccaaactgctgggattacagacgtcagccagcatacccggttgtatgctgatgttctaattcaatgtgataccaaagacctgagatagtctctcccactctggccccataacatatgtccacgaggtggtaataataacaactatagtagcacctaaggttggggcagctcttactttgtgcgatgctttttatagtgttattacgtgtgattctcacagcaaccccaggtggtgaacaacgttatgattcctgttgtacaaatgaggaaactaaggctttgcaaagctaggtaacatgcccaatattacacagcttcaaaagtgacagccctaggacttgaagataaactcatctaattccaaagctcatgcttttagccattacttgagacagtattaacttttaaagtttgtaatcaatatgaatttggccttgggaaagcaggttaagcatctggggttgatgggagataacattacaccctctcttagcctcagcaacttcatctgtaaaatgggaataattacatccgagtcacagaagttttgtggctcttcatgaggattaaataaagtaatgcatgtaaaagagttttgtacaaagttcacttttataaaatgcaagttgtggccgggattggtggttcacgcctataatcccagcactttggggggctgaggtgggtggatcacctgaggtcaagagttcgtgaccagcctggccaacacggtgaaacccgtctccactaaaaatacaaaaattagccaggagtggtggcatgggcctgtaatctcagctacttgggaggctgagactggagaatcgcttgaacccgcgaagtggaggttgcagtgagccgagattgtgccattgaactcccacctgggcaacagagtgaaactgcatctaaaaaaagacaaaaaaaaaaaaagtaagttgttatatgcaatgcataaattattacttagttccatgtaaaatcttcccactaagtgaatgagggttcacctggctgtagtgctatgagatagatatgaggggcagattggtttatgcttctcaaaaacagaaagtgtgccagggtggaagtgtgggtggggagtctccgcctcccagccatgtggcaaagctggaatgtgagtacagcagcagtatggatgcggttttgaggggatggtggtaatcctcttctggcggcacccctccagtattgtgggatgctctctgatttcttttgagaagacaagtagctaggagcttccctagcctttctgttgtaaaaaccatcaagatccctgttgaatgcatacctggagcttggtttccctaagcacagactttaataacttcatttggatttagtctcctatttaaagctgccacccactctcaattttttgggttttcctactaagaatggatataacatgggcagtcttccagttctcctttcttgctgccttgaagacaacacacaggccaatcacaaggaggcagagacaggccccaacaagttgacaatcctagagagcttagtgtgagtagacttgctgaggttcctgacttttgctggaataggagagtgccactggctttttgacatttctttttccaactgtttccttgtcaaaatgaccagcagctcagctcccctaaacatacctcctcccctagattggttcagaggaagccatcaaggtccttttgcaaacggatgatctgcatttttgagatccttctttcctctgctgttcatagaaatggtctcattggaataattccttttggaacgttactaaggacaccaagaaatcaacaagaaaatttgagtgtatctgacagaagaaatttggcttttgtactctaataattatttattagaagcaataactggtcagaatttatttgcttaaaaccatgtaaagaaaggtgcttaataaagataattgcatcacatatagtaatccgttttagtatctttcaccttaaaactatgtgacaaataaagacacaaattgctctttctttctaataagcaattttggaaattccttattgggaaattccaaattttacaaaatttacaaaatttaaaattttggaaatcgtacctgcatcaagttttctgaaagaatatttaaggattaaggttacttagaatccaatatatgcatagtttaatttaactcatattgttaaattctttttctaattttatttaagaaatgagtaatattgacaagggccttgctgtggtttattatggcttgtcctagagtctctattcccagctagattaaaagtgcctcagggctgggcatggtggctcatgtctgtaatcccaatattttgggaggctgaggccagtgaatcagttgaggccaggagtttgagaccagcctggccaacatagtgaaatgctatctctactaaaaatacaaaaaattagccggacatggtggtgcatgcctgtaataccagctacttgggaggctgaggcaggagattcgcttgaacctgggaggcggaggttgcagtgagctgagataacaccactgcactccagcctgggagacatagagagactccatctcaaataaataaataaataaataaataaataaataaataaataaataaataagtagtgcctcgggtgcatagatggggttgttcagttttctaccctgtgccttgggaagtgcctggtacacactggtgtttggcacataattgtagagtgagattgagcctggcatgttccttgatccctagacaatctctatcaggtgtgatcagtaaggcacataatatgatatgtgactattacagagtagcacactacaatatgtgcctaaagccataacatcaactaatacaattcagcagagtagaatgtgaagagtgcttgcagagtgctgagcaccacggtgaggaagtgtaaacagaagaaggtatttctgggttggtgcaggatggttagggatagctttgggtaggaagcgactcttgaccatgaccttaaaggacaggtaatgtttacatgggaaaatacaaggaaaaggaggtgcataatgaaaggcatgggggaggtggttttgggaaaccatcagtctgacagaaacatagttaagaaaagtgcaaggtggtggtaggaggtaatttagaagtggagagtcagatgtcctattaaggagcttgaactttatcttgtaggcattaaagatgttggtgtaggattggaatgaaataaagacttaaccttagaaaaatactgtgtggattgaagttttcagatgaagagtgggtacatcaattcggaggtgagggaaatagttcaagggaggtgtcacaccattaaaaaaaatcttttaggacttgttttttgcaatcatgattgtttatggttgtaaagattttgtttcagaaatgattggtggagaaagaagtgtattgagaatcaaaagatgggactgtgccactgatgtgcgcagtgagaagctgcaagcttggtgccccatcttcctaactgtaaaatgggcataacaactaccagacagccgtcaaaacattatactagtgatacaatgaagactaagtgatataattttgaaaggcagtatgccttatatgtgtaaaatgctgtttacttggaatatttttatagtaaaattattttctttggacaagatatagatgcagaagaaaatgatcatatttctgtgagattaggattcagaccatttgaattttttatatttattaaataggtactttatgttgggtactgaataagtcttttatttttaacacctcatttccctcacaaaatggatggcatctttggactaggggaaatgtgtggtccctgcagctgtagtattttatgattctatagcttttgcctttagcaaacttctcttagaatagtgatttaagggctgggtgtggtggcttacacctgtaatcccagcactttgggaggctgaggcaggcagatcacctgaggtcaggcattcgagaccagcctggccaacatggtgaaaccccttctttactaaaaataaaaaattagccccgtgtggcagcatgcgcctgtagtcccagctactagggaggctgaggcaagagaatcgcttgaaccgggaggtggaggttgcagtgagccaatattgtaccactgcactccagcctgggcgacagaacatttaatgctggtggctcacacctgtaatcctagcactttgggaggccgaggtgggtgaattgcttttgctcaggagtttgagagcagtctgggcaacatggcgaaaccccatctctataaaaaatacaaaaattagccaggtgtggtggtgcacgcctgtagtcccagctacttgagaggctgaggtgagaggatgacttaagcccaggagatccaggctgcagtgagctgacatagcgccactgcacactgcattccagcctgggcaacagagcaagatcttgtcttaaaaaaaaaaaaaagtgacttaagatactgacagtataaacacaaccaaacccatgggcatctgtgctgggaataaaagacagacatgttttcattgcactgatttaggattctgcttggaaaggaaaactgtgatctctcctgcagttgcctaaaatgctttacagttatgggaatggaaaagctaaattctgtgatttgtgggtagagggaaggaggacgagtgtcctttctgatttcctctttttccttctcttccaaggggaaataaaaggctagagcaacaatttaaaaagaaaaggcaaggagctactgggggtagagtcgggagggaaaaaggccaaacccactaaataatttcacttcagttacagtaaatctcaaatgatgatgctacactcctgagaatgttccatggtggaaatgcctgggctttgaattttgagcagcgaagtaccaggagagggtgacatgataacattcaacaggaagaacactgctcttgtccgtttgacggtcctattcctccggatcactcaatcttcacaaatcaagcatatagctccttcacatgtcatttgtgaagggaaagactcctaggaaaatgttttctaggaaagggaaaaaagcagaaagcaaaggtctcctgcttactacagcattcgtgttgcataagcagtattaatgtagtggagtattaatcacttagaacagttcacgtattattcctatctgggctctgcagggtcctttcttcacttctttctcgacatttggattctgtccattttactcctccctctgcacttggaatagaagtgaaatttgttgtgccaattctctgcttgttagaagccatggtaatgtttagtaggggaaaagatttgtactgctacatagaaggaggttttgggattatttaagactttactttgttgatgggattcctagaatctactattactgggtatactagacaagtttgtagatttacaaaagtgtggataacatgggttgcacttgatttctttatccagctctttggttctaaatttattgccaattttatttatcaaaactattctcagcggagtagtattttctgtggacacaaggaaacatctgtgagcttaaaccttagaggcagatagccagttagaacatttggcatatgaagcttagatagcagaagagaaaaattaaccaaggcaaccctcaaaaatattgagaaggcaactaagaaaaatttcttatcactgacagactgcagtattgagttcgtgttaatgaagaaatgtcagaatacataatgaatcaataaggagtgtcatattatggcaagtttcaatgttggtgtcaatctcgactgccaggatttatggtagattatataatggaatcctgagttctgagagatcaaaggaaaatgctggctctttcttcatccattctcttaggtcaagcctatgcagcaagaagccaagttgagaattgagcaattatctgaagtgggcagtggagacggccaaaccagataatatataaccagaaagtcaccgtggagggaaaatgtggactgaaaataggataaggggtggaggtagaatgtcaagccatttggtcagtgtccacagtccaaatttactgaataacagccaattccttacttcatgtggttatttagagcgagactagaggacaagtgaaaaaaaaaaaaaagagttcattcctaaggttgttgcatgtttgtgcaaaatttcttcaaatctctgttattatctgttacatgtctaattctgagtacttccagagattgcatttcattactttagattagtgggttgaagtggtggaggaagcccatataatctgacttacatggagaaaacaagtctttttttatagtttagttgagtgttatatttaattagcctttttttccctccataatgcatgcttatgaattttccacttaaaattctgaggctctgacctttatcatttcctcatggagcaatttctgtacctccttaactttagtagaacatagcaatgaaatatacaagtcccctagaatagaatttgtgtgaatttggttttctaaaaacacaactaccaaagtctgaggaccagtgtggtatttttttcttctatttgatatggaaaccataaactacttactttgagcagatgtttcccagtcctaaaatacagctatcagtccactggcccctataaatctgttggagtgcacctgctaattctgaagcctccctaatacaatgttaaactttccttttttttttttttttttttttgagaaaaaaattgtaaattaggttcactgttgcttggaattaggaaaaaataaaaacacaggcatactaatatttcagatggaaaaacaaagttaagaattcaacaagtttttttcccccactctatcatgtcttgcacatttaaagctgttatacaacattttaaaaacaaaccaaaaaaacccagggcctttttccaacagcttaggctgatgacccacagtaaaaaagtgccccatgggatattcttaaagcaccccaagggagtctattgaaataacttaaagtaaaaattcagaagaattttacatgtaattaaaaattaagaacgttgttttataagcaatagggaaaagctgtattaagttgcattgctcaatttctcacttgctctgtgcagtgactgctttttcaaccatgtaacaacgtctgaatcttcgtggtaaaatcatacctatcacagccacagcaggttttgttctgctgctgcacatgtgatttgagatactgtgggctgggagtttttttttttttaatttctaatggcaaaatggatctatagaaatggaagtcatctgtaatctcagcactttgagaggctgaggtgggtggatcaccggaggtcaggaattggagaccagcccagccaacatggtgaaacccatctctactaaaaagataaaaaattagctggcgggcgtggtggtgtgcgcctgtagtcccagctacttgggaggctgaggcagaagaaatgcttgaacccaggaggtggaggttgcagtgagccgagaccgcaccgttgcactccaatctgggtggcaagagcgacactacatctcaaaaaaaaaaaaaaaaaaaaaaagaagaagaagaaatggaagtcatcccgtgggcctgagttggtgtagtggattatggcctgtgcgtgaatgaagaaatacttgccaatggcatcagtggtaactagcttaagccctactcagctttgtaaaataatgtaatcaaggaatttgatctgaacaggtaagccaaacattgattcttcagtgcctattgataagtgagactacttttctttttaacagccttatttcacttaagtggggagtcaaactagctttaattaaggaaatctgtagaaatcacccacatctccctttccttctctgttaaaaaaacaaaaggaagaagaaaactaggaaggagtaagcacaaagatctcttcacattctccgggactgcggtaccaaatatcagcacagcacttcttgaaaaaggatgtagattttaatctgaactttgaaccatcactgaggtatgtgtgaacatactagtttcctctttctctctcctgactttgtccgtgaattgataagatctaatttggtcatcagtttggagaacgatttttcatttaatttctttcattatcaagtgtgtattgtcaggggcttagcagtacacctactatctgatgggcactctacatgcgttgcttaggttgaaattaaggatacaatctgtgcactaccaccatttaaaaaaatccccaagtctactgtgtgggtgaggtttctttgcatagtatcagagaggttaaccaatttatttacatactcaatagtccactctaagtagggaaaatccaagctttttttttcttaagaaagagcttttcattcttttttccctcagagctttaccatagtttccagcaagtgaaaacatttcttgatttgaatttcacaacctccttctcctcttgccagttgtatggtgctaataggaagcaaaatgtgagtgtgcttttaatttaaccctaaaataggggaatatcttcagaatttagactttacatattcagtgacctacctaaaaatagagacatagttctaaccttctcaatcattaagaaacatttctattgaatttaattattcaaaacaacaggtagcagtttcacaagggaaaagacaagccatgccacttgtatttgtggtcaccaagtaattacattattttttatttaaaattaagataaaataacttactgactgtcaagtccatttctcatttcctccatagaacattttaaaactagttcacaaacctcttgaaaagtcatgcctctagaaagtgcaaattgtcaccattgcctagaagccaacttgagaggctgtgtatctatgcagcattttgcaaatccagtagcaggcatgtgatataaaagattaaatgcacccctgatttgtgaatactatcctagccttcaaaatgttcaaaagcacaggaagtctgcacttttaaaaatataacctgcccaaattgcaagggaggggttgggtgtaggacctaggtctgtctgccaatcagcttgagatgccagtggacgaaacctgacttcactaaaaaccagactggcaaatattactcagcgtggtaatttcctaattgtagaactggcctgtttggtgaagtatttcaggaaaatttttagctggaccttttctaccctactgcataagaaatgaaggtttctaggcaaagactttacttagtgactaaccaaaaatggtaaataaagtcaccacttccaggcttagctactgtcctcaaaacagctgcaggactggtcaggccagtcttctgaggctggaggtgcatgtggaacccccagagccttgtctgcaagggcatggctgactgcaggctgtttagaagcaccccgccccgtgaaactcctctggcttaggaattttaaacagttctagttctaatctctctgctcagagtctgagcagctgtgaatgagctctcctgtgaatcacagaaatgttaatgggtgagctgctctagcttcttacttccaagtggaaggcgcctgtagctctttgccagcttgatgcagtgagtttgattcctcttttgggcagcagggagagataatgaaggagggggaaaaaagattttaatatagaaacgagtcttccatctggctgaggctgaacaaagtagaagaaccagtgcaagtcactgggggtatggatctcataccattttcagcatatacctccctttctctctttttgattctacacatgtcagtccctgagtagtcttgcattgctttccccactttgaagtcttagatccaaaactttgattccagaaaggtctaaggtgctgttgctgagattttgaaagagacctgagacaaactgttgggattctagacgctattgcgcatctgcctgggtaactgtgtcacttaggttgggtcaccagaataattctcctccatttttgctgcctttccaatttataaacaacacagaacatcagtggttctcccataatcaaatatatttggctctattaatattaaaatttgatcttgagtagaaagattctaagggctaaaaaataaaagatgtaaaatgtatgttgataggttagtgtagaagccacccatggggttgcccccactcccactctttcatattttttttaagaaacaacactcaagttacaaagtcgattctttttttgttttgttttatttgagactgagtctcactctgtcaccacccaggctggagtgcagtggtgcgatcttggctcactgcaacctctgcctccccggttcaagcgatttttcctgcctcagcctcccaagtagctgggattacaggtgcccgccaccacacccagctaatttttgtatttttagtagagatagagacagggtttcactatgtttcaccatgttgaccaggctggtcttgaactcctgacctcaggtgatccacccgcctcagcctcccaaagtgttgggattacaggcgtgagccaacgcccctggccacaaaagtcaattcttaacttaaaacataaaagttccatttcttttatggtctacttagtcatgtctggagtcagtgagctcagtcaagtagtttgcagaatgacagttgtgatacctattcatttacccaccagattattttctgctctccatggcactttatagaaaacagtttattcggtcattacaacagctctaggagggggtttcattaaacccactttctaggaaagcgaactaaggcttagaaaaatcaagtaatttgctaaagactacccagctggcaatgatatgacaggacatgaacttaggacaataactcaaggtcttggtccctgtaaatatgggtttccaggttatgtatgcaggcagagggcttagatcctgaagtttccttcagaaacttcaggatctaagccctctatataggagcagtataaaaaggaaggatctcttcccatagggagcttgtcatccattgaatgaggaactcagacttccactgtgaaatgatatttgtatccccattgtgtgcgagatatggggactctgatcatcataagagcacatttttcctgcctataaatgatacttaatagagctgacagattatatatatctggaacacttttacctagcagaaagacaacaggctaggattagctgactaataattttatttatcaagctcaattcccatgctgacttctcttcctctagtgaaaatgtgtcatcagatttggtcccaaactggagaggtgaaaggatcctttgaccagtataatagccatgccatcagttttgctttcctaattaagttttatatgggttaatgatctatatcattattttgggggtttctaaacacatatgaactaaagatggaaaagatgatggaaaagatggaaagaagatgactcagatgtacaaaggcttgcagagagaaggataagccaaaaaattggtaaatcacacatgaataatcaagaactgactacaatataataatatgtgtccatttccactaatgaataagctgccattatgtctcttcattctctatttaggacaaattacttctctgctgtatttccattcttacaggtacctatctgctgtgatttttcccagttttgactttatcttgttgctttaatcttgtctctaagtaagctgcaacccagtaaatatattccagtattgtttattgtaattcctgcctttatgtcaggtggcaagaggaagggactggttttattaatttatcagtctgggtgtgtgctaagaggatccttagtacatgctttgattatggtagattgagtctaaaagattcagctggtttattccatttattttggtctgtctacctaacaaggtcacacagtggattatactagttttctatgtgtcatattgttggcctgacacataatagcaaataagaggtaccagaattttctgtacagtctgaagctgtgtgtgtacaacaaccagtgaaaaatcttagttatttggacttttgggttccatgatgccagagaaagccagacaccagcagctggaatcagctaagacctaagaccctgcatgcacatatagatgtttacattttcttcctattgcgacattcagccattgctttggcgcctatttcaataatatattgctgctcatcaaagtggaaataatgttttgttactagctgagtattgaaaagctcttcatagttttgtgattttgactcagctccaacatgcaggacccatttcttcaactgactttggcaacaggagagattgactagtgggcttgaaagtgatccactgctgtttctgtttaactttcttcaatcctactgggtcttgggaagaagaggtagcgggcatccttgtttgcctcaaccaggaagcacaaggccatcccagggcggggcaggagagaggtgggagggaagaagcaggctccacagggccattgtttaccttgttggcgggtcaggtcttctcagggtagggttcctgggataagagcaaagcttattggttttccttgctgtgccacgagagcacaccagatcacccctgcagccttgcttgccttcccacagcctgcccttgcctagggtttcagctgatatcctttctactcaggaggagaaaccacagaacacatggaggaagtgtttccagtgttaagactttagaccaaactatagaaatctgttctacctggaaacctgaagaaataaatcatgactgctattcagtagaagtaaaataaaaaaacagctttactggtttggaatcataggaaggctttctgtatagcctctctgagagctgcctattggaaggatttgtcctcaaaacgtgaggatttgtggtgttccagggtttatatgacactggcaggatagtttgctagagggctgtgcttcgacctttatccaagggatgtaagccgtgtgtttaggttagtgagcgtctagcacaaagctctaatgttgaaggagcattggaggcaggctgtgcctctgaacatgtagaattgactagaaatgccaatgttcatttcaaaatgaaatcattatctttcttatgcttccatttaaaaatgattattacatttttgcatatggttgaatgcatattaattttagcaagtttagaaaagagataagcataaagacatacataaaaatcacttattctcatcagctatagataatcactaacaatattttaggacattttcttttcatctttttcttagcaatatgtatgtgtgtgggtatacatatttaagtgtgtatatatgtaaattaaaaaacataaaatattcccacaatataattaataaaaatctaagatacaacacaatttccgtttgtaatatgtagtgtatatatgtatatatacacattatatgtatatataaaatacatgcataaaatagatacacaggtatatattttgcaaattgaaatgatgttgtatcttgtagattttatttaacattagaatttatttacactacttaggtgttttaacaaggattgtggtccaccatttatttccttaagagtaattccaaaaagtggaaatagaatgtcaaggggcaaagttctttataaagtccttaaggagtattgccagatatatttttttttacttccttttaaaacatgattgtattgtagaagttctctttaaaaattccaagcaaaaatttttcaaaatcccatctagaaatcaaatcatgattttatttggctatgcctcttgtagtccttgtctatgaacttattctattattaaatataataggtaatttccactaatttgacagatagaattttattttttacattttctcttgttacagtgccatgcatatttctattatgttacagagatcttgggggtcttttttcctccctttttcctttctcttttcttgttctgtaccccttcacagaaaccaacaaatacaggttgatgtgtatcctctactcttttctccatgctcacacaacccaatatttacacatgcactgatttttcagggcaatggtccttctttatcataaattgtgggataaggttatatacataatatatgtgtgtgtgtattactctgaatcttggttttgtcactttgcaatatgtcttaaagattctgataaatcttatagatctatctcattcttttcagtagttgcatgcagtataaatttactataacttattcaagtaatctgctttcagctgatactctgttgtgaacagttttcaacatataaaaaagtgctgtcattacaaatattcttagatatatattcttagtaattgggggttttattgttatggtgtaagtcccaggagtagaattgctggtttaaaaggtatgtgtatttttacatttctattggttttttcatattattttctaaaaatattatagcaaatcacagtcccactagtgatgttggagagtatcattttcctcactagtactcctatttccctgctttctaatctttcctgatctaatgagtaagcattgttaattttcttttcattttcttgacttctaatgagcttaagcatcttttcacattattgttgttcctttggattttcttatctgtcaattaccaatggatatccttgacctatttctcccttatatggttgcttttctcttattaaaaatttgtaaaagttctttgactattacagattttaaaaactggcagataaagttgtatgatttattgtgtataatatgatattttgagatatacatatatcttgatatatcaatatcgagatatatatatcacacgttgtggaatggctaaatatagctaattaacatgtgcgttacctcatgaagttatcatttttgtggtgagaacacttaaaacctctcagcatttttcaagaatataatatattgttattaactatagtcaccatgttgtacagtggatctcttgcacttacttttccgatttaactgaagttttgcatcctttgaccaatgtctttccaaccctcacctcccacccctctgcccgacactgccccagccccggtaaccaccattctactctctatgtctatgagatcaacctttttagactctacatataagtgagatcttttggtatttgtctttctgtgcctggcttatttcacttaatataatgtgctccaggttcatccgtgttgttgcaaatgacaatatttttctctttttttaaggctgaatggtattccactgtgaacatataccatattttctttatccattcatctgttgatggatacttagattgattctacatcttggctattatgaataatgctgtaataaacatgggagtgcagatatggctttgacatactgaatacattcgctttgggcatatacccagtagtgggactgctgagtcattcggtaattgtatgattactgttttccatagtggctgtactaacataccttcccactaacagtgtgcaagggttctctttactccgcatccttgccaacacttttaatcttttgtccttttcataatacccattctaacaggtgtgagatgatatctctttgtggttttaatttccattttctgatgattatagtgatgctgagcattttttctatagattttttttttttggtcagtggattgctaaatcttaccccgtcaataatttctcctttgattttacttttataattttctgctacaaaattaaaaaataattgtatgaaataaaatttttcttcctatacgtattctgaatttcctatcttacttcaaagagtcttcccacctcctattttctaaaattttcttctaaaaatttctatgttttattttattatttttaatatttagtattttttacatctggaatttttttatataaaagtggaaggctcaactgcatctctttttatataaagaacgaattgtttaaacatcacatgttaaataatcttttctccaataaattaaattatattagcatcaatttaaagattttttttctctaaaccactaatctatttatttgttgccaggcctgagacgtattgctttgattataatagctgtatagtctcttttaacatttggcaagtttgatgctccctactcattaatattatttataatgttagcctggttttcctttttttttttcagtccaaataggatttagtcagaagaaagatacgtggattacatttttaaaatactgatcaaaatgaagatgctccaaccgtataaatggcagatgaaatagactttaaagtaaaaaatatttatcacacaatatatcagaaaaatataacaaacccgaaccaacaaacatcagcaacgtagctccaaaatattagcttgaaacatgaaattgccaatagttgaccactttttgacctacaaaagcaacaatttatataaagaaaaggtcaataaaattatggtaaattgaatttttttttattattacactttaagttctgtgatacatgtgcagaacgtgcaggtttgttacacaggtatacacatgccatggtggtttgctgcacccatcaacccgtcatctacattaagtatttctcctattgctatccctcccctagccccccaccctctgacaggccccagtgtgtgatgttcccctccctgtgtccttaggttcccacttatgagtgtggcgtttggtttgatgttcctgtgttagtttgctgagaatgatgattgccagcttcatccatgtccctacaaaggacatgaactcatcctttttaatggctgcatagtattccatggtgtatatgtgccacattttcttaatccagtctatcattgatgggcatttgggttggttccaagtctttgctattgtgaataatgctgcaataaacatacatgtgcatgtgtctttatagtagaatgacttataatcctttgggtatatacccagtaatgggattgctgggtcaaacggtatttctagttctagatccttgagaaattgccacactgtcttccacaatggttgaactaatttacactcccaccaacagtgtaaaagcattcttatttctccacatcctccccagcatctgttgtttcctgactttttttttttttttgagatggagtctcactctgttgcccaggctggagtgcagtggtgcaatcttggctcactgcaagctccacctcccgggttcatgccattctcctgcttcagcctcccaagtagctgggactacaggcgcccgccatcatgcccagctaattttttgtatttttagtagagacggggtttcactgtgttagccaggatggtctcgatcttctgacctcgtgatccacctgccttggcctcccaaagtgctaggattacaggcgtgagccaccgcacctggcctgtttccagactttttaatgatcaccattctaactggtgtgagatggtatctcattgtggttttgatttgcatttctctaatgaccagtgatgatgagctttttttcatatgtttgttggccgcataaatgacttcctttgagaagtgtctgttcatatccttcacccactttttgatggggttgtttgttttcttgtatatttgtttaagttcttgtagatattagccctttgtcagatggagagattacgaaatttttcccccattctgtaggttgcctgttcatgctgatgatagtttcttttgctatgcagaagctgtttagtttaattagatcccattcgtcaattttgccttttgttgccattgcttttggtgttttagtcatgaagtctttgtccatgcctgtgtcctaaatggtattgcgttggttttcttctagggtttttatggtttcgggtcttacatttaagtttttaatcttgagttaatttttgtataaggtgtaaggaagggatccagtttcagttttctgcatatggctcgccagttttcccatcaccatttattaaatagggaatcctttccccattgcttgtttttgtcaggtttgccaaagatcagatggttgtagatgtgtggcgttatttctgaggcctctgttctgttccactggtttatatatctgttttggtaccagtaccatgctgttttggttaccgtagccttgtagtatagtttgaagttaggtagcatgatccctccagctttcttttagcataggattttcttggctatacgggcttttttttggttccatatgaaatttaaagtagttttttctaattctatgaagaaagtcaatggtagcctgatggggatagcattgaatctattaattacttttggcagtgtggccattttcatgatattgattcttcctatccaagagcatcgaatgtttttccatttctttgtgtcctctcgtttttccttgagcagtggtttgtagttctccttgaagaggtccttcacttcccttgtaagttgtcttcctacatgttttattctctttgtagcaattgtgaatggaagtgcactcatgatttggctctctgtttgttattactgtataggaattcttgtgatttttgcacattgattttgtatcctgagactttgctgaagttgcttttcagattaaggagattttgggttgagatgatggggttttctaaatatacaatcatgtcatctgcaaacagagacaatttaacttcctctcttcctatttgaataccctcaatttctttcttttgcctgattgccctggccagaacttccaatactatgttgaataggagtggtgaaagaggatatccttgtctggtgctggttttcaaagggaattcttccagcttttgcccattcagtatagtattagctgtgggcttgtcatgaatatctcttattattttgaggtatgttccatcaatgcctactttgttgagagtttttagcacgaaggggtgttgaattttattgaaggcctttttttcatctattgagataatcatgtggtttttgtcattggttctgtttatgtgatggattacatttactgatttgtgtatgttgaaccagccttgcatcccagggatgaagctgacttgattgtggtggacaagctttttgatgtgctgctgggttcagtttgccagtattttatcgaggatttttgcatcaatgttcatcagagatattggcctgaaattttctttttttgttgtgtctctgccaagttttggtatcaggatgatgctggcctcataaaatgagttagggaggagtccctctttttctattgtttggaataatttcagaaggaatggtaccagctcctctttgtacctctggtagaattcggatgtgaatccatcttgtcctgggctttttttggttggtaggctattaattcctgcctcaatttcagaacttgttattggtctgttcagggatttgacttcttcctggtttagtcttgggagggcgtatgtgtccaggaatttatccatttcttctggattttctagtttatttgcgcagaggtgtttatagtattctctgatggtagtttgtatttctgtgggattgctggtgatattccctttatcatattttagtgtgtctatttgatttttctcttttcttctttattagtctggctagcagtctatctattttgttaatcttttcaaaaaaccagctcctgtgttcattgatttttttttgaagtttattttgtgtctctgtctccttcagttctgctctgatcttagttatttcttgtcttctgctagcttttgaatgtgtttgctcttgcttctctagttcttttaattgtgatgttagggtgtcagtttgagatctttcctgctttctcttgtgggcatttagtgctataaatttccctctaaacactgctttagctgtgtcccagagattctggtatgttctgtctttgttctcattggtttcaaagaacttatttatttctgccttaattctgtcatttacacagtagtcattcaggagcaggttattcactttccatgtagttgtgcagttttgagtgagtttcttaatcctgagttctaatttgattgcagtgtggtctgagagactgttaggatttccattcttttgcatttgctgaggagtgttttacttctaattatgtggtcaattttagaataagtgtgatgtggtgctaagaagaatgtatgttctcttggtttggggtggagacttctatagatgtctattaggtctgcttggtccagaggtgagttcaagtcctgaatatccttgttaattttctgtctcattgatctgtttaatattgacagtggggtgttaaagtctcccgctattattgtgtgagaatctaagtctctttgtaggtctctaagaacttgctttatgaatctgggtgctgctgtattgggtgcatatatatttaggatagttagctcttctcgttgcattgatacctttaccattatgtaatgcccttctttgtcttttttgatctttgttggtttaaagtctgttttatcagagactaggactgcaacccctgctttttttttgctctccatttgcttggtaaatcttccgccattcctttattttgagcctatgtgtatctttgcatgtgatatgggtctcctgaatacagcacaccaatgggtcttgactctttatccagtttgccagtctgtgtcttttaactggggcatttaacctgtttacatttaagattaatatttttatgtgtgaatttgatcctgtcattatgatgctagctggttattttgcccattagttgatgcagtttctcgtagtgttgatggtctttacaatttggtatgtttttgcagtggttggtaccagttttacctttccatatttagtgtttcttttaggagctcttgtaaggcaggcctggtggtgagaaaatctctcagcatttgcttgtctgtaaaggatcttatttctctttcacttatgaagcttagtttggctggatatgaaattctaggttaaaaattcttttctttaagaatgttgaatattggcccccactctcttctggcttgcaaggtttctgcagagtgatccactgttagtctgatgggcttccctttgtgggtaacacgacctttctctctggctgcacttaacattttttccttcatttcaaccttggtgaatctgacaattatgtgtcttggggttgctcttctcgagagtatctttgtgatgttctctgtatttcctgaatttgaatgttggcctgtcttgctaggttggggaagttctcctggataatatcctgaaaagtgttttccaacttggttccattctttctgtcactttcaggtacatcatcaaatataggtttggtcttttcacatagtcccatatttcttggaggctttgttcattccttttcactctttcttctctaatcttgtcttcatgctttatttcaagttgatcttcaatctctgatatcctttcttttgcttgattgattcagctattgatacttgtgtatgcttcataaagttcttgtgctgtgtttctcagctccatcaggtcatttatgttctgctctaaactggttattgtagttagcaattcctctatccttttttcaaggttcttagcttccttgccttgggttagaacatgcttcttcagctcagaggagtttgttattactcaccttctgaagccggcttctgtcaattcatcaaactcattctccatccaattttgttcccttgctggcaaggagttgtgatcctttggaggagaagaggtgttttggtttttggaattgtcagcctttttgtactggtttattctcatcttcatggatttatctacctttggtctttgatgttggtgacctttggatggggtttctgtgtggatgtcctttttgttgatattaatgctattcctttctgtttgttagttttccttctaacagtcaggcccctctgctgcaggtctgctggagtttgctggaggtctactccaaaccctgtttgtctgggtatggaggctgcaaaacagcaaagattgctgcctgttccttcctctggaagctttgtcccagaggggcacccaccagatgccagccagagctctcctgtatgaggtgtctgtcaacccctgctgggaggtgtctcccagtcaggaggcacaggagtctgggacccacttgagcaggtagtctgtcccttagcagagctcaaatattgtgctgggggatccgtttctctcttcagagccagcaggcaggaatgtttaaatctgctgaagctgtgctcacagccgccgcttcccccaggtgctctgtcccagggagatgggagttttatctataagcccctgactgggactgctgcctttctttcagtgatgcccttcccagagagcaggaatctagagagacagtctggctacagcagctttgctgagctgcgatgtgcttcacccagtttgaacttcctggtggctttgtttacactgtgacaggaaaactgcctactcaagcctcagtaatggcggatgcccctccccccaccaagcttgagcatcccaggtcaagttctgactgctgtgctggcagcgagaatttcaagctcatggatcttagcttgctgggctctgtgggggtgggatccactgagctagaacattggctccctggcttcagcccccttttctggggagtgaatggttctgtctcgctggcattccaggagccactagggtatgaaaaacaaaaactcctgtagctagttcggtgtctgaccaaatggctgcccagtttttgcttgaaacccagggccctggaggcataggcacccaagggagtctcctggtctgcacccaagggaatctcctggtctgtgtgtttcaaagaccatgggaaaagtgtagtatctgggcaggagtgcaccgttccttagggcacagtccctcagggcttcccttggctaggggagggagttccctgaccccttgggattcccaggtgaggcgatgccccaccctgctttggctcaccctctgtgggctgcacccactgtctaaccagtcccaatgagatgagctgggtacctcagttggaaatgcagaaatcacctgtcttctgcgttaatctcactgggagctgcagactggagctgttcctatttggccatcttgccccttggtctggttttcaaccttcagtcttccatatttattttgaatgaattttctgcagctttattaaaaaagaatagaaacaagtaagagcaaagcatagttggtttatggttgtaataaacttatatgtatgtcctaatgatttgacagctttgtgatagtatcttgtaatccaagtacatgatatatttctacattatttagatcttgtgttaggtttttccataagattaattttcttcatattggctttcttgctatgtttctttttagcataaagctaatccaggaaaaggaataaaactggaaggaaaaaatgtcttaaaccattaatattggctgaccccggtggtagggttatgaatgaaacatttttgcttcttccacttttttatattttccaaattgtccatattaatcatgtatgatttttataataataaattaatgaaatttaagaattagataattgattgaattggataattgaattaataaaatttaagaatgagaataggaataattgtgctttgaaaagtcatatacacaagagttttagatggaattcaatactaaatttatatgctatactaaatcagtaattctcaaggagcaaaggtgctggggagtgtggaggagctctttgttggtgttgcacatacaatttaagacaacattttccttattcctcaccattttaaccatatcacctaaccagcctctggtagcactcaatagacatctgatgaatgaatgaataagtgaatgaaaacattgtgacaaaatggtataacattttgtatttgaaaaatatatgaaaatctattcttttcaaatataaaatgggaaaataaaattcaataaaaatatcttggttggtgagaatacacaaaagatataccttcttgtctatgaattagtaataagaaattgtcttgaggaagtcaactacatctggaaggttctctctggacaaggagcataagtgaaaaacagtgcactaaattataaccaagagttgcaacttaccattttaatgcttcagcacaggcacagagactaacatttactaagcaaacaagaagtcttggcaagttaattaaataatgaattatttttggtgaccaaggagttgggcttctcattttaaaaccatgcatgagatttttccctttctacccattactaaaatatcgtattagtgtgaaaaattataccaggactgggagaaaaagaaatcacatctgtccttgacaatgggctgaatgaagaggtgaaggagtggttttactatctaagtgactgaaaaataggttatggtgccccagcaaatccttgttgtttgctgacaattagtgatgtctgtttaaatcatgcagttttattaggccttaaaaatatcttttagttagtttcaatttcatcaagggaaaaggagagcagagtagagtggaactctgctcagagtccggttggaagccttcaactttgttctccctgttttcagatgagtgtctatttgtggctctaccttttctctttcttctcttaccatgacactcccctcttctctcttatcttagctgttcttttcttcttccgcatattaggcagtgggagaaacaccctaaatcagttggaggtgaggaaagaagaaaagcacccctatcttggtagttcctcattcttcccttcgtcacgtccatgtcatcaggctctgccttcatctgcgatctggatacaatccaatttatagcatccattcaaccaaaaaatattgagctcttactatgtcaaagtagtgttctggatgctcggctccatcagtaaacaacctagactaacatcttgccgttgtttacatctcgtggtgtagagtttacaccttgtggtctagaatttacatcttgtggtggaggcaggcagatgattaacaataaacttaagtaggtctagatgtcaaaaggtggtaaatgctacaggaaagagcaaaggtcgagccaggtaaggcagattggctgtgtgggtgtggaggaagggtgcaagagtactgtcaagataagccttcctgagaacatctgaaccaggacatgaaggacatgaggaagtgagacagtcgctatccagggaaggaatttccaggcagaagaaagagccagtgttacgccttaaggtgggagcatttctgcgagactggagaatcactggagtccattgtacttggagcccagcaagggagaaaagattggaggactcaggaggtgctggggcaggtgaactgctttttgattggggagttcagagggtaatgctttggataaatgtaactgaaaactttctcagaagtgttttcatactatctctacaattcattttcatgtgaaaacttaattggcgagcagattaatatggtgatcttcccttagatcactaggaaaatcttgttttatgaatttttcttcccttttcattcactagcagagaaaagagttgtaaaggagccgcagaaaattatagtaggtttctccctactactgagctactgagactggaagatgctcacgttagcaactgagtatatttatgtatttccctttaatgtttgaagggtcaggaatatttgacttaggatactagtctgtttagaaacatgattcaactagctacatgactaaactagcagctgtcagagagaatgcaaggtcaaaacttagtagttgataataataaagaaagggcagagtgttatgaaatgttatgatctgggtaatccattggctcacttttttttgtcagcctaaggttacaagatgataaattaagttgctaatattctatatctaccatttacttttcctttatcatgtgtctggcaatatgctgagtgttctacctctagcattttattcaaactgtgcaatctgcctgctgaaacaagtatcattaacttcatttcctaaggtgagaaaattgaggcccagagaggttaaataagtttaggatcatatgcatagctggtaagtactatactttaatatccctttgccttcatgctttgctctcactccatgtttaaatgagcagagagacttatctttaaacagatatatagcaagtagtattttccaaatgaattccacaagatgctccattgcaaaagttcaaataagtttagaaaaatgctgcaaactttgtgcttcttaagagatttacagtgcagattagcacattaaagcctttgggaaatttgtattagaaaaacctttattaacttatttaccccaatttttccaagctttttgatcacgaaactctttaaaaaacaacaagtataattgcttttatagtattctttgggatacacttggagaagtgttacatgaaaagatatgattggataaatttaaatataggaagaattatttaatcattttttggaataaaacaccaattttaggttgtctaacatacatttgagccaagacatgaaggacatgaggacataatttacttttgtccttgtaaggacataatgcacttttagtggtttgcattgtttattttcttttgaatttcatgttactttataaaggtaattatttaatcaaaccatttgttaagtgtcagacactatggtaggtgctggtaatataaagagaatatgtaaacatcaacacaacatatctcctagtatgggcttacagtacagtgagagacacaaacaaataatttgtaggattgaaataagtcttacatttgccacatcaataaagcactatggaaacaaaggcacaagaacttaactttgtccaatgaagtctttcaggaggaggtgatattggagctgaattttaaaggattcatagatgtttatctgaaggactaatgcaacatgttggaggtgagtcttcaggaaagaggcaacaagaaccatttgggtaacaagataggacttggcaagttaggggagtcgtaagtggttcattacggctagaatccagggctctctggagagattgggagtacacagatcactcaagggtttggtatgaactgtcaggctactaagacagaaataacaaaaatcagatgtgggtttagaaagagcattttggctgtaatacagaacatgatggataattgatggagcgagattcctggggagatagaagaggatagggccatgtaagtacatctgctggtattttaaaattagaaaaagaaatttttggtagcaaaatcagaacagacccaccaactctttgcaaatcatgggactagaatgtttggaaaggaagatgctaacgattttcattcatttgtttatcatctatgttgagtgtcttcttgggcctaggcagcatgcccaaagctgggagaataagatactgtatgagatgctagaaagatccccacctctcctttccagaaattcagtatatcagactaattggtttacagttgtgaccatgggcttttggcatagctgttcaacaagatttcattctttttcaaaagcaattcattcatccaccaaatatttgttaaacaaatgtacgttgcattgtagtgggtcctcagggagctggatgtacatgccaaatatgtttcattttatttgaagcaagtccacagacaagtaaactagtcaagtgataccaggcaaagtgatttgctttccaacagatggtgacagattaatttcctaagagactgatctgccccagaggcactgggaaagtcttgttagggaggtagattatagtcaggaccttggaaaattgttgggaataattgaggtcaggaagggtatacttaggtggatggggacagcccctgaacgagggatcagtccttttggagtgagcacggaatattcaggtgcctgggaggagtgaaggcttgtgcttcagcactgattgtgtgcaccgatggtggaacatacctgcctgctcagaagctttggcttctctctgtaggtgagagacagccattagaagtccttgaacagggaagaaacacggtgaaagcaaggatttcattgagaagtccctcatggaagaagaagattacattggaaagagcctggcttagggagggagcagtgacaatcagagaaaaaggcagataggggcaaagatactggaagaagaggaaaaactgtccaaagctttgtccttgtgtgggaaagctggtgctgttggcgtgaaagaggaagcaagaacatgtgcactgacacggctgagagtctccaaaaccattgtctttccttaaaacagtaatgatcacaagcagcttacaactttgcatatagccactggggcaaaatcctattaaaagctaattcattatctgagccagtgcatgataatgcgatgtaaaggcgtgttgggaggcagatgatcagaacttttaagcaaactaaatttcataacatttattagaagcctgtctctatttccagaaaacgcctataaatgtggctgtaatgtaggctacaggtcatcacactgaagtagaagcaatgtacaatacctgaaaggttagagaagttcagggtctgggcttataaaaaacttcattattcatttgaaagatattgttttgtatcccccaattgtggttttcaatgtatataaaagcaggatatcatactttttgatctatggatttggaaggggataatggtgtggtgggcactgagcatatggaattatttaattagagagatgccctttagattactataaaatataaccagaatctcctgtttagacttctaaaatctacttctttgaaaacactactaaaatgaccacaaagacctgtcctcacaagtgggagctattaatcaatagtgtgtacacatggacatagagagcagaataataaacactggagactctgaggggtgggaggggaagagggaggtgagggatgagaaattacttgatgggtacaatctacactattctggtgattgatttctctctgtttcctcttcagaaactgagaggaaatttagtttcctcagtcaccactcctccaaactcctgcgtgggtgatacaagacttgctgtcatcttgaggcagaaggggttaggggatttccccattgaacctgatagccttcatttcatttctgtcttctcagggaaacatttacccctctttactaaatggaagaaggtttgtaaactaggagggtatctatggatctgattgctccttcaccactctgctatatatccatgtaacaaaacagcgcttgtggccggatacagtggctcacacctgtaatcccagcactttgggaggccgaggtggtcggatcacctgaggtcaggagttcgagaccagtctggccaatacggtgaaaccctgtctctactaaaaatacaaaaattagctgggcgtggtggagcattcctgtaatccttagctactcgggaggctgaggcaggagaatcgcttgaacccgggaggccgaggttgcagtgagccgagatcatgccactgcactccagcctgggtgacagagcaagactccatcgtgggaaaacaaacaaacaaaagaacagtgctggtaccccctaaatctataaaattttctaaaaaataaaatgacaataaaggaatgaaaaaggcataggtacaagcagatgggataggacactaaagcaagctggagtaatactggaattctagaaggtagaaggcttagcagagcagttcaggtggaacccacgcctgtgggggcaggggcatgagcagtgagcccatctaactacgggaccccagataggcttgggatctagaagcgacagatgcctctaaaggctgggggtaggctgggactgaaagcagaattggtgtaaagtctttaaaaggagcaattagatccacaaataccttcctagtttctaattattctaccgcttaggagagaggggtaaatgactccctgaaaacagagaaatgaagtgaaggctatcatgttaaatggggacaacacctagcccctccttcctcaagactgacaggaaagctcctacaacccacgaaggagtttggaggggtgttgtctgaggaaactaataagtccaagagaaagaaccttcagaaacggacatttaaaggattaggtccccacccgattaccctagagatacacatacagaaatgtgattggacagtcaaggatcaccgtatgatgcttctaacctgaacaatagacacctagtcacacacccaaacaatcacacacacacatacacacacacacacacacacttacttcacttctgctggaggaatttacaagatgaagaacatcttgtatctcttttgggctactgtttgtgaaaggaatggttgcatgtgctcttggctaagccaactccatcctgaagacagatttttgtgaggtgggggaaattcgcccagcgttaatagtgttagtggttgtcctgggtccatcctggtctgtattcctgctttttcattttcagatttaaatccagagttattacagatggtaacatctgatgccaatttatggatctttttcataattcacctgctaggaatctcaggtaacctataaaatatgcttttatttggtcattttaagagttacgtttctgaatttcaggtattttatcctgtattgtcagcacattaaattagggaacacattcattgacattctatgtattttcctttgtatttcaaagtcagagtcaagtatttaaaaagataagatctttcattttgtgtgtgatcccacggaatactttctactgtagatttattaaaattctcccacctctggcctctgattaaggaattgcagagtattctctatgacaactcattaaacctattattccccccagggcggtttagtatatcactaaatatacttttagtgatatttgttgattggagcatagcttttgtgtttgccaaacatcattgatgtgttttgaggtcatgtggttgtggggggcagggggtggttgtaaatgtaatagtgtccctctagtattgtaatacttcaaggacatagaatttattttttaaagtcttaaatctttttgtttgtttttctaggaaatcttgagtctatgttctttgatttgagactatagagtttcttggtaaagtctccaattattggttttctgagtaaattcttgagaattggtgaggctcccaggattattgtttgtcatcctgttctaattaatagagaaaaagcatataaatcttagatgtcttagatctgggactattgcatctacttggcttgagccaaagtgtcatctaatttttatccagtaattgtggcaacatattgcttccaaaacaaatcacatttgtaaatgcatattgagcattttctacatgaagggcattaccagggagtgaaagaaatataaggtctgaattttgtcctctgggagagaacattctagtgggagagatgagttgtgaaaagttaaataacaaatatttatagatggtcaatataggaacttgcaaatattattaagattaattacatgtgaaaaattgttattgaattcaaggcaaaagaagtgaacttaaactgagttgcacaggaagaactcataaaaaggtgagcttgtgttggatgagtggatttgggcagataaagaaagacaggagcaaaaataaagaggtggaaaaccacaggggtgtttgatgtatgcagggcacggaaatcagttgtatggtggggggtaccttcaacttaaaacctctgtaccagttagggtgcttgagttgtaagaagccgaaaccaattctggctcatttaggcggagaaagaatttacaatccatgactaggatatatccctccatctatttaatccctgtttaacttttctttattttttatagtttgtatagttttctatgcagaagacttgcacatctttcgttacatttgttcataagtatttgacacttttatgttattattaaagattttctttttttttttttgagacggagtctcactctgtcgcccaggctggagtgcagtggcgcaatctcggctcactgcaagctccgcctgccgggttcacaccattctcctgcctcagcctcccgagtagctgggactacaggcgcctgccaccacttccggctaatttttgtgtgtgtgtttttagtagagacggggtttcaccgtattagccaggatggtcttgatctcctgatttcgtgatccaaccgcctcggcctcccaaagtgctgggattacaggcgcaagccacagcgcccggtcaagagttttaaaaaaatttcagtttctaactgttgacactacatagaaatacaatagatttttgcatattgtccatgtatctgccaaacttgctaatttaacttattaattataataattttatctatggattcttttggattttccaaatatacaacatgccatatatgagtagtgacatttttatttcttcttcctagctccgtaactttattctattttcttgacctactgcattgactaggatccttcactacaatgggaagaaaaagtgatggtgggcattcttttctcactcctgatcgcagggcagcatttaacttttcaccattatgaatgatgtttgctctacagatttctgtagaaccatttatcagattcaggtagttaatcctaacttggctaacagcaattaaaaaaatgaagtaatataaaaattaagaaattaatatgctgctaatgatatgttgttgagtaacataaatataccaatttttctatatctactgagatgatcatatgaatattgttctttatttactatggtgaattgcattcattaattttcttttctttttttttttgagacagagtcttgctctgtcacccaggctggagtgcagtggtgcagtctgagttcactgtaaccttcacctcctgggtccaagtgattctcctgcctcagtctcccgagtagctgggattataggtgtgcaccatcacgcccggctaatttttatatttttagtagagatggggtttccccatgttggccaggctgatcttgaactcctgacgtcaagtgatctgcctgtctcggcctcccaaagtgctgggattacaggtgtgagccactatgcctggctggattcattaattttcaaatgcattttaaaatttctgaactaaatccaacttgattataatatactatctttttttaagggaaaagtagatgaatcagactcagcaaaaataggagccagaatagcaactgatacggtttgtctatattcccacccaaatctcatcttgaattgtaatctccataacccccacttgtctagggagagatctggtgggaggtgatgggatcatggtggcagtttccctcttgctgttctcgtgatagtgaattctcatgagatctgatagttttataagggcctcttcccccttcgctactcactctgtctctcacctgccaccatgtaagacgtgccttggctactcctttgccatctgccataattatctgagatctccccagccatttggaactgtgagtcagttaaacctcttttctttataaattacccagtctcaggcagttcttcatagcagcgtgaaaattaactaatacagcaaccatggcaggggaaggccaagcaccttgactgagtatatccaatgggagaggagatttttttctcacagccaaatcaggacactcacagctttgtgtttaaaagcttgggctctggactcaggctgcctggtttgaagtgccagtcctccctcttatgtggcaggggaccttagctctgagtatccttctctataaaggaggatgatgttctatttacccaataagattctaaggattaaatgatacattaaagtgcacaggtcagatcactctcagcccatagaagtaattataattccagctattattattgttatttgtgaatatgagaaagaagaaagttcactctgacatcctgtaaatggaaaattcaactgaacattgaaaaatgtttaaatctgtctatcagaaagtttttcatcaaaagaaaacactgagtagtctagtgttgtagcttgatccaaaaccttgaataattttcaaactcatttatgatatctgaaatattcaatgacttatacctttgaattttttggcagctttgtggaggtatagctgacatataagaaactgcagatattcaaaatgtacagttttataagttttgatgtatgtatacaaccattaaaccactaccacaataacataaggaacatacctgccccccatccacacatttgatgcgcctccttttaaaattctctttcctaccctccacccctcactgtttaccaaaaagaatgtctgatggtgccctgggcagtcccactctgcctagaaaacaccatagaaaaagacagcaaaagtgctttctcactctggagttctacttgattttaatggacatagattagtgtgaaccacataaaccagtactaaaatacaggatttgatctagaaaaggtgatgctaaaaatgcatgtagataaaacctaatttttttcagacaccaaaatgaaaaattattagtatgccatgacacatgaacacttttatattccacaaccactgtgctctccttttggtgttcatttgcaatggatggaatgtttatgtcccttccaaatttgtatgttgaaatgctaactctcaagatgatggtattaggaggagaggctgttgagaggtgattaggccatgagggtggaaccctcaagaaaaggattagtgccctcagcaaagaggcctaggagagctagcttgctcttcccagcatttagggacacagcaagagggtgccgtctgtgaactagaaagcaggccctcaccagataccaaatttgccaatgccttggccttggacttcccagcctccagaaccatgagaagtaaatttctgttgtttataagccacctagtctatagtgtgttttgttttagcaggctgaatggactaaggcattatttattgtgagttctattcaccatggagcatatgtggcctatgtgtccctggcactgaggcaggaactgagcagagtacgcaggggaattaataatgcttggacctatctttaaaacacctagagtttagtaggaatcaactggaagtagtagggtaaaggaaagtaggtgacttttgttgagccctgccatgtgctagagactgtgctaaagtgatttacccacattatcttatttgaacctcatggcaagcctgtgtggtaggtcctattcctctatttacagatggggaaactgaagctcagagacattaagtaatttgcccaaggttatagaattatcagcaacaaagctgaaagtggcaaagggctctttctagtcaggaggaattaagagagcttgggtgcagtggctcacatctgtaatcctagcattttgggaggccaaggtgggaggatcagttgagcccaggagtttgagatcagcctgggcaacatagtgagacttcgtctgtacagaaaaaaagaaaaaagaaaaaaagagcttgggatcgtgcctcctgtgactcagcatcaccttagtcttggtctgcctccattctgaattgtgccctaaagctagtcattgcttccttcttggtttctgctacaagtttctgcctctcccactggcccatttccggggttcctgttcctgttatgcacatcaatccctagatttctgaggtcccagagggtgggcttctgcttagtccctgtttgtcttcccagggctaggcatcctggtccttagccctggcactggggcttctctccctgctgccttcgaccccccggggctgaccatctgctgctctatccctgcatcctgccagctttcacatcccctgtctcgagctctgcttgccctttactcttgaggggaactccctgcctccacctgttggactggtctggtcccttcactggtcctgccctttctgaccatcttctactctggtctggcctcccattttccagagctcatctgtctccatgtgtgtcctgcttctcagagggtcttgagttccagcttttccaggtctggctggtgccatggccaaaacctgtcccacctctcccattcgagttcctcactagctcctttttgacagttctttcttttttggggtctagctttggccttgctgcatgaatcattaacacataaatatgtgtcttcacaattaattgtttccatttggtgtttgctctagtcaaggaggatggagagggagcaacatcttgtactgaatgtcttgacatcactaggaactagactgcttgtgcttcccgggcatgctgaggtctcaagaataaagagtatccctgaagacattcttatcagtcttccctggtgaaacattcatcctaatttttccttttagctttgagaccacttttgcatgatttttaatatgtcattaaattaaatagatataattttctctgtctagccaagctgctgttagaagaatctttgcatacaactaatcataaaaaagacattcttcttgcctctttggaaaggagcctgtgtcacctaagagtgaggagtacactcattcttttgtgccttgttcatctgctcaggggattattgattagcagatagaatgtgggtgcaggctggacgcagtggccatgtctgtaatccagcactttgggaggccgagatgggtggattacttgaggtcaggagtttgagaccagcttgtccaacatatagtgaaacccccgtgtctactaaaaatataaaattagctgggcgtggtggtgcatgcctgtagtcccagctacttgggaagctgaggcaggagaatcgcttgaactccggaggtggaggttgcagtgagctgagatcgcgccactgtacaccagcctaggtgacacagtgagactccatctctcaagaaaaaaaaaaaagaaatgtgggggcagataagttttttggggggtttgcttttaattctttggaagaactgggcttggctggctgggcacctagagcaatgtggacatgggcagctgcttgtcccatggatgccagggacagagtcacaagagagacggttagaaatggtgccaggttctcgctgcctcgtgccaggtcagctcccaacaaagcctttgtacaagacacatataaaccctcagagagtttatgctaacccagtgtcttggccatggcttactcatgatggaaaactgatcatattttattctggccacatggaataatagacatgtaatcactatgagatttgagttgcagggtctttggtttctaataacctttataattttctccctcatcagggagacagaataaggtgtttacattactactttcattttgcaagaataagatcgaggttaaatctacagttatgtcttgatagactgcagcagatttctgcatcagtagaaagtgctgttttcccactaatcagaagaagaaagtgctagccataatgatatgggtccactgtgaagtagaagacaagaaacagagcaggacgtggaattgggagcaatgagaaaaggtgcctagagttgctcttggcaccctgcaccttagatcacccttattaactgcctgctgtttactctgaaaatctttctgtcatttttgagagataaaatctgaaaatgcagtttcttcaagttagaaatgataatttttataatagagtttaagaaagccatgcttcttttctcttctatgagaacatttttatttcaattataaaattgccactataaatagccagtcaagttcatagggcatgagtctcatcaggcggataatttacattatataaaaaaagtatgagttatttaactaaactaaaaaagcaaccagtatcttgtggtcacatactgtatgtgatcccttttacttgcaaggtaaaaagtggtttcataaccttgccaatataattccaaagaactaaggacttagtgatcgttgctaattgaagttattctgtttatgagcaagcaacactatttctttgatgaaaaccagaaaggatttacgtgtcggtaaatagggttcctttatgtttgtgtatgtgtgtgtgtttgtgtgtgtgtgtgtgtgtgtgtgattttatgaggtttgtctcattcttctatgctagtgagtgttgattagttggattgccttttcagttgacctattgctttttaagagcatttttggatatagtcccttaacccagaattaacttctatgataaaaacgctttttgggttgtcagagaggctaataggggatatatgggcagggagttttttaccagccgtcagatctcatcttgcagactgtaactactgtaaccatgccccatgaagggtagtacaaatcatgctattgaaattgagagagatggctgccttttggacaggaagagaactagaagtttttgactttgtgaatctaacctctgcagctgcatcccccagggctgctgtccacataccctgtgctccactccctctcatgatttctctcaccaccgtcattctttgtttctcttgttcctttatcctgaagctctcaacctatgaacctgtgaaaagcccagataacagtaacagattacatttatttatggaacatttattatagatggtgtcattttctaagtactttaaccatattgattcctttaatctttgcaatcatgcagtgaaacaggtgattctcatactcccattttacagttgaggaaactgaggcactgaggggtgaaatgacttgtctgggaccacacagtacgtagtcgagctagtatttggacccagactgtctaactcaagagcccaagttattggccaccatactctatagcacctctaacccagatcaaatatacacagcaccatcacatagtgaaattaatcagtgtcatgtccattccctctgcttaattgtatgtttcttgtgatgaggaacataagccatctccaatgcctggggccacacatagcagatgccctataactatcatcattgtcatcgtcattcttatcttcctcttcctcctcatcataatctactacatataaggcaaatttgtgggtcaggcacacttcacataaattagatttaattctcacaacaatcttacgaaatttgtgttgtccccagtttatagttgaaaagaccttgcatttaggaagtggtaaaatgggaatttgcgaccctgccatttggttccagaatccttcctcctaaccactctataccatatgcttaattaagaaaaaaagaaacaaataggtgagaaaaaacaatgatgtgaagaattttgctgcccccagtattaggattttttttcttcttcttgctagactctagagggcccagatcctgtggagctgtctctctgaagggaagggtcaggctgttcaccctgattttcctggagtcacagataaacttctgccctccaccggatgcctctatcttacacaattattttcctttacaaatttggttgatgacatattcacttgggataattgggttgtccctcctactttgaaactgtgagagagttcactcaatttccaactgcgtatgaagctcttgagtcagatttttttgcctgtaacacctcagctcacaccagtgcagaaatggaagttttaattggctgtaggattgaagggttggtttggtgcatggtggtattttaagaaaggcaaagttttatttaaatgaggaatattctccctgggttttttgagttagctactgggccatgcaacaggcctggctgcttgtgagaaaatgagaagggtgatcaagtacaagaagatgcagccaaagaagtggacacaatccacgtcaagttccatcttctttgtggcagccatgattctgaaggtcactgaagggtatttttccctgagctgtttttggagcctgtgccactggcttcaaatgctgggtcttggccacctcagttgctataaaatatggttatgagtgcttccgcttcccagcatctagctgacaaagccccacttgtgccttgctcagccccacttcattgctcctgccctctctggggagagggactcaccacctgggtgacaaggttagggcttcttgctgcactttttggcatcttgctgctccctgtataagggcaaagctaaccttttttttttcttttcattgagacagtctctctctgtcacccaggctggagtgcagtggtgcgatctaggctcactgcagcctctgcctcctgggttcaagtgattctcctgcctcagcctcccgagtagctgggattacaggcttgaaccaccatgccaggctaatttttgtattttagtagagatggggtttcatcatgttggccaggctagtctggaactcctgacctcaaggaatctgcctgcctcggccttccaaagtgctggcattactggcatgaaacaccaccccacctccaaccttcaaaagatttaaaaaaatgtgaaaactgaaatgaagactagatactaatgaaacattggactcattatgactttgttaagtcattttgattttattaaaatcaaacattaataaagcagactgtgaataaataaattatattctttggccatttcttcattagacaaggatgctatctttcatggctgtgttattgtggggatggctgatagctcatagaaccaatctaacatccacagatttttttcatagttctggactaggtttcttagcataatgcgttgttgtggtcctcatggtctgttgttctctcttgccaaccttgtttcatcagtcccctgttgtcctgcagatttttgaagcattggaatcctagcaacagatttctcatttaagtaggatggtcctgatcactagtctcccacagagagttggtaaaaagttttgttcttcttatcacccacagaacttccctgaaacattttttgttgtgcttgctcagaaaccataagcttagtagaaaaatgcaccttgcttgtgaatacacaatcaggtgtccaaatgagatggtcccctcctagaagataatatttcggaagtcttgcctcagtgggaggtacttggttgtttgtttttgttttttttttcatttcaatagctttaggggtacaagtggcttttggttacatgcatgaattgtatagtgctgaagtctgggattttagtttacccatcactcgagtagtgtactctgtacccagggtccttggattttatgggcttgtttttgtttgcttttatgttaagatatgaataatatgatatgctttggctctgtgtccccactcaagtcttatctcgaattgtaatccccataatctccacacgtcaagggaggtacctggtgggaggtgattggatcatggggggcaattcccccatgctgttgtcataatagtgagtgagttatcatgacgtctgatgtttttataagtgtttgaccattccaccttcacacgctgtcactctcacctgccgccatgtaagacatgcctcttccccttctgccataattgtaagtttcctgaggccaccccagccatgtggaactgttgagtcaattaaacctctttcctttataaattacccagtctcgggtatttctttatagcagtgtgaaaacagactagcatataatagaaggctctttacctttttaaacttggaaggccaaattaatactgtcctttccattataagaatcttcagattaaatattttctcattcattgtccctcagatcatatacatttgctttttaactctaagttacatgtaataaacaatgaaattgtattgtggatcataaacttgagttttaaaaagatttttctcctaattttaaaagtaataaaaacaataaatacttactgtattccaggtagtgtttttttttttttttgagatggagtttcactctgtagcccaagctgtagtgtggtggcgtgatcttggctcactgcaacctccacttcccggcctcaagcaattctcctgcctcagcctccttggtagctgggactacaggcacaagccaccaagcctggctaattgttttgtactttagtctctactaaacagggtttccccatgttgcccagggtggtctcgaactcctgagctcaggtgatccacccaccttggcctcctaaagtgctggtattacaggcgtgagccaccgcgcctggcccaggtagtgttctaaggggcatgcttccattaattcatggaattcacaataaccctttgttgcagtaactattattatccccactttacagataggaaagcggtacagtgactggggcagagagaggctctgtgactttgtgcaagcagcaatgtaggcatttgaatttcggcacgctggctcctgagtccattctactaaaaattgtgctgtatttaatgcagagaatttcaaaaacatgagataaaaaataagagaagaatagcatcaattttcccatcattcaaaggtatctgttaaaaggaaacatttaaaacttagctatatatactttctgaatttgtatgtacatataaacttataaaaaatgaaaatgctaattgttttcacacgtactgtttggtagcctccctttggtatgttcccagaccaaaaattattattcttccccatgctttttttcagctacataatgttctattttatggaagtacatcatttccataattgaatttcttattaagacatattatttgcaaatctgcaacaaatgtgcatgttatttttagacgtatgtttggttatttctttacgatagagtcctagaatcaccggctgaggcaagggagatgcacatttgaagcctctttattcatcttgccaattgtcctcaagaaacattgtttcaagtcccattaatgcaagcaatgaacaaaagtttttatttttctggatactggatgcctctggcttatttttctttctattctgtttctttaatagacaaaacaaaagaaaaagtttctcatatcaatgtgcatttttttgcgatttgcaaaaagttcaaaaattaacaaaatttatctattccttgagtaaatgtatgtggttcaagatgtcaaagaaacaaagtattgtgcagtggaaaatgagtgcaccttcagcacctgcctcccagacatccatcagtaaccctctcaggaggcgaccactgttaccatttccttgactagccttcctagaataattatgcatatacaagcaaagaagggtataagggtacacacacaaataagcatactacatatattgtttttgcccttgtgtttttcacctaacaatatattttggaaattattccatattaataatcaaataatgatattattatttttgatgcctacctactattgcattataagggaattataagggaagggttgcaaatattaacatctgttaattagctttggatatttcttcttttgcaaatacttgccagtgttctttgagcagtcttagaattgtggttttaatgttttgttattgatgatgatttgtaagtctttgctgtgaaataagatgaccgaccattggtattaaatgatgtaaattttatttcacatttcattgttgtcttttcaattttgttttctggtggtaggcttattttgttgttgtttgttttgttttggtgtggctatggaagtctttttgggcaatcaaatctatcaatcattttgatttgatttgtgaatgattttcctggattttcctggatgatcagaggctagtgttgtctctttgtttacttagattcttttgacaagggctttggctattgtgaatagtgctagtatgaacatggatgtgcaaatatctcttcgagaccctgctttcaattattttgggtatatgtccagaagtggaattgttggatcatatggtagttctatttttaaatttctcggaaactgccatactctttctcataacagctgcaccatttcacaatcccaccaacagtgcacaaggattccaatttctccacaccctcaccaatgctcgctattttttgggtgttatttttgacagtagcccatcctaataggcatgaggatcaattgttctgaacataacatttctgtcagggtttttaaaaagtttccaaaatgacatccctccagctccacatattctataagagcaatatcataaattagaagctgtctatgaaaacttgtagttggaagatgtttgttttctgtgggttagttacatttcacatatgcctcatttgtgaaataatttctaatgtgcatgagctggaattcaatgcctgtagtcaaagtaggcttaattttgaattggagttgattaaaatgaaatgactaattagctttatattgacttgggagttgtcccctaaggaaggcattgggacaatgttgatactctgattacctctattcctacctctgttagcttaaaatattagtactgcattcagcacccagcaagaatttctagtatctgaaggcagcaggatacttgcagccattttcaaaccatggaatatggatgattggtagagacttctctatcttgagtcccttctaatatttcatgctttatcttattcataagaaggggcttcactaagtaggactgtcttgtcttgaccactaggggatcaaggttaagtttcttagtcttggtaattgtcagatttctagtctttaaaatagggataatgtcatggagtacctatgtcagagttgcaaggaccaaacgagctaaggcatgaaaagcatttagcaaggtccctggcaagtaagggctaaataaacatggtgtttcttgatgttatgtcttgtaaccattgtaataatctcagtcaatcagatttatatcagggtacaggttcttttctggggaatttttctagcaccaggtattttctgtttatcttctatgtggatggcttttccttatttcttctcattgacaccaagggattccaagtcccattctgattgtgtattgtcaaagtgaaaaacagctgtggccagcagagccatgactataaccattttcaaagtcctgtgtgtaacaaacctcaaggattgatttttcactaagcctttctccttgactgtcaaatgacaagcaagggtatgcagatgataaccccgaacccctttgatcccatttccaaaatatggccatgccatagatgaaggcaaattgttttatttcatcttgttggccccattgtgtatgctctaagttcattttggacttctgtctttactgatagcaatttctatttctttcagacagaagccccttctttcataccttttagttgcatttcttagcattctggccgcagtcttctactacatggtccttatttgtcatctcttccctttcttcctctctccatcccttttttccattattcatccagcaatatttattgagaaccaaccatgtgaggggcagcacactggacattgtcttggcttcctctgtcactgcagatttaatggatcactttagacttatgcctgtattattgccagggttcccctatgtatattgaaacaaatagtctctggggatctttccattttctgccactgattttttctttcttttctttttttttgagatagagtcttactagctctgtcacccagcctggagtgcagtggtgcgacctctgctcactgcaacctatgcttcctgggttcaagtgattcttttgcctcagcctcctgagtagctgggattacaggagcgcaccaccatgcctggctaattttttttttttttttttttttgtatttttagtatatacaggtttttctcatggtggccaggctggtctcaaactcctgacctcaagtgatctacctgcctcggcctcccaaagtgctgggattacaggcgtgagccaccacacctggccattttctgtctcttctgattgggctgtgtatctgagctgtgtcctgggccactgtgccatcccacagctgacaaaatggctctcacctccaggaaactcttacctcagcattttttcctctgtcttgagcttttcttttgttctctgggaatagtcctcttactttcttggagcttctttagttattttttgatcaattttttttacacagttttttgtaacggagcaaaatattttcagaacttgtttctggcatgtgtgtgtctgtctcatctatctgcctgtgtctatgttaaccgttctttgaatctgatgcccaatattctatttgattctgttgattctgaaaatttctttttagtcattggtttagcatttctacctcttctccttaaaccctaggattttctttaaaaagtgttgggactgatgttctgttcttcagattggcgaacatggctcaaagaccactagtgtttaagcagcagcagcttttctatattctgcttgctgtgggcacttgtgatgtcccactgtggctgccatcagcagagatgtggatcctggtggtggctgtgtctgcctcctggccagccagcttcctttatagggaagaaatgcttccgcttcttactggggtgtgagaggcgggcccgtcagtcactgctgctccctagcactcatagcaatgtccattttctatcctttgtgccctgatgataatctttctggtatcataactgtcttctcctccccttccctgtctcctcttcctgctttttttcttcttcctccttctcctcctcactccagtatcaaggcttagcttaaatgtgttgcactataaaggcctcatattttaaaaatataattcattcagtcctcctctatgcctaagcttatttctttgttatggcacttttcatttcatagtatagctctctaccgaggagcgcatacgggataagggcagagtatgagtattttttgagcccaaaaaataatagtcatttttattggtatagcttcaagcatagttcatttacatgatttatgttttaggaaatttcaagtgcagaaaaattgcccagcagttagagatgattgggttatcaatatgctccctgttttttggtgtattttttccagctttattgaggtataacttacaaataacattgtatatgtttaagatgtacaacttgattttttcaaaattaattatttttttgaagtaaattttattgtgtatacttaaggtgtacaacatgacgtgatgagatatatatagataataaaatgattactacagtgaggcaaactaacgtatccatcatctcacgttgttatccaacactaaaatctacgcatggagcaaaaatgcggaatacagtacaatatgattaactatagttctcatgttgtagattaaatctctagacttgttcatcctatatctgctactttatagcctttgatctacatcttctcattttcttcccttcccccaaccctccccataaccactgtgttatgttctatttccgtatatttgacttaataaaagattccatatataaatgagatgatgcaatttttttctgagtctttgtttatttcacttagcacaataacctccaccaggctcatccatgttgtggcaaatggcaagatctcattcgtttttaaggctgaataatattccatttgtccatttgtccatgaattgtcacttaggttgtttccatatcttggctgctgtgaatagtgctgcaatgaacacgggggtgcagatatctttacgaggtggtgatttcattcctttggatatatattcagaagagggttttctggatcacagagtaattctattcttaattttttgagaaaatttcatactgttttccgtaatggctgcagcaatctacactgccaccaacagggtacagggttcccttttctccacacgctcaccaacacttgctatttcttgtctttttggtaatagaagggcagggcatcattaatattgtttcccttacatgtgctgaacaaacacagcagagcagttaccagcgctaactctggaactggcttgctcatgctcatctcttgtccctgccagttcctaactgcggaaacttgggcaagttgcttaacctctctgtgccttcctttgttacttggagctgataaaaataatgcttagaacagttactgccatataaaaagtgctattaagtgtttgctattatgtgttgaattcagcttaatagaatcatcatcaggatcaccagcaatttattgagtgacagtgtgtgttttattcattgatcgtcattacacttagaatagggtcggggatatagcaggcattcaatcaatatttttgagggaatgaattaatgaatgggctagatgttatatatacaaagaaatatgtctaatttctttccttcaggtctcacagatggttgagaatacaagatggagataagacgaaaattgaatggtgcttaatatgaagcccttcaaggctgcctctttcagaatcatttaggaggcttattaaaattgcagatttgctagccaaactctcctcgatctcagttccatagatctggacgtcggtccaaaactctacagtgccaagaaagctccccaggggcttccggtgaattcccaagaacagccaggactgggatcgcaggccaggcagtaaatgatacaggagatgagaggagggagagctctgggggctgacactgttgggaaggcctggtgggaggggaggtacctgcaagggcatgtagggcttgggcatggggtggacttgatcgtgggggcttagactgcagtagagacattctggtcacatttgcctgcccatgagctccttccgtctcctgatgtgcctcagcaatttcatgtgcaaagtacacaagagccatttgttggaaagtacctaaatcactctatttactgagtgctttacttgcacttataaatctaaaacaaattttcaagcaaataaacaagtgtgtggatatggagcagaaataccactcatggcatcctgaacttggccctctgactcagtaattagtatcctaaaactgagttcaagcatcacattttattttcaggttttacatacttcatagaacttggtctctgatgttacagagatcacagtaacagtttaccttatctccagaatttctaacttctcaatggtggcatctctcattagaacaggtagtcaccaaatagttccacacaaagactctcccaatgtgtcatttattaaaacaaacaaacagatttgatatacaattaatataccacaaaatcacccatctaaaatgtacagtctggtagtttttaacatattcagaattctgcagctttcaccacgaattaatcgtagagtattttcatcaccccagagccacccctccctacctttagtcacttcccatttccccggcccctgataatcactcatctgctttctgtctctgtggagtactattctggaaatttcatataaatggaatgatacaacatgtggccttttgtgactgacttcttttacttagcatactgttttcgaggttcatctatattgcagcatgtgtcagcacctcatttctttttgtgctgaacactattctactatataaatatacttcattttctttatccactcattagcttgtacacaactggatttccactttttggctatgtgcaaagtttctgtatgcatgcatgttctcatttctcttgggtacccacttaggactggaattcctgggacatgtgctaactgtatttatctaactttttgagaaatcttcaaaatggttcccaaagcagctgcactattttatatgcctaccagcaatgcatgagggttcaatttctccacatcctcaccgacatttgttattgtctttgattatagccatcccagtgtgtgtgaagtagtatcttgttatagttttgatttgcatttccctaatgataaatgacataaagcatcttttcaggcatattggccatttgcatatcttccttgagaaaatgtatgttcaatttttttccatttaaaaatttgatgattttaaattttattgttgagttgtaaggattcgttatatattctggatagtagacccttatcaaatatatgatttgtaaatattttctcccattttgtgaatcttttcactttcttgatagtgtccttggatgcacaaaagtttttagttgtgttgaaaaacagtttgtatatcttttcctttggttacttgtgctttatgtgcatatctaagaaactgtttctaatcctgggtcaggagacttacaactctgttttcctctaagagttttatagtttcagctcttatatttaggtctgattcatttagaattaatgacttgtatatggtgtgaggtagaggttcaaatctattcttctgcatgtggctatccagttgtccgagcactaaatgtttagtccattttcatccttccattttgtcttgtccaggctgttgaagtagcctcctcacagctctccctgctcttagctcttctccaccagagtccatctcccaccatactaccagttattcatcttatacacagatatgattatgtcctttccttaataaaaaaactttattctttccttagtttctataaaatagttcaaatattcaacataaaattccaggtcctatctagcatgacctcaacccacctcctaattttactgtgttccttctccccacttgctaccccatcccagccatccttgacttcttagctggtctctttctggcctgagtgagacatttggcctggatatatatgcatggtatggctttggttgcttactgtggcattggtgcttatgggatagccattgactttaattaatggggtgttatcagcacatttatcctattgaaatgactagaggaacccataagaaaccacattttcaggactagtaatctattttagcatcatttggaagacaacaaactttcattttatgggtagactaacattcacaaattatgacatatatcatataatcataatcattaagttatattttaaataatcaaccatccaccatcccaaactctaagactttgttggtaagttttgtatgtcacaggttcatatttttcacattctgacacctacattcaaggcctcaaactttaccagagactttttatcattgaggtaaaactagaagtcattaatttaaaaaattatattatttttaattatggtaaaaacataaaatatacattttaccatcttgattttttaaagcagtttactagtgttaagtatattcaacagatctccagagcttttcatcttgtaaaactgaaactgtaacccatttaccaacaactccttccccatttccttctcctcccaaggcctggcaaccaccattattctttctgtttctgtgaattttactactttagatacctcatataaatggagtcatatggtatttagcacaaggtcctcaaggttcatccatgttgcagcacatgacagggttttcttccttttcagggctgaataatactccattttgtctctatatcacatttttttgtttatccattgatctgttggtagacatttgtgttgcttccacttcttggctgttgtaaataatgctgctgtgaacacaggtgtgcaaatctctttgaggactctgctttcagttctttgggatatatacacagaagtgtatataggattaggattgcaggatcagatgataattattgttttaatttttcaacttatcttctcgaatgagaacactaaattaaatttgtggggtttgtgtcattttagacatagctcacgaagaagatggtaactttaaattgtccctgcaacaatgatgatgggcttcagtgattgtcttaaatgagtcatcattatttttgtgttttataaccaaccctatgcatctgaacacaaaagtcaaacctttttaatacctcaggtgtattttacaccaaaatacagggaaaaggcatcaatcaaagctgcttaacagctgatatgatagtgattacatgtgatatggtagttgagactgaaatgctatttgtaatacaaagattatcttaactgagtctgatttgaggtgaaaaaaggtactaattagggtgacaatatgaatttgatttaactttaaagtattatgagagaaaacatactatgtcacaactcttttatataacgaactgggatttaggtatggagtgggtagaatagtggtcaagagcagggattctggagtcaagtgtttggcaccaatcctggctctggccattgccagctgcatgagtgccactgggcaagcttctcacagcaccagatttttcatctgtaaaatacggttaataatggattgtggtggcattacatgaattaatatacgcaacatgccggaatgacatctggcagggaggaaaagccatataagattttgtaattgattttctagcacaagctatccattcttaggttgttgtatcttccttgtgtcatcccacatatcaatattgtcatctgcaaaaaatatacacgtatgtctcttttaactaatgattttaaaatgtggactaatcaatgatctaaaatcccccttccttttagtcaattagtagttcataaattgaagatgtgatggatagaacatttcgtacccagaaagctcttagattgtgaatgctgagggaacactgggagattcagtgagtgcagcacaaatacaatctaggtgactggaatagtttctaatgaatgaatcactgaataagcagatgggttgtggaaggcaaaccatgagtaaattttttcttttactacagaaatatttctgaaaggtaaatacccaggtttatgatgatagaccttctttaaactcatgctatttttctttctgggttttgttgtcaacacaatctcatctgctctttgcaaccattacctctcagaatgggtatgaagatcaggtgcaaccatgtatgtgataatgcttctaaaaactattttttttccagttttattgaaatatattttgcataaaaatataaaatccacccatttaaagtacaaagctcagtggttttcagtacattcacagagttgtgcgatcattgccacaattaattcctttctgtctccatggaatctaattttgaacattttatataaatagaacaatacaatatgcggtcttttgcgtctggcttatttcatttagtatagtgttttcaagggtcatttatattgcagcatgtatcagtacttcattctttttattgccaaataagacttcattgtatggatatgtactacattttattttctcattcatgagttgatgaacatttgggtttccacttttggctattacaaataaaattgctatgaacgtttgtgtgtgagtttttgtgtggacacacatctttaattctcttgagtatatgcctaatagagaaatttctgagtcatatggtaaccctatatttagcacttccaggaactgccaaatggctgtacgattttacattccaaccagcaatgtgtgagggctccaatttccctacactgtcatgtacacttgctattatctgttttgtcataatgggtatgaagtggtaaaactactgaaaaaagtgacatattcatggagtaaaagtaaaattgaaacatgcagaaagtattcttcaggcccagacagccccccagaattacagttttttttctagagtccttgaaagttgtctatgcacatatgacgtatccctagatatgtatttgcaagaacacatgtaggagtatactattttgtatcattctttatcacttaataatatacctaagagcaattgctatagaacaggttgacctgcctcattctttttactcttagcagagtattttttgtgacgatgtaccttcgttcgttttaacagcttttctaatgaagggcattttggttggttttgctcttataagtaatgccatgcgcatccacaagacatacaattgttcttgagtacatttgtgaagatattcacaggaaaaaacaagttatactgctatataccaccatcaacaggggatgagagtgcctattagcccacaatctttccagcttaacactgtgtgttatcagcctttcccatcttggccaatgtggtaggtaaaaaatagttcagtaaaagttgatttgacctataaggggcaaatcaagtttatgttataaagcttgaagttcaacattgaagttgaactccagataatatggttaaagctttcaaatttctgagaaatatgcaggcatagagattgtatctaaatttgccttaatacatagtatatccatttgctaattgaagaaggtgattggttcatttatttattcaactggcatttattcagcatttatcgtatgctaggtgaactttaagtgctagagagaaggatgaataagaaacatacattgcttacaagtaatatatagtctaataagggggacatatatatataaatcaataagcataatggacatgaaatagaggcaagtattatacaataagctgtgtatattaggccataggctaagctactgtgaaaaaaaaggaccctcaaatacttgggaaattgcttttgggaaaagacaaaaaaaaaaaaaaaagcttgtggaaaagggtgaaaagtggacatgagagtaaggagagtaagccatttttaaaataaaattttattttaacttcgattgtcatatggtaagtgtacatattcatgggataaaaatgaaaggttttgacacatgtgtgcattgtgtaatgatgaaatcagagtaattagcaaatccatcatctcaaacatttatcatttctttgtggtaaagcattcaaaatcctctcttctagttagtttgaaatatacgatgcattattgttagccacagtcaccctgctgtgcaatggaacaccagaactgattcctctcacctaactgcaactttgtaccagttgatcaacctctccccatagccatttcctcttaagcaagaaacatggaaattgtacacattacttctgaaaatacactggcaagccacttctagttgcagggtagacttggaaaatgaagtctaactgggtgaccctgtgcctccacattattctggaggaaggggatcacggagctagggtccccagtctgggaggctggtagagaggcagctcgctgtgctactctgatatttttagctccgtgggggaaaaagaactgctagacagagctctgtcaacacagatctgacaatctcattcagaaacaagttacagagacctcaagtgattaataaacaagattattctatagaacatcttatggtgacataatcaatatgatttcaacactcagctaataaatgctatgaaatacaatttatgtaaggtgttaattgacatgtcaggttttaaatacaaaaggaatgagggagggagacatgaatatagatgggtgttatcagagaatgacacttagatacatttcatattgtgtcatgtaaactaatacctactttttgggatatttcttcatggtttagtttttaatgtagattcaagagttttatatattcaaactcttcatgaaaaaaattcagctctggttatgtacatccacatttacaggaattgaatttttctttttgtacacttgtgagtatattttttcctatggcaaacgttttccagaaagcaaaagttatttgtgttactgtccctgataatcgatgctgtgtaataaatcgttctcagcaatggcagtttggacactgatggacagttggtgactggtaatttgtacagtatgtttagtgggacggcgggcaagggggaaaagtggcatttggttcctcagtcccagatttgggtcaatgttctcataatactggtgagcaaggagcctaattctttaggaattttaaaaggtttcttttagtgaagaacatttcccaggtgtctaatgaaaaattataaatgaccaggtataattttgccaagctttccaacatagttttcctttagggtgagaaacaatcctttgattttcttgaagtagaagtctcttctcgaatgctaacagtaaaacaagaccttttcagacagattttgtattttgccatcaaatgtgcaatttttgaagatacgggacttgagaatcaggtaaacttcgttctgaaaaccaggcttaattttatgactgtgattagaaagttgaaaaaaaaatcacgttctcacaaatgaaaacaaaagtcagagttcaaactgtttatcctgtttctgtaagcttttgtttcagaaggccaaggattatttgaggagaacctggaaaattaactcaaatggaggaaaaaaatggcgtttatgcaaaatgcagcaaaagcagacagccttggagaactgaagcttaaatagcgtaagagtctgagtactagtcttcagatacttaaaacagcatttgatagacaagttagatatttaaggaaacatttaatcagcttggcatcagcattagtggcttcaatttttggctgagcctgactttgccatatgatcctagacaaatttgcctaaaatgggtgatattaacttctttagggaaaggctctgtactgggatttttttgaggcctatgatttatggggtcaagctataaaacaggaggaaacacatgctcatttgtataatttttacatatatttggtccataattgtacagctaggcaattcatttattatctgtttgagagtaaaagtttgattattttaatgttactacttctggttttttctcttctcacatgttcccagtgactcctttctgataacccaacttatcatcatagaacgcatgtaatgctgagaataagacacagggtcttggaaaatgaatgacagcaatggtgctccgatggcagttttgtcagactttgaatggtttatgaaatcactgttgataaaagtgaacaccttctactgaagggagaaatttaggggggaaaaatcccaaatagaaggagttaatatccaaacctggagacttacctggtaaggttcacttaactggtaaaatgtgatccaatttaaacaaagtatttttagttttctcagaacaaacatcctacataaacacaaaaaatgatatgagacatagatataacttggttcacaatattttccaaaactataatgtaccagccagttggtacagcacaccaggagagaagatcattattaatgtgctaatagcagcattttattttgaaacccactctgcatggttacagggctcaaaacaacatattctaacaggaagatacattaccgaaatattttaatgagaatatttaatatgcattgagaggtccgcattttcttgcagagaccttgtaggtagctctttgagatttctgtctctatgcatttaagtgaaggagttggttgggtattttagttggcaaattttgcagacatgtagctttggtagtggagaggtaatagtaccatgccctgcgtgctggcgaggaagccccacagcaacagtggcttttagcagctaccagatttgctaaaagcagccatgtccaattagcagtaagtgccatgcacctgcagttactaggaattgaacctcttttgaggctgaatcttaatgtagccttttaaaaaaatagcaaaaatcttactcatactctgagataataaagaaaaattagcaatggcaaaatggacgcactctgaaatgtattcttaataatgatttagaatatggggtaaatgtagaggcaatgacacatttaaactgcattatttttaaatactgttttatcagtttacttcctaattttgaattcaattttcatatctatactgcaactgctttttttttttttttttagaaatctataatattgctgcaggctccctatgtatgtttccataattttctgcaaagtgttttcaccagaataaaaaaaaattacagttcaaaattgcaaaactgtagaaaaaatatgctctttgacttcttttctatgtgtcaaattcaccacaatggaaaggactacactatagaattaaaacgttattttcaacagatagtacttattttaacatgtgttcagcatttaaaaatatttaatattcttttctaaaaatgcttacattcagaaactatttatgagggttctgagcagtatgatgtttctttctctgatttactgctttttctcttttagaggatattgtaggagaaaaacatttgttaagcaatttccagaactactaggttctaataagaccaataggctaataattcatttcattgcaactggagtgtgtacttttcctttattctcagtcataattttttaaaagagccaagaacaccaaatcatcaaatctaatgttgaacatgtagtaacttttatttgctgatcatactctgagattcaccataacgaataaatcataagtattaaaatttcagctttttaacatacccactacactgctagcctggtaacacagtcaccaactacacagcttcttcaactgttgacgtgctttaaagctaggattatggtatcctgccaaaaagatcctacaaactgtcactattttggtttgtcctgccagccattgagaagtagacaatttctatatacacaaaccagtttggaaaatttatgcaaataggaagttattctcaaaatgggttatttgattgcattttttttttttttttttgagacaaggtctgactctcgcccaggctggagtgcagtggcgtgatcttggctcactgcaacctccacctccgtggttcaagcgattctcctgcctcaatctcctgagtagctgggaatacaggtgcatgccaccactcctggctaatttttgtatttttagtagaggcaaggtttcaccgtgttgactagggtggtctcaaactcctggcctcaagtgatccacccacgttggcctcccaaagtgctgggattacaggcataagccaccgtgcccagcctgattgtgttttaatgtattggctcccaaccagtagcaacagtttgggtgcacagatattgccgtagtgtttctattcaatgtgtcaaattatttaggtaaaagtttggcttaactttgttgacatggaatttctatatcctccagtttctggtttaactggtttatgtggaaatgaatggaaacacatggttaagttccccagcctccagcttctctcttcctcttacctatatttgtacttgcccacttttcctcttgtgggcctgttcctagaatccattatgttctgtgggtgacatcagcctgctactgcgggaagaaatagaattttatggtgcccaagataaaatcgactatgatgatgcagaatgaagacctggagaggagtcagagattgcaggggataaaaagagagaaatcagagatgctcccacaaacagagaaaaccttcagaagcagcaggaaggacagagtaaatggagaacaaaaactcaagtcaaaatagtcaatggaaataaacagttttgaattccagttataatttggaaaagaagcaaacgtttattttaaattaagaaaaaagtcgcttataatttcctgaagtttagaaaagtgaaaaatagttaaacctcctgttgttagctaagaagtgtctattattataagtttgttgctggagagaacataaaaatctctatctattgctattttttttttttttgcataagggatggataaaagagtgtttattttatttagcctttggcctgtaaagtaagatttatgaaacaaaggacaatcggaaatgataagaattttttcctaatttctaattatttagctaaaccttgattgatttctctcaggctagtgcccatattacagcagcagtcagccttcatttatcttacctgggaccactgctaaatccgatgtcacttttcagtttttatattatgtgaccatttagccacatttcacctacttgatcattccctccatcttgagacctccctcgacccggcttccaacatactttgccctcctggtttttctttctctgttggctcactttctcagtctcctctgctggttgctccatttttccacaatctctcaaaactggtgctcctcagattaagtccttggacttctctccttagattgacatctggagtcatggcttcaaacaccacctatcactccctttctccttgaactctagacgtgtccatccaactgctacgtgacatctccactgggatttctaagaactttgccaaacttaacatgtctaaaaccaaattctgggctgggggtggtggctcacgcctgtaatcccagcactttaggaggctgaggtgggcagactacttgagcccaggagttcgagaccagtctggccaatagagaaaagctgtctctacaaaaaatacaacacttagctggacgtgatggtgcatgcctgtagtcccagttactggggaggctgaggcgggaggattgcttgagcctgagaagttgattctgcagtaagctatgattacaccactacattccagcctgggtgacagagtgagaccctgcctcaaaaaaaaaaaacaaaaaccaaaaccaaaaccaaaaaaaaaaagcaaagagcaaaacacaaaaaacatattccaaatctcccctttaaacctcctcttcttacaatgagtcctatcttgatttatggcagatccttccttccagttctcaagccaaacaccatggggtcattcttgactcctctcttccatgggctcatctaaacatcagagtatcctgttggctatctggaatttaaccacttcctatcactgccattgctacccacctgctcttagttatcaccagagttccctggagtgttggagccgccgcagagctggtttccctgctcctgcctttcctgcccatgctctgtcctgccagtcagctctgtcctttaaaaatggaaatcaggttacctcatgactcttttctttctttttcttttctttttttttttacagaatcttgctctgtcatccagcctggagagcagtggcatgatctctactcactgcaacttccgcctcccagattcaagtgattctcctgtctcagcctcttaagtagctgggattataggtgccagccaccatgcccagctactttttgtatttttagtagcgaaggggtttcgccatgttggccaggctggtcttgaactcctgacctcaggtgatctgcccgcttcagcctcccgaagtgctgggattacaggtgtgagccaccgcgcccagccatgactcttttcaaaaactccccatcttctccacttccattcagtaacagtcagatctgcatggccccctcctgaccttctgatgtcatgttctttgctaccccttgagtgcattgaacatgcctctgacccagaacttttctgtttgctatttcctcaagtgcatatcttgttccttcattttcttcaggtgattattaaaatttcacttccatgagtccttccctggcccccatatttaacactgcatcttcctccatcttctttccctcctccccatgtacattttactcccttactaaattttttttcctatctcactttcttttctttttgagacagagtattactctgtcacttaggctggagcgcagtggcgcaatcttggctcactgcaacctccacctcctgggttcaagcaattctcctgcctcggcctcccgagtagctgggattagaggcgcgtgccaccatgcctggctaatttttgtatttttagtagagacagggtttcatcacgttggtcgggctggtctccaactcctgaccttggcttcccaaagtgctggtattactttctaacctcctgtgtatgctacctatttatttgtctgtctctctacactagaatataagctctatgagggtagacttctttgttttgtccaatgctctatttccaatatttataaccgtactggccggtaggtactgtcaattatagtttttgaataaattgagagtaacaaattctaactggtgaaaataaattaaatgggccgggcgtgatggctcacgcctgtaatcccagcactttgggaggccgaggcgggcagatcacttgaggtcaggagttcaagaccagcctgggcaacatggtgaaaccccgtctctattaaaaatacaaaaattagctgggtgtggtggtgcatgcctgtaatcccagctactcgggaggctgaggcacaagaatcgcttgaaccctggaggcgaaggttgcagtgagccggcattgagccactgcactccagcctgggcgacagagcgagactctgtctcaaaataaataaataaaataaaaattaaaaagaaaataaatgatctcacaggatatcatttcttgattggaggaggagagaaaaatgtgtatgtgtgagggtacagagagagttcctttgcattagtgagggttcacatcagaactgtctaacctccctactcagtgggtcctgttacctctctcctgaatccaataatactctggtgcacaccttttactggtactgaggctattttaacgttccattaaaaaaaaaaagaaaacatttaaaatacaaaaacaaggctgtactactttaactctgaccttagaagactctcagttttataactgtttagagaaaatgtggaaatgtttgctggccccaatctttttattactcatctctataaagaggcttttaaggacatattaaaaagtttccatctctcttgtctcttgcctttcttctcatcttcctttcttgtaccccaaatggctgaaagcaagaccctgagagtctggaagaaatatattctggtcagagcagactgagctggagctggcctagaaccttggatcctgacctcagaattgctgctcaaattactgctctctgaaagagtgagctcatgcatgtttattattactgtgaacaaatttagctgttgtttcacccaaacattgaagttctcgcttggacccctttgcttgtttgtgcttttgcaaatgtgttttctcatgtgctactagaaccaagatgaaagcttcagttctcagaacaggtgccacgaccgaggagacaaaacaagagctatagaggggtgtggtgtgtgaaactgagaaagcaggtagtttttcagaaaaactgagagccaggaatgacttcatccatttcctgtaataaggcaatggtctgaccttgaggaacctattagagtgtgcttctaaacagaggccatttcgaggctgaatgtacgggagtatttacctttgactgttttctgaagcaaggtattttataaactgtaaagtggcttatacaattttaggaatggaaagttttgcaaagtctccaaaatccctgggagttttgaatgtgcaggccatatgaattctttgtagtttcatggtcttgctgttcagcattctttagagtcacctgcatggtagaagtttagtaggaatttgggtagttatgggctggtttctttgttttcccaaatagaggtagcaaaatggatgctaagaagcaaattacttttactattttagatgcctctggggacatcctgtcataatgcaacttaaaatatactcgtctcctcagttcctttttatgtatttatttaatagtcttcaaccaatttgttcttcattagctgttctacaatacttcaagagaagtcatgataatgatgcatttaggatcagaaaaatatagcatgtgtgagttcctggggactttagagaatatctagcccagtctttcattttatagaagaggaaggccagggatggtggctcatgcctgtaatcccagcactttgggaggccaaagtgggcggatcacctgaggtcaggagttcgagaccagcctggccaacatggtgaaaccgcatctctactaaaactacaaaaattaggcaggcctggtggtgggtgcctgtaatcccagctactcaggaggctgaggcaggagaattgcttgaaccaggcagaggttgcagtgagccaatatcatgccactgcactccagcctgggcaacagagtgagactctgtctcaaattaaaaaaaaaaaaaaaagaagaaggagaggaagctgggggtgaggacaggcagtgactcacccagggtctcacactgatttgctggcagagttaagcatgaaaaggtgcctctcctagtctctttccagtgttcttgtcatcacaatgagttaaaataaaaattactagcaacttgggagtaataacaataaacttctcaaaatctactacatggtctagaaaaccaaacataaggccggacgcagtggctcacgcctgtaatcccagcactttgggaggccaaggcaggcggatcaggaggtcaagagatcaagacaatcctggccaacatggtgacactctgtctctactaaaaccacagaaattagctgggtgtggtggtgcgtgcctgtagtcccagctactcaagaggctgaggcaggagaattgcttgaacacgggaggcagaggttgcagtgagccgagatcatgccactgcactccagcatggcgactggactctgtctcaaaaaaaaaaaaaaaaaaaaagaaaaccaaacataaaaccagaatattcctgtgagttccattacataggacaatatggtcctgctgatctattaaaattatgtttataaattagaggctcttcattgggagatatacttaatgctagatgacgagttagtgggtgcagcgcaccagcatggcacatgtatacatatgtaactaacctgcacattgtgcacatgtaccctaaaacttaaagtataataataataataataaaaaaagaataacaggaaaaataattagaggctctttactgtatttaaggtgttcaaataattgaagctagtttagtatctccttagccttccccagcatgccctgcagctttgacgctgcagaacaccagttggtggctgatatttagatgatggaaatcttggacacattttcatttttgataaaatgacatggcactatggttacattttacaaatatttttgcggatgtatatcaggtggcatacccaagaaggaacagaccttcctcaggggtccttcttaggaaagtacagctttgcttctctgatcatcagaattggatccttcaggtattaggttggtgcaaaagtaactgcggtttttgccattcaaagtaatggcacctgaaagggttggtaaaattcagaatattataaaatcagtaaaagcttaatcaaatttgcctaaatctatcctacagattagtctatgcatggtttattaaacaacctaactgaaacacacatgcatatgtgtgagtaagctgacatcagggatcaccttatcatggaaaatctagggaaggttggctcaatcttcaatttgtgaagaccaattcccctaccacgtccatatatacatattcccaggagacttgtttcttcagggctctctttggttctcagctcttcctttctgaattagtgggtcactttaacctcccttgggtcacagtcgtgttccacactgggtgggtccagaggtagaactcattgcctttctttgaatcccacacaagaccacccaacaaggcattgtagttggtggaaaactccattgaagaaagggtctatattgcaacaaacaagcatctagaaatagaatattaaatatccctcctcttaaaaatccattgtccaattcagacttcagcataatgtaatcttctgtcttcttttctctgtgtttccatcttgagagccatcctattatctgtgtcctttctttgttgtcttaggaagaatattttggcttatcctttgttttgttctctccttcccggacctattatggtaaatgtggaatttgcagataggcttatttgcgctccccagcctgctcccttaatgctctctggtaagacacttctttgagtcctccgaggcgagttgctgccccccagcacctgctcttccccatcgcaacccatgacagtaaacgcactgcacatacttatcccacagactgctgtgagaactagatggaggctatgtgtgaagctgcaagctcttggtaaagtgctacagaaattggtagacactgttactatgataagatgttcagaaaataatggatcgattaaagtttcacttatctattaaaagataaaaaactctatgattgagacctttttggaatattggaaaatatttttgtgtgcttattagcatactgatatgtttcagtacacatttcatggatttatggctaaggatgttactttcaagaaggtaactatacatcgctctctactagcatgctgttctgttcctgagaaatagtggctgggcgaagggtatgcaaacatttcttaatatctcatccaataccattttcccactactaattattcaacacatggaaatgtaggtcaaagcattaaaaaaaaaaactagaacagcaataccttggtggttggcaggtgtttatttaaaatatttacgttttagccttattttttaatacttctttttcatatatattagatatttaactaaagaaaataataatcattctcatggaatactttaaaatagtagaaacaatcatgaatagaaatgaagatttaggcctatactaccctaggctctgtcattcttattcctaaccatttgcataggaaatttagattcacccacttctctttcttagaataagattcacaggtttttgggcatattcccattgcatgcctgactggggaggtgttcaaatccctgcttttctactcctcagccctgtgaccctgagcaatttctgtggcttggtttcctcatctgtaaaataggatattaatagaacatatccctttaacgttgcagtgatcacattaattagttgatgcaaaacagtccatctagaacagtaagccctcaataaatgctagctatcattatcatttcatagccagccccaccatggatgggtcatgtgacctgaagcaaatttaaattctctggatttcagttatctctcattgaaggaattaggctccatcagtggttctcaaactcaagtgagtatcagaatcacagggagggtgtgttatgacactgaaggccgggccccaccctcagaatttcttattcagtagatccaggagggagtgcaataatttgtatttctaaaaagctcccaagtgaagttgatggctgatctggagacacaccttgaaattcttctgcttactctaaacaaaacgtgcttttttatcttgagtgcacatcagaaccctctggggaggttaaaagtcccagtgaaatcacaacctctgcagatggtaaccagatcttagtggcttttaaagttctccaggtgcttccattgagcagctaaggttgacaacacttctaacaccgctttcaggtgaaaaagaactatcattctaacttaaatgaaggagaaaatgaattcatcattctgacaccgttatctattctttcatgcatgggcttatcctatgagaaataaacatttactaaggtgtatgcatgtttttagaacatccattgggaagcatgttgtacagcttgtagtaaaacagcatggtgcatgctgaaactgttataggctttgcaagttattttttataaattagttttgctggtgtgctgtttgattattggagagtggtgtgaacatgtttctatgcatcccagggggttgctgtcacctttaaggggcctctttaaatcccagctctttcatttacaaattctatgaccttggatgagtttcttcacttttctgtgccacaagttctcagtaaaatggagataattatagaacttacttcatagagctttgagaatcatacaggtaaagttattttacgtaattagcactcaaaagtgaccattaataatctaacgttttaaaatatattaataggccagatgcagtggctcacacctgtaatttcagcactttgggaggctgaagtgggtggatcacttgaggtcaggggttcaaagccagcctggccaacatggcgaaactccgtccctactaaaactgtaaaaattagctgggcatagtggcgtgtgtctgtagtcccagctattcaggaggctgaggcaggaaaatcgcagtgagccgagatcacgccactgcactctagcctgggtgacagagtgggactccatctcaaaaacaaacaaacaaacaaaaattaatagtttaaatatttttaatatatttcaatatataaagatgtaatttttattttaaatatattaaaatagataagtttaaaatacataaagtaaatatataaaattaatatgttaaaatgtttactgaaagtttacatttttctctgtattgctaagagcaatttattgccttatatgttgtgtaatatctagaaaacacacctatgtaatttccaaattataaccaccttggctcctggacaagtaggactgtgtctgatttttttttttgcatccttgtcactacctgccactctgagatcacttgttgtctttccatatataatcacctctaggtacacttctttcattatttctacgcatcctctccactttgctgcattcttgtgtgcattcttttctcccacgttggaaagaaatatgcatattgagcgattccaacccccaaaggcaaaaattactagccagtgttgaaaatgaaagcaaggaattttttggttattgttgctgtaactttttgatgtgcgtacatatgtgcgtcttttttttccccctaggggtggaatggggtggtgttagtcagggattactgacaggacggtgttgcctactgtgttggagagactaagactggggaaagattctccaaggctgggaaatgcagacgtccagtcttggaaaacagtttgtcgttggtcgttatgtcagaagaggagtgtattcctggaagaaggcccacaaaatatacccagagcccaggtgcctttctaagacgaatcaacattcactcacaagttcagctaatatatgacagaaatacaagaatgaacaagactcctgacttaagcttacagctgatgggaaacttgggaactggacagagaattaaaatacaacgtggttaggtacaacttacctgcgccagaggagtgacggaaggccttggacggggagtgatgcctggaggatgacagggcgacaggtaagttagggggctgggaaggggaagggcggccctgtgggtaaagggaaggaggttaaagtcagcagggaaacaggcagttccctgttgctggagcaaagcgcgggggtgtggctctcctgtctctggctttgctgtcaacaggcgagattggcaagtagggcgaccaaccggcctggtttgctcgggaccggggtttcctggaaggtgggactttcaatgctaaaactgggacagtcctgggcaaacaaatcagtacggttggccaccctatctttgtgtgggcatctgctaactgagtcatgggcctgtctggtttatttatttattttttttctgcctgagtaacagaagaatgtgttaaacatatggagtatggaagaagaaggagaggggagataggatttttatgttatagattggaagaagacatccttgatgaaggagatgtttttactttggagaaggactgcctcagccgcgaaagaccaaggggtggcaccacagggagaagtctgcactgcgcttgtcaggacggccagtggggggctgctgagcgcagggagtcagtcctcgcaatgaagatatagtctcggggagataatgctggaaatcgatggaagaagtggaacaggacacaaatttagtggaatttctttacaatgtgtgcttcttgtcaccagttcgttaaccatgataaaaacggttatgttgttacattcatcaagatccaaattttctaccattttaagatgtctatcagtcacaatgatgatcactgaagaccgaacgagatcatttcctctaaaaattatgttacatttatccataatggcatcagtgtctgttacacgtttgctttaattttgaggtcaaatacgacatttgtaaatctagcacttcatgtgattctgtaagcactaaacagctaaacatatttacttcttttttttgaatcaattagaacagtgctgtacaatagaaaaatagaacagtgctgtacaatggaaacagtgctgtacaacagaaatctgtcagccacacgtgtcgtttaaacttttctagtaatcacattaaaattgtaaaaagaagccaataaaagtaattttaataatatattttgtttgacataatatagctaaatatcaattttgacatgttctaaatataacaattattaatgaaaaatattacattcttttggctttgtactaaacatttgaaatgtggtgtacgtttttcacttatagcacacgcaattcagatgctacatttttattaggaatatttaatctgtagatagatatcgtaaaatttacatttgaaaaaaatagattcagacacctaagttgttacaagcatacttaaaagttttcaatgactgaattgagtatcagttttaaaatttaaatcaatgaaattaattaaaatgaaatgaaaatttagaaactattcctcagtcacgctggctacatttcaagtgcttcatagccacatgaaagctgtattggacagcaaagaagtagaatatatttggaataaaaattttaaagtggacacattgtgttactctcgttagccatgctattgctattttttttcctatagctaattaaaaccttaagatccagtaggttctccacctttttttaaagcattagttccatgtcgaccctgtagatggcagcactttcttcctaaaactacatggaggagttgcctgggcttgtcactcagattctggcacttttcatagaaagagtctgaattatctggaaaattctttggtaacataggtcagaatcttttcagctctattgttattctgcacagatggctgttgcttatgaaaacaatctctcagcctctagtccaggatattactcattcctcagttcaagaaactctagggtgagaggagaaaggggttcaattacagaactgttatcaaaatgcgttggtttatgcacatccgtgttttggacatggtgattccaagagactcttaataaaacttttcaaagtagatgagagacagtttttccctcacatgctgtggcaatattaatctatgttttcatgttccactggactttgtaattgaattttaaggaatgcatacagggcttcatatttatatataaaatatccatatccagtgttgaaagaaattaacaataaaatatgtacctgtataaaatttgtgatttttgaagcacccctctcttcctcttcgcattgcatttgtggtaggagaacatgagacaaggaacgaggtactaaggacaaagaaggagcgattcagaggtggatttcctgaagaccaacaacatttttgcatagctcgtgaggactctctgatactaaactccaataaatgatggtttggtgttttgattgcttttgattgacatttaaaaattacaggagactgagataggaggattgcttgagcctgggaagcggaggttgcagtgagccaagattgcaccactgcactccaacctgggtgatcgagtgagaccccatttcaaaacaaacaaaaaaataaaaaataaaaaaaaacaaataaaaatcacacgcctctttttttcactcaatctgttttccaaataaaatatcaagattctatttgaattttaataatgattttgctgagttttatagcttgaatactatggcaagtataatgtctaaaatgctgtgattttgacttaagaaaaaatttacagttttcttaatatactctttagttcttttaaactctaatacatgaaatggattgctaatgagggtaggaagggggaaagactggggagaaaaatagctaacttttctagcgatagatacatgtcagaagctgtagtaggttcttttgcatgtgtttacttacattaccttctgtaatctgcattgcaattttttcatagacaaggaaacctagacttagagaagtacaatacctgtcatctcgtaaatgacagatatagttgagcaaatctactgaaatggtttagcttcttatctttccagacaacagataaggacttattctatatgaagacatctgagaaatgaaaatatggtttcaggttcatagaatcttttacaccacgtatttctggttctctttcttctattcagatcattctttcatctgtttcttttgtcttcttttccaaaatgtagcaattgccccaaattcagtacttgtctctcttcttaacaatcacatccaatcccatggcctcaaccatcttcccttgcatataatttccacatttacaactttattctcttgattactcaggataagataattgctgaacaaataacagcatatatctcagcttaagagagtaaaagtttatttttctctcatgcaaattctattgcagatattccccacctccttccctaggttgtcctcaaaatgcagtgactcagggaactcctctttctgtcttaacctattttaggtcttagacccctttggcagtctggtgaagccaataaatctcctctcaggacagtttctaaatgtgataaaagaaaaaaaagatatagtgacagatctaataattaaaattcaaagttaatttcaaattagtgataggtaaatatatttcaagatgtctgcactgaatacagcgtgataggtaatatatatgatttatcttggtgacaaagacattggtattgctaacactattatagctgccatctgtattcacaaagggagatgtcaaattccagttaaaagaaagattttcttaacccaagttcataggacttcctgaatggtacagatgctaaggtctagtggctccacaactaccaaagccttcttagtgttctctgctggatcttatgcatccaattgactgacaagcaaagaacctgcagaataataggagacatttgttgggtggggagagcaaacctagaaggggcatataccccttacaattatagctctatgcgctagaattagttatatcattcctcctagatatgaggggactaggcactgtacttcagctgtgtgtccaggaaaaaggtaaggtatggggaatgtggagcaataattatttgaagcaagaatcaccagtggatgctaaaattcgtgagggaaaacaggaccagaaacaggatatttttaaagtctccaagtacctccacataggatacttattaattgcaaagggaaaatagtaactttacagagaagaagaaatctggcagacactaccatatccaagtgatcaaaggtgacatcagtagtgggacacattaacatcatgtgcttctgatatgatacacaaaggagaaacaacctcattcttgtgatgttcctgccaaaaatccataacctgaaagaagcatcacaaaatccccaattgaggggcattccacaaaatagctggctagaactcttcaaaattgtcaaggtcatgaacagttccagaccaaaggaggctaaaagagacaggatgcctcaatgcaagtataatcctgaattgggtcttgggtcagaaaatgggcattagtaagacaattggcaaaatttgaataaggtcaatagatttgaaaataatactgtacctatgtgaatttcctgactttgatcaaagcactggggttaagttaaaacataagatgttgtttttggaaatacatgctgctatatgcaacttactctcaaacatctcagaaaaaaaaatagataagttcatagatagatagatgacaggataataaagcaagtgtgataaaatgttagcatttggggaatgtaggtaaaagtatatgggaatattttgtaccattttctcaacctttcctttaactcgtaaattacttaaaagaaaagcaataaccctggctcttataaaactaaggaaaatggtccatcctttcctgtgccttgtgttttcctgctggtcaaagaacctttggtaatgacaatctgagttggtcactgatattctagtaaattcagaatataacttcctgggctatgtagaaaaatatagctcttcatattttaattcattttcctgacagcacgtttctgtgcttttatgtatggatactgcctagtaatgtgcacaccagtcctgcagatcctggaacattttattatcttgatattgacttacgtatttaggtagatctgaatagcagaattgtcagtcgtttcaccaagacattatcgggaaatctggacttggaagtctacttctgccaggcatctctccacgctggcttctgggccacagaagaaaagatctaatcaaactcatttattaacaaaggcttataatattgaatagcagcttccaggaatctaagaaaatgttcacttttatttctgactaaggaggaactattatagtctttttataccagttagaagtgatgacttggtattaaacttattctaattctcaatagccctgatctcgactctgaccacatgcgcgcacaccctcccccaaccctgtaagtgtgattatggcaaggggaaagttaaagtggagtgaatggtgagtcgtggaatgacagagagcatttagcatttgtaattgacagagttggtgattgactgaatggacactgaatatctaggctaaaagtaattgaatgtggatggtgtagtgagatggagaacactagcaggaagatagactgggctacgcaggggctagatcatgtgttcagtctgggatatactaagtttgaggtttctgtaaaatgtccatgtgaagatgtccaattgggagttggatatttatttatgtttccattcccatcaatcgataagcttcagaggaaataagagtgtaagatttttttgaacaacaggaaaggaagattgtagtaagatatgatggcataatggtatatggaagagttttaaataaaagttagccaggcatggtggcacgcgtctgcagtcccggctactcgggaaactgaggcaggagaatcgcttgaatccgggaggtgaaggttgcagtgagccaagatcgcaccactgcattccggcctgggcgacagagtgagactccatctcaaaaaaaaaaaaaaagggatgaagagggatgaggagaactcaagttatattagcctgaatggaatagatgagtggagagatgggcatgataggtgagttaagaaggaaattctttgcctcagcaaccaactcagatgctttgtgaatctaaattatgtgttgacattctagtagacctagacctgggataattcacttcagcattatgtaatcttaatttttcatttataaataagaaaatattatgcaatacttgccatagttttctaaaagctgaactcagaatgttaatgaaattaaaatgggaaagctattttgcttagaagatattttgttataaacatttcttaaatgaagaggctctagaaatatttattttatagaatttaaaatatagccatcactaataaaggcaggcataattccaacgatttcataacacatcagttattaaatctaattaatatataaatgtaactaatatgtaatttaatataaccctaattcaatgtttaaccaactgaagctggttaaactatgaagaagaatcttcaaattgaccatttctttccaagcggtaaaggtgatacgggattttgtctatacatatagagcaaaggagaattaagccaagatttagaattttaggcaaaaagtgtttatagtatcattaagtggttacatatgtaattttactgttataaatatgactgagtcaatttttttttcaaagattttgtcacaatgggaggcacaaggagtttagacagatgaagactctttctagaaatctacctaatctatcacattagacctggagataattggtttgacaatttcagttgtttctcagcaaaaaaaataagaaactaaaagtgttcagatggcagagaaaaaagtttgaagaggagagaaagaagaacaaaaagaaaaaggaaacagtagacatataaagaaagcacctaaaccagtgagatgccccagctatgcaccagcagcatggtggattacagtagagtttttctacagaactattgtaaatcactggaaaatagtgtccaacttatttgcttaaaattttcagttaatgtgctccagcagcattctgtagacaacgactctcactctccccttattatggaggcagagctgtttctctttgtcccgttctctagcctgtgatatactttttattgctcaagagctatagaattgtatccatgcctattgttgtcctcctgatgggaattcatgtaattgaaagcgtttatcctctcttagtagaaaaattgggcacttggaggcaatgaaaatcccccacctttgtccacggcactggaaatactcttcagtctgctttgttctaaagtttctacttttcccagtataacctgttgaaaatttagtccttcatgagaaatacggctggaatttcttgtggcaggctggccgccggtgttcatgtagttacaccttttgttgctatttcaccactgatcaaaaaataaaattgtattttttcaaaagaaacatggaatgacatgaagaaagtccttaatatatcatggagtgaaaaacagcaagttgccatgcaaatgtcaaatagatcctatatttttaaataagcaactgcatatgtatcatttaaatatatatgtttagatatttgctaaattatgaaccgcagttacccctggggagtgaggttaggaaaagtaaagtgagattttcactttttacattatactttttactttacccacttctgtattgtttgaatctttaaaatgaacaagtgttattttgtaattaaaaaaaacaacaactgacaaataactatggggagtaagaaattacttggaatggaatatgtttaaataattaatttgttgatacactgcttgactattattttcttttgctaaatcaaaactcccctgcttttctcaggaggttgttttgaaaagaagggtaaatgtttctaatgaaatgaacagctcaaccttcccacctcctgcctaaatgcctcattttggttttgttactaacaaatgcaacacgcaaggctttatggtaaagcaagcaatgtgggtttctaacagggcagtacacacccgtagttgctgggaaaccactttagtaatggtggatttattgaattggaacaggaatggagatttggaacaacaggaagtgaggtacctgtaggggtctcagttgtcctgggcactgtgacatggcacccaaatgtcatgcaagagtggcccttccaacatatgcaccaatctgaatctctccaaagtttcttgattacaccataaaacaatgaagagaacagcattgccaataacttcagtaataacttttgcatcatattacaaagggtggtgggtggcactttgtgtggtcatgggtatgtccaaaagaagggagtggtggctagactcagttctcctttagattttaaggcaaaatttagcaaactctatggcagattcttcaactatttgtcagacagacattgtctacttttctggggatttatgattgaggccccttttgaggggagctttgagtgcagtgaggccagatagaagggccaagaaggatgggagcagctgcatgctagtgagcaattcaaagttggattgtgctgactggaaaatcccggttagcaaatcaactatcacagacttcatattcttttcagatgtgcagcctttataacatatttgtaaatgctaaaggactgctccacagggaggttacaaagagaaaagctctgggtggttgtaaaatggacaaattgtaaagccttactagtagtcttaccattcctctcagctcataaaaaagtcctcctcttcatttgactatgcctcaaatctactgcttcttggattattaaacactcttttcctccaggatcttaaaatctctctgttataagttgaattgtgtccccctcaaaaatgatatgttgaggtcttaaaccccagtatcctagaatgtggccttatttggaggtggggtctttacagggttaatggaattaaaacaaggccactagggttggccagtcctttttataaggaatccagtatgactggtgtccttattaaaagggaaaatttggacagagacacacacatagggagaaagacgtgatgatgaaggcagagtggggggtgatgcttctataagccaacgaaccccaaagattgccagcaaacccccagaagctacagagaagcatgcaacagattttctatcacagccctcaaacagaaccaaccctgccaatgctttgattttggacttttagcccctggaactgtgagacaatacatttttgatgtttaagccacccactttgcggtgctttgttccagcaaccttgggaaatgattacactttctcatctgtgatcacagtgaggccttgtcacaatcttcactcattccttctatagaaagctgaaagcctatggacaaggataattgccttggctgacgcatatgtttgaaggcagctgctggcaggcaaccggagactttaccctggtcctagtggagaggaagtctataggaggaggcagggagccttcctggctggcaacccagtgactcaggttgttttcttactccaaggatctctgtgcaagtaggaatcctgacatcttctctttttcacttgtttatgagaccctgcttgttgtagagtaaagagcagaacttaagaatggaatctaatcaccttgaaagaataatctctcatctcctctggtggcaaaggattgggatgtggaggttatagttggaaaattgattcctaggtcaatgtctgtgggtgaatttctctttgaattgttatcagcaatgttatggtgttcggtggctttcaacgaaataaacacacctgacatccttagtaaagagaaagctttctgaaataagagtgagggacagactgggacatgatgctttgcatgaaataggtgttcagtaagtatttgtagagttggaagaagttagattaaacagggctattgtatggcacattgtcattagggagttagagagggcttctggaaaggtttggtcagttttgacttaccttgcaataaatttggactataataaccatttcactagtttgtaaaaggtactggcaaccaaagatggggaatgccactcaatctcacttgttctactttcaaaagcttgctttggtcacattgaaaggttccatttggtgaagtatagcatatcacagaaaacaatggagtttgggagttcgggaacaaatggttgttttgtgataatgaataactttgacatttcgtttgaagttaagttatgttgtttgaacttttctgtccctgaacaaggcatcgtatgccaagaacaggtaacagtttctggatcactggggactcattagtcatggatggttagtggtactacattgtggtcttccttcaatattgaaagctgtaagaagcttgtgacaaattcttaccttggccctcacacagtactggtagggctgggatgttattgcttttgtccaccaacttccaactgtagaagtctaggatgatcacagcagttagagatgatccatttagatagtctatattaagggaaagtatccttcatccatggtgttgaacattcgtaggattaaaatgaaagaagccaaaacctttctagatctttattggtatatcaacagaattagctgattaggtatgcagaaaaaacttgggacttgaagacaccattaaataaataactgtacataaccatacattaaataactgtaacaccattatataaataactaactataaataaagagctctacattcaaactgcttttcactgcatttgtcagatttcacttttaatataattttagttgacttatccctcatcttaccttaagaagataatgagttgaggtggatcttgagccagtgtttagtccaatatagccctttgacttggggaaagatcaaacttcgaaatttatatgcatgactcctctctgggcaaggactgaagtggcaggagaggtgaaagaaggaatcaggacaaaaagtagatgctaaaaggaaaacagtctgtcccgtggagaggaagtacccaaagaaacagaagaactccatgatggagagtaatacaagttgaatatcccttatccaaaatgcttgcgaccagattgttttggctttgggattatttcagattttggaatattttcatacccgctcagtatccctaatctgaaaatccaaaatctgaaatgcttcagtgagcatttcctttcagtgtcatcttggccctcaaaaagttttggattttggagcattttgaattttggatttttggattagggatactcaacctgtactagcgtgttaaaacagtcctggccaggcgcggtggctgacacctgtaatcccagcactttgggaagccgaagcgggcggatcacaagatcagaagatcgagaccatcctggctaacacggtgaaaccctgtctctactaaaaatacaaaaaaattagctgtgccgtggcgggcgcctgtagtcccagctactcgggaggctgaggcaggagaatggcgtgaacccgggaggcggagcttgcagtgagccgagatcgcgccactgcactccagcctgggtgacaaatcgagactccgtctcaaaaaaaaaaaaaaaaatccaaaaaacccaaaacagtcctagaggctacagcctagagcagtgggcaaagagaagcagaatctacagaagatattgttcaaggcctgctatgctaggtctcagatagcaccagaactgggcagggcaagaaacgtcaggcccaggggtctggtttaaccagaagaggtgctgaattttaggatctgaatagcaagggttgtggtcaggaagtcagtttcatgtaagaatgaaggtgagcggatcttaaatccctgaaaggaggcagagagaagaatataggaaatgggtggataatttttgttgcgagtaaaaatgttcaggactttggaggcaggaagagcaggtaaagcaagttcgaggaaagaggctgggtcagaggggatctgaaagcaggagtcagaaacatccattggaggcctggagaacataaatgggaggtgaatagactggggacatagtgcctgggtggaaagaagctggctcgagtccgaaaccacaggctgaaatattaggaaaaagagacccaggaattcagttcagaataggagggatttgtggggcaagaccagtggttcttccagacattttatcagagataacaaagcagaggctgtctgttctctgcccttggtgtgagaagaaaaggactgacaggagtgcttggcagctcaagccagttatggagctgtgggtgctagtggctattaactaccagggaattagctctgctgaatgagtcctcacgcagaggcagggatagaacgttgcattcagaagactggccacggaggccggctggggtggctcacgcctgtaatcccagcactttgggagaccaaggcaggaggatcatctgaggtcaggagttcgagatcagcctggtcaacatggtgaaaccatgcctctactaaaaatacaaaaattagccaggcttggtggcgggtgcctgtaatcccaactactttagaggatgagagaggagaatcgcttgaacccgggaggcagaggttgcagagagccgagatcacgccactgcactccagcctgggcaacaaagagtgaaactccgtcttaaaaaaaaaaaaaaggaaaagaaaagaaaagaagagtggccacagattggcttggctggagaaggcatttttttatagggagatatacgtgagtttgacgggatgggctagcaggcggacattcaggttttatgggataggcaaaaaggtacaaatggtatttggggggatgtgaatggcatctgagaaaggttgatccaggcttgtgtggaagctggctctgagcataaaatgccagagaaaggcttgtacaactctgaggtcttttcttttcttttcttttctttttttttttgagacagagtcttgctcttgtcgcccagcctagagtgtagtagtgtgatctcggctcactgcaacctctgcctccctggttcaagcgattctcctgcctcaccctcctgattacctgggattacaggcacctgccaccaagcctggctaattttttgtatttttagtagagacacggttttaccatgttgcccagggtggtcttgaattcctgacctcaagtgatctgcccacctcagcctcccaaagtgctgagattacaggtgtgagccaccgcacctggcctattttctattttttaaccagtcccaagtaagggtattggttagggttgaggcaatggaaatctgaaagaaagggtgagttaggtatttcactggacacatgtggagaatgttggtgatttaatgcagagggaattgtggttaaaaaggttaatgtaagaagggtcatgtggggactggaaatcacaatagagaaacagaggccagaatgctgaactcataggaagtgggtgaccatgggtgattaaaatgtacaatagggctgggtatagtggctcatgcctgtaatcctagcactttgggggactgaggcagttggatcacctgaggtcaggagttcgagaccagcgtggccaacatggggaaatcccaaccctactaaaaatacaaaaattagccgggcacggtggtgcatgcctgtaaccccagctacgtgggaggctgaggcaggagaatcgcttgaacccaggaggcagagggtgcagtgagccgagactgcgccactgcacttcagcctggggaacaagagcgaaactctgtctcaaaaataaataaataaataaataaaaataaaaaattaaaatgtacaatagagtgtgtaaaaccaggaaatctacatcttgacacttaactacccaagacgcaattggttcctcgtctgatttttaaaagaagtttccactttcttcggaaaatcacgacagtccttgttctcaatttctttgtttttaagaagagaaatgttgtatgatttcacttatataaactacctagaataggcaaattcacagggatagaaaggtggaatggaggtgaccaaaggtggaaaggaaggaggattgttcaatgggtacaacatttctgtttgggatgatgaagaatttctggagatggacaatggtgatggctgcacaacactgggaatgtgcttaatgccattacttaaaaatggctaaaaatcatgcattttatgttatgtatatttacaacttttttttttttttttgagacagtgtcttgctctgtcatccaggctggatggcggtggcatgatctcggctcattgcaacctccacctcccaggttctagcaatgctcctgcctcagcctccccagtagctgggattacaggtgtgtgccaccatgcctggctaatttttgtattttgagtagagatggggttttgccatgttggccaggctggtctcgaactcctaacctcaagtgatctgcccacctcagcctcccaaagtgctgggattacaggtgtgagccaccatacctgccatatttacaacttttaaatcataggaaagaaaccactaatgctttgacaactgtgagattttgaatctcaactgtgagattatggtttgtggaaatttctttatgtgattaaaaaagatactttttttgccaaaaaatttgttttcgctgtcatgcaagttctcctgggtaagcacctttggtcttgttttgtgcatagcatacagagcagcaattgtatattgctaaagaaagcctgttttttttttcttgttaatttatttaagttccttgtagattctggatattaccctttgtcagatggatggattacaaaatttttctcccattctgtaggttgcctgttcactctgatgatagtttcttttgctgtgcagaagctctttagtttaattagatcccatttgtcaattttggcttttgttgccattgcttttgtgttttagtcatgaagtctttgcctatgcttatgtcctgaatggtattgcctaggttttcttctagggtttttatggttttaggtcttatgtttaaatctttaatctgtcttgagttaatttttgtataaggtataaggaaggggtccagtttcagttttctgcatatggctagccagttttcccaataccatttattaaacggggaatcctttccccataaggatatgaacagacacttttcaaaagaagacatttatgcagccaacaaacatatgaaaaaaacctcattatcactggtcattagagaaatgaaaatcaaaaccacaatgagatactatctcacactagtcagaatggttgttattaaaaagtaaaaatataacaggtactggtgaagttgcagagaaataggaacacatatactgttggtgggagtgtaaattatttcaaccattgtggaagacagtgtggcgattcctcaaggatctagaactagaaatgctatttgacccagcaatcccattactgggtatatacccaaaggattataaatcattctactataaagacacatgcacacgtatgtttattgcagcactattcacaatagcaaagacttggaaccaacccaaatgtccatcaatgtttgaccgaataaagaaaatgtggcgcgtgaacccgggaggcggagcttgcagtgagccgagatcccgccactgcactccaccctgggcgacagagcgagactccgtctcaaaaaaaaaaaaaaaaaaaaaggaaatgtggcacatatacaccatggaatactatgcagccataaaaaagaatgagtttatgtcctttgcagggacatggatgaagctggaaaccatcattctcagcaaactaacacagaaacagaaaaccaaacactgcatgttctcactcacaagtgggtgagttccataatgagtgggtgagttccacaagttccacaagtttcacaagtgggtgagttccacaagttctataatgagaacatatttgcacagggaggggaacatcacacaccagggcctgtcggggggttgggggtcaaggggaagaatagcattaggagaaatatctaatgtagatgacgagttgatgggtgcagcaaaccaccatgacacatgtatacctatgtaacgaacctgcacattctgcacatgtatcccagaacttaaggtataataaaaaagaaaaagaaaaagaaaaaaaaccctgccttttgctttggcagtcatcattccttccatcttctcatgttttcttatttaactcagtagttctcaattgacagcacaaaagaattactcaggagagttcaaaaaacacctatggctgactcccccaagattctgatttccttggtgtggggtagcctgggcatgaatattatttaaaaactcctctcatgattctaaggtggtagccaggattgaaaaatgctggactttcaagtttttgttttctttcttttcttccaaaaaggtgaagccctgacttgggaagaattcaaatgcgagttaggcttatgtttgatgtcactgattcctaaagatcagtccattgattctcctcattctcaggagagcatttggtgtcaaaatcacagcccaaaactcttaccctagttcagcatctaactctcttcagtcctgaaactgtttttgtcactctgtccatataatcacagtgttgtagaaatttccagctaaacattgtctcaaactttttgtacctagttttaaatcaaaatgtagtacaaaattattaaatacaacgggctttaaaatattgagattttggtgatcttttttgtagaatgcaaatactaatgaaactaattttttcttttgctttcaaactatacatttcttctaaaacttctttcaaagtagaatttcataagtggaagaacccttgaagattattttaatagaattccttaattttagagatgaggaaactgagactcaaatatattaattaatttatctaagtgtcttagtccattttgtgctgctataagagagcatacttgagactgggtaatttatattgaacagaaatttattggctcacgattctggaggttggaaagtctgatatcaaggtgctggcatctggcaagggccttctggatgtgtctacatggtggaaggcggaagggccaagaggtaaaatgtggctgaatttgtgcttctattatggcatgaatcccatccatgaaggtggaggcctcatggcctaatcatttctcacaggcaccaccttttaatactgttacaatggcaattacatttcaacatgagctttggaggagacaaaaattcaaaccatagcactgaagttatacaactagttaagaagagagaacctgagactgaaaccctgatgttttgactcccaatccagaatgtttgatcccctacatcccaccgcttcgctgtttccattcctttctcctgttttcatctattttcactaagagggcaagatatttgctaactgctacacacccaaattgtataccaggcaggtcagaatgactctaacattttatttaatgaggcagaataaaatatcttcctactaaacagtgacaagtgtttgttttaaaaaaaagtattgtgcacaaaaaaaaaaactactttcagcataggctatattttacaaaataaatttacagtgggaaccacagagctatttagagtgtctggtataaatgattttattgttactctgcttttttgaaaaagaagtgtgtgaagcagaggtaagtagtactgaggaaataataactaaaatactaaggacgagatgcacatgggaaaagttcttcattaactgtaacgtggtggagaaatgtatgttctagacaggtcaatcatggaattagaaaaagttgggatcttggattgttgagttcaaatccttagttttaaaactgaagacttcaaattttgattgactacagatcaatcaacaacctgttggagttggaaacttgaatctgattctccatccttgtttgggatatgaaaaaaaggaagacatttaagagtatttttttatttatgaaactaatgtatcatcatgtaaaaatatgaaatagaaagtgttaaaaattataaagaaacaagaatgtgtttttataatctcattttcttactttacgtaagatggtaagtctattttggaattaattgtttttaagaatagtattataattcaatgttagataaagatttatttaaccctttcccctttaacaagtgtttgggttttttaagtttgcttccaagttttcggtaaatgatgcttcaatggatatctctgtttgttatcttagtatgtatcttagattaattcctcaagataaatatttaaaggtatggtatatgtaatattcttgatacatacttccatatttccctccagaaatgtgtgcacctatttaaatgtgtgtggaggtgcacattttaacattcctcattattctggctgccttctataaatcaagctaccctggtattatggctctcctccagaaatctaatcatttaaacacatgaagtgaatgtgtgaatggacaattaagtgctggccaaatgtggaaaaatgttaagtgtaaatcaaaggcaactgaaacgttaaatacaccttccattcctccgccacatccatgctctttcccatactccacatctgctcactaaaattggaaataaactgtaatgaaccagaaatgtctgacttactggtgtgtttaggtgagttttattgaaacactgactgaccccaccactctaataccatcaccttaatgtttgtatcttagattaattcctcaagataaatatttaaacgtatggtatatgtaatattattgatacatacttccatagttccagcaaccacttgtcatcctgtgtcccccaaggacactgcaatgactgtcacagtgacttgtgctcggttgaggagcaagtggtggctgaaatccagccccagtcagctccccaaaccaaaccacttttacacagtgtctatgtgtaaagttggtttgctttggggagattgatccccataagggatcagcaccagccctgtgtctatctcttcttctcctggggagatgttggctattttgctagctggagaagggcacgcaatttgttgtcaggagacaggttcttaagttccattggtacatgcagggcaagacaggcagagggaatctgtcactgctacaggcacttcataagcccaggtatagacgataattgaaatggattgatttcatagtagtctaatacagagtggtgctacaatctctgtatgtgcctatttagaaaataacttcatatttaattcttcactttacataaaagatatgtgtattaaatacaccttttattttagaacagttttagattttagatttaaattgggaagacagtagagatttcctatctaacccacacccagctcccgtattagtaactaacatcttgcattagtatggtatattacaattaatgaaccaatactgttattttattattaacttaattcatgctttattccagttcccttagtttctacccaatgtccgttttctattccagtatcccatccagaataccacattacattctgttgccatgagtttctcagattttccatgtttttgatgaccttgacagttttgaggaatactggtcaagcgttttgtagaatgtacctcaactgagatttgtctcatgtttttctcatgattaacttggtattacaggtgttttgagaggaagaccacagaaatgaaatgccattcttattacatcatatcaagcatatattctaacaatatgatttatgacaactaatgttgaccttggccaactggctggggtagtatttgtctagtttctcctctgtaaagtccttccttaccccctttccacactgtactctttgaaggaagtcactctgcacagctcacaatgaaggagtggggagctatgcttcccctctttgagagttgtgtatgtacacaaattatttggaattcttctgcatgggagatttgtctattctcccctatttatttatttattgaattatttatatcagtatagcttcatggatatttattttagactttgggctaaaaaacaatactactttattttattgttcaaattgttccagcttctagaagttatatttttatagagaagatatgtttttaaatataaaaacactttaaaaaaatgaagtcaacaggataaaatatttttaaattttccttaatgggtgttctttgtaccatgtttccatcaaataacattctgattgaaatctaaaaattagtgtttgtattttaagtgctaagatcagagaaaaagtcacaagtttcccagactgagttaggcaacatgtgactcagagttataaggaatacctttcccattcctgcattgcaaccagtgttacagttacagaagtgactagtgtaacttcccctcctgggttccagctgccaggacttactttagttcttttaacatatccttcccaccaaagataagttttttgaacagtttccccatgagtgctccccccaccccaacttgtgccttttattcatgtctttataatatttattggttggctggtgcaattgcagaggttggcaagtctgaaatttgtagagcaggccagcaggctggaaactcaggcaggagttaatgctacattctagggacatttttttcttctctggaaacttcagtttttgctgacaagcttttcaactgattgggcaaggcccacccatgttatgagggggaactgtacaatcagttgtcatttaagccaatcagtcaactgatggttggtgtcaaccatatcttcagaataccttcactacaacatctagactcatgtttgattaaataactgggtgccataaccttggcaagttgacacctgaaattggccatcacagtgaccaagacagaaagtgtaatgagcaggaaagcaccccagtgacaggacagtgaaagatgagcctggagacggggagtgggaggagtgctttgacagaatggtcaagagagatggcatctgggtggagatatgaaaagatgtaaaagaagggaaggaaccagttctgccaagaatttatacttctacaatttcccagatgatattgatgctgttgccctggagcccatactttgagaaccacagagtaagggtatacctctgttattatccaatgaatcctgagaaagcccattaatatctcagtgtgaccattttttctcaaaattcctacctcacatgctctgaggggctggcagcttttctgggaaggtaaaatctcaagagggaggctttgaatgattccaggacaaagtgaagataacatactaccgcaggtaaagtctaggtttacttggaggtggctcaaaacacaaatcctgtcaattttaatgacacatgaggccatgactctgggtcgtcactctgggcaagccattgaacccattagaacctcagttttcccatctgtacaaaaagaggtgataatgggtaagcaatcctggactgcattgtggtagtgccatcaagcaatgagatttgtcaggaaggaagtgtgattcaagtacaggcactttgttatctgatgcctgtgtgttgagtgtgaaggaggggttaattattcctctattcatgtcctttctattctcaaaatttcttatgtgggaggaaaatcttggtgcggtaaagatcacagccaccctggggtcagacagaggactgtgtcaagcttggtaagcgtcaccattcaggtgagtgggaaagagactgaaccccattaaaccagatgacctccaaggccctgcccgccccaacatctgagggctgcctggcttgtctgcacagggtgctcacagtactcctgactttgacataattttaacattaaagtcacaaggatgccctggatcacaactgctggagaagagatggtagtgggatttgtttcccaggagactttctgattctagtggggccaggaccaacctccaaaataagaggtctttgcaactgctgcgagcctcctggcacctctaccctctagcgagaggctgcctctcctgccccaccccggtttcaagcacgctgcagggcaggaactcactgtgctggcaaaggtgagctggagacctggcacggcataaagcttttttaactgaccctttttaatttcatcttccctggacttaatctagagagtcattgatgaaacaaacatgccattttctcccgatttcacgcttttaaatgtcaacaacaaacaaacgtttatatacacaaatgttgctgaaggagacttttggctttagacaagggtaaaaactgaacctcttagtgtgactttggttgattttttaaaaaatctgtaatttgacatataaagaattattaagactttttttttttttctggtaggcattgaatgtgtccttgaaaagaaaaaaaatatgctcagtttcaatcttctgtctatgggtagctagttatcccagccttagttattgaataaggagtcttttcaccattgcttattttattttactttttgagatggggtcttgctctgtcacccaggctggagtgcagtggcacgattttggctcactgcaacctccgcctcccaggttcaagcgattcccctgcctcagtctcccaagtagtttggattacacatgtgcaccaccacacctggctaatttttgtattttgatagagacagggtttcaccaagttggccaggctggtcgtgaactcctgacctcagttgatccaccccacttggcctcccaaagtactgggattacaggcatgagccaccgtgcctggctgcattgcttatttttgtcagctttgtcaaagatcagatagttgtaggtgtgtggtcttatttctgggctctctattctgttccatcagtctatgtgtctgtttgtgtatcagtgccatgttgttttggttattgtagccctgtagtatggtttgaagttggataacatgatgcttccagctttgttctttttgcttagattgtcttggctatttgggatctttttttggttccatatgaattttaaaatagtttttttctagttctgtgaagtatgtcactggtagtttgataggaatagcattgaatctataagttgctttgagcagtatggcccttttattgatattgattcttcctattcatgagcatggaatgttttttccatttgtttgtgtcatctctgatttatttgagcagggttttgtagttcttcttgtagagaatttcacctcccgggttagctgtattcctaggtgttttatttcttttgtggcaattgtgaatgggattgtgttcctgatttggctctttgcttgactatttttggtgtataggaaggctaagtgatttctgtatgttgattttgtgtcctgagagtttgctgaagttgtttatcagctgaaggagcttttgggccaacactatggggttttctaaatatagggacatgtcatctgcaaatagggatagtttgactacctctctttctatttggatgtgctatatttctttctcttgcctgattgctctggccaggacttctaatactatgttgaataggagtggtgagagagggcatcattttcttgtaactggaccccttccttacaccatatataaaaactaactcaagatggattaaagacttaaatgaaaagcccaaaactctaagaaccctggaagactactgaggcaataccatcttagacataggaatgggcaaaaatttcatgatgaagatgacaaaagcaattgcaacaaaagcagaaattgagaaatgagatctaattatactaaagagcttctatataacaaataaaactatcaacagagtaaacagacaacctacagaatgggagaaaatttttgcaaactatgcgtctaaccaaggtctactatccagcatctataaggaacttaaatttacaagaaaaaaacaacctcattaaaaagcaggcaaagggcatgaacagacacttttcaacagaagacatacatgtggccaacaagcatatgaaaaaagctcagcatcactgatcattagagaaatgcaaatcaaaaccacaatgagataccatctcacaccaatcagagtggttgttattaaaaagtcaaaatataatagatgctggtgaagttgcagagaaatgggaacacttatataatgttggtgggagtgtaaattagttcaatcattgtgaaaaacagtatgatgattcctcaaagacctaaaaatacaactaccattcaacctagcaattccatgactgggtatatacccaaatggatataaattgttctatcataacgacacatacatgcatatgttcattgcagcactattcacaatagcaaagacatggaatcaatctaaatgcccattgatggtagactggataaagaaaatgtggtacatatacatgatagaatactatgcagccaccaaaaagaatgagatcatgtccttttcaggaacatggaaggagctggaggccattatccttagcaaactaatgcaggaacagaaaacctaatactgcatgttctcacttgtaagtgggagctacatgattagaattcatggacacatagagaggaataacagacactggggcctatcagagggtggagggtggaaggagggagaggatcaggaaaaataactaatgggtactaggcttaatacctgggtgatgaaataatctgtacaacaaacccccatgacacaagtttacctatgaaacaaacctgcacgtgtacccctgaacttaaaataaaagttaaaaaaaaaccccaaaaggtgaagtgttggtgaggatgtggagaaaagggaacccttattacacaattagtgggaatgtaaattagtgcagccattttggaaaatagccaaggaaaatttttttattgagtcagatgatgttaccttacagcaatagcttccaaaggggatgtcctgaatagtagaacttctctttacattttcaaacctctttttactttctgattttgagtttcataatgaacatgtatcaatacaatagcacactatgtattttataaatgaacaaatatgggaaaaataagatatgttcactttcctggctgaccctagttagtctaaactatcagttataggatccatttgttctaaatattgaaggcattgttgggggcagtggggagggtgaatgatagacgcaaattccttgaaggaatagaaatgtgactactatgctgaaaagcaggacccatggagtataaatagagtattcactgtgcttttacatttgtttccctggaggaaacgtaaaacaaatctcaagactttctggtcatttctaagtcataaacggccactagtcactaatttatataaccagcccaatgtaaatatcaaacgtgtgagtttcatttcatctcacaactcctcccctttcccagttctggccccatacaagcccgctgcctgcagtgtaatggaggaagatggtttctttttccttccctcccatttatttgtctttgtgcatcttaaagccagcctgaatttctactccctacaaggttgaagtgggtgggtcaggaggtggggagagagctaaggaacgttggcgtgagttgttgttgtgtttgagtctggaaggtgttgggagctgccccccctcactcagggcctcatttatgggctcttcggataacccccatgctctagcactgggatcttgccctgtggatccctccatgcaggtggcaccacaccctctggctggttgtgatgggccttctcagctttgagaattagcaacacacttcctattgaagtcatctgtccctgtgggtagcccacttgggctggatgcaaactgaacctgcactgattctctcttgcatgtggcccacatgagctccattttcctccgcaaactttgggtgcacagccccacgacgacacagacagcttttcttgcgtgccaccaaagtggtgggccagagttctcttatccttaagattttcaggtgtcaccacgtccaccaattcttggcagacatgaatcaatacttccaagggttttggtgaagcccttttccctgggctgcagatgagggcagccatgtcctgtctcttccacctgttgtggaaggggttcatggcaaacatcttcgaacatcctctaatttcccaattcttgatcctttcgtatgcttgatgtgtgagagagaagagagaagagagaaacgcttcttgctgctttttttttttttaatcccacatggtgaccttagactttactttggaatgtgccatttaatatctggggacctcagcccaacacagggactaaatagctctgttttaacattttgtttatatacacacattcatttgaccaaatgaacatgttccagcttttttaacccttgcccagcaaatcacttaattcagttaataaaaagactaaaataatgaggccaaccttattggccacgaacatctgttgggtattcctaaattgatccctgagttaatctccacctttaaggagtttataattttatttggcaaattgatgttataatgaaattcctgggcatgaaaaaaacctaactatgtaatgttggatagtgtgagttttcccaaaagtaccagtataagcaataaatgctataactgatcatgaattgtttacagtgattgagtagaatcattgcatctggtcatgaatagaaagagcacctcccagacggctggtctgctgccaggtgtgcagttttaggggtctccacactcattctattcacatcttttgactttatcagctgtgtggtggatctgtggttacaggctgatgtggtttggctgtgacctcgctcaaatctcatcttgaattgtagctcccataattcccacgtgtcatgggagggatccagtcggaggtaattgaatcacgggggcgggtctctcccgtgctgttctcgtggtaatgaataagtctcacgagatctgatggttttataaatgggagttctctttcacgagctctcttgcctgccgccatgtaagaagcgcctttgctcttcctttgtcttctgccatgattgtgaggccttcccagccatgtggaactgtgagtccattaaacctctttcctttataaattacccagtcttggatatgtctttattagcagtgtgaaaatggactaatacatgagccacattgttacagagtttctgaaggtcattaagagaagtccatgctgtgggctgagctgggactcaagaatctcaaaggagagccagtgcaatcaacacgaagggcccatcttgaactcctaaggcagggcagagctgggtcttatggagacatgtggctttcaggtaatccagtgagcacctgtgttttcctcctataattcttgaggaatggatattgttctatatttcagatagtataataataaatacctggaaaatactgtatgaccccaaacaacaggtaaaatgtcaaaaaaaaccttttatctacacaaagttagacaacaaattcaaataatcttatccgtttattcattctcttccaatacaatcatgtatcatttaatgatggggatgagtttggaggaaggtgttgttaggagattttgtcatggtgcaaacatcatcaagtatacttatgccaacctcagtggtatagcctactacacatctaggcttggatagtacagcctgttgctcctaggctataaacctgtacagcatgttactgtcctgaatactgcggcaactataaaataatggtaagtatttgtatatctaaacacacttcaacatagaaaaggcacagtgaaaatatggtataagagataaaaaatggtccacctgtacaaggcacttgccagaatggagcttgcaggactggaagttgctctgggagagtcagcgaatggctgatgagtgaatgtgaaggcctagggcattattgtatgctactgtaaactttataaacactgtgcacttaggatacactaaatttattaaaaatttttctttcttcaatcaataataagtgaacattagcttactgtatttttttttttactttataaactttaatttttttttagagatagggtcttgctctgttggccaggctggagtgcagtggcacaatcatagttcactacaacattgaactcctaggcttaagcaatcctcacacctcagcctcctgggtagctggtactgcagacgtacactactgcacccagctaatttttaaattttttgtagcgactgggttctgctatgttgaccaggctggtcttgaactcctgactcaagcaatcctcctgcctcagcctcccagcatgctgggattataggtgtgagctactgcacttggcctaaactctaatttttaaaatcttcttgactgttttataataacacttagtttgaaacacaaacacattgtacagctgtacaaaaatgttttctttctttacatccttattctataagcttttttctgtttaagtttttaaaaatgttttagtctgagtgcgggggctcacgcctgtaatcctagcactttgggaggccgaggcgggcagatcatgaggtcaggagatcgagaccatcctggctaacacggtgaaaccctgtctctactaaaaatacaaaaaaattagccgggcatggtggtgtgcacctgcagtcccagctactcgggcggctgaggcaggagaatggcatgaacccaggaggcggagcttgcagtgagctgagtttgcaccactgcactccagcctgggcgacagaacgagactctatctcaaaaaaaaaaaaaaaagttttaaacctttttaaaaaatcaaagtcacagacacatgcattagcctaggcctacccagggtcaggatcatcaatgtcactgtcttccccttccacatcttgtcccactggaaagtcctcagggacagtaacacccctggagctgtcatctcctctgataataatatgggcttctggaagacctccagaaggacctgcctcctgcctaatgctgttttacaggtaatatttttttctagtagaaggagtacactaaaataatgataaaaactgtagtaaagtaaatatataaattagtcatatagtcatttattatcataatcattatgtactgtacataattgtattgccagacttttatacaactggtggcacaataggtttgcttacaccagcatcaccacacacgtgagtaatgtgttgtgctgtgacattaggacagctacaatgtcaggaggcaataggaatttttcagctccattataaccttacaagaccactgtcatatctgcagtacaaaacatcattatgtggtgcatgactatatttactgagcaccaaatatgtgcccaggcagtgtgctaggggctggaagtgacctcgaagtctagtaaaaaaaccacaacagtaaaacaatatgtgtaattcaaagtgacatatcctgtaatagctggttgcctacctgctccccagagagaaattaaacctgcttgcttaacttattaattttaaattcatgtacttgcaatataaaaacatattttaaaacatattaggagaataggatgtcttctgtagtgataggctatttaatgttctcttcactgtgttctaaaaaaatcgtgatcgagtgtaacaaaatggggaagggagggttagcataaactctcctttgatgtctatgctgtggatcagaaaactcatgaatatgttaacaactggattttctcctaatatgaaaacaactctttggcttcttttgcaaatgtgaaaagttaaccataaatataagaccttttctttccactaaaactagggcacaatcattgttttcctcttattggagtccaaatgggtttccataatcttcagatctagtagttgtatttatcgatgacataaatggaaagactaaaagataaagttaagaaaaattcagtggtttatggcttcaactctactgataattttgtatataaagggatcctaaattagactgtacacacatttgccatttgagttccaagcattttagcaatagatcaaaagatcttaatgcctgatagttgaaagattacttccaaattttttttatttttgtgaaagccaaagtccttttctcaacatgacagtcacaattttgtcaacaatctacccgttatttacaaaggtttaaaatctgataatagatatttacttggactatacaatgtctcagtgggagcaatagatggtttacaatgggtctgaaaatgttgcaaatagtcaaaactggcattgcaacaattcatttccaaaaacacactagactcgtgagtttttggtttttaagtttatatagcttgcttctggtgttaacgttctccacacctaaggtgccaacatgcatggctactctttgtccccagagaaacattgctaatttgtaccaaatttcaatgatgtgtcaagcaaactgtcattttggaatgatagtaagcacgccttcaacaacagctctttatttcgtccaaaacctttgggccacacaattctgacctttatcacactctcagtacctttcattcattattagcttgtgcttctggggccccgggaattgtcaactatggtcaaaataatggagcaaaatagcaagaagaacttgcgtttcctatatcattgcatttaatctttgcaacaactctttgaggtggaaattgccccaattttatagattcagcttaaagaccttgatttgtccaagatcacacaaccactaggaggtataatgttcaaataaaaatgtctgaaaagagctgggtgtggtgggtcatgcctgtaatcccagcacgttgggaggctgaggtggggggatcacctgaggtcaggagtttgaaaccagcctgggcaacatggcgaaaccccgcctctactaaaaatacaaaaattagctgggtgtggtggtgcatacatgtaatcccagctacttgggagactgaggcacgagaattgaatgaaccctgtgaggcagaggttgcagtgagctgaaatcgcaccactgcactccagcccaggcggcagagtgagactccatctcaaaaaaaaaaaaaaaaaaaaatctggaaagatagattacttggcctcaatcatagtaaaaaagtgtcagttaaaactgcatggagagatactattttgaaaagcatcaaaaagttcgaagatccatcatatttgtaaggctatgggagtttaaattgtacaggcgttatgaaggcatttggttacatctaccaaaattaacaccgcacatatttactcatgtgcaaattgacttatgtacaaatttactaattgtagcattgttgataattgtaaaatattaggaacacacctaattgccattaatggggaactggtaaaataaactagaattcctctgtgcatggaatactatgcagtcatcaaaaatgacgaagatgtggccgggtgcggtggctcacgcctgtaatccagcactttgggaggccgaggtgggcggatcatgaggtcaggagatcaaaatcatcctggctaacacagtgaaaccccatctcttctaaaaataccaaaaaaaaaaaaccaaaacacaattagccgggcatggtggcgggtgcctgtagtcccagctactcgggaggctgaggcaggagaatggcgtgaacccaggaggcggagcttgcagtgagccgagattgggccactgcacgccagcctgggtgacagagtgagactccgtctcaaaaaaaaaaaaaagaaaacagaacaaaacaaaaaatgaggaagatgtttatttagtgaaatagaaagatatccaagatatgttgctaataaaaacaaaaaaaaacacatggcacaaataaggtgcatgttactatctgggtcttttaaaaaggggtgtggaagaatgtgtgtgtgtgttttcttcaatatgtgtagaatatctctggaaggaaatttaaaaactggcgacctcagctgtctccagagagggaaaattggtgggttgcaggcagaggtgaaagattttcccactatgactttgaaaatatcttttcaagtttaaagcaccaactgcattatatatcaagagtaaataaaatacaattttaaaatgaaatggcatttgtaaaacacttgatagatgttcagttaacagccatcaggatttattagtaattgtggtttttgccattaaaagtaattttaaaagtaatggttttgccattagttttaatgacaaaaaccacaattagttttgcaccaaccaaataccttacgcttctggtgagggctcagaagagagatcataagtaaagaacactagaaaggatgtttaatattatttccctttttaaaactggtggttgtcaaagcagtctgaaggaaaagtctccagaactggtgatcatgttcacatagcagtagtttggagtcaacagaaatcatcttcaccatcaacctagctccgaaagaggccgagccaatctagttcccttggccaaccaccttcctcccaacctatacgttggggtgatccactacaaagctctcaagagtatacacaatgctactacagtcattgtgagtgagatctgaagggagcataggctaggactcatgagattatagttcagagtttctactgtaattcctttcagcaaagtgaagagcatgtcactggggttacaagtgttactggctacttagctagtgctagattacccaaaaaagtaaccgggtctcatgggcagaggtgggaaagtctgttaagcacatagtgaaggatgaatctgggctgattggaaaacatttgtttgaatgaatgtagcatttatttccaagaataagcatgtccagactgattgagcaagagttatatttagttcagtcgttctgatgtccattttgagaaagctaaaccagcatgccagaaggggtcaaagatcacattttgcatgaaagaaaagccaatggaaatgggactgttagacttaaacttttgggtattttacactaggacttagaaaggactttattcctttttatattttctgtctctagcattgcaagtagcaacagagtgaatttttggtatttggaatactctctcctcatttttcctttgggaaaatcattagcctatttgatttgactgctgttgaatatgttccatgacatccataagtctaccttcaggcattgcttgtgcttgtttattacatatgattaattgcttacataagaacaatgatgatccctgcagggggaggagggatgtgaagaacaacttacttaggcattccaggggctaacaagggatggtttgatacagctcattcttgttttgaatcttcatgcctcttgagaaagaaaggagcagaatatgctttgcatggcgctatgtcctcccaggtcctatgttttcttttttgtattttatcagttctctacgtaaggattttctcagtttaatataatttccatttttaaaattcaaatacctacatatgaggtgggaaaggaaattaatcagatgcattcctataaactgcagacttaaattaagaccttgagcaaactggcattttgatgacttgaggattcagtgggtgggacagttgtacatcttgaactctgggtacactgccgaaagcgaggcctgagaaggctgtgttgaggaaggagtgtcagtgactgagcctgttggaaagggaggctgagagagatgaggacacatacgtaagggagaacacattggctggccaggtgtttttttttctgctgtggattttgattagaattctgggtctcattaagtgacccatgttgaatagagattggatagggctggcttggaaagccctcagtgaagagatgaactcgacagcatgataaggaagtagatgcaaattcaggacaggaaatggagaagggcagggtgagaaaagggaacaaatttacaatttgtgccattagccatttattagaatttggtataagaatttgtggaattattgtttccttctggatttatggtacaaaaacctactgacaagtgtcactaaaagtgatgtctttattcaattatcaaccaaaagttttacactaaattcttttgagtctttgaatgtttatgttatttccaataatctttccagttcttttaaaaggctgatttttaggaaggctagcactttttgatcacagaatagtttccccaatgagtatgatagcttcaatatctttcaaattagattcttttggaaattgaactgtgtcaaatcaaataaaacaagtagggttttttgctgttattgttgaaggtattatatttgcaagtttgtacaatttagcagatataggaaaggtctaatttttttctttagctagaatgttcagttcaaattatacagatataagcatgagacctaaatgaactctcttctgatgagtaatgaatggaaggtagattactcatttcttcatgttcaaaaaacaaattatgtctctgaacacagttgtttcaatgtttttaacttatgttctcaagctcttcccatttctttatcagtgatttgggaatgtgaaggcagtcttgttgtagtttccaaagatttaggcatttttgagactctaagaatagttcattaagccaccaattagtcccttaattttatttaagctgagcaagcaaggcccacactaaaagtcagaagaatgcggcatctacccagagaggctgagggtgggatagaaagaaggaggcactccaagtttggagacacagattctattccagttcctcaagctgcatgaccttcagcaagtctcctgtgttgttcaggaccccagtttctttataagtgcaatgaagagtttggactcaacaacttataaagaaacattcattctaattgtctattgtgtgaaaagaatgtgagttgttctagaaaatatgaatctgctccccaattgtcctccaagctctggttctaaatttcagttattatagttacttctttcgaggtaaatcattgaggaagtcagttaatgcagagatgatgtctggaaggagtttacaagttcattgttcaaatagtatttgttgggggccaactacaactacacatcagggattgtgctcacattggactagtgtctttggaaaacagagtccttgtgtgccctttttgaatttacaggccaacttggggaagcagagagacaaataggaaatccaacagcatgataagtagtataatgagaatgtttagggagatacgagcatttataggagtagcactcaacaggaaatcaaggaaggcttcctggtggctatgatgtctcaagggagacttgaagcatgagtaggagtatgtcagatgaaaagggatgggaggaagatttcaggtagggtaatttgcatacgtgaatatttagacccagagaaagtccagagggactgaggaacttaaaagaaatccagtatgggaggagcatagtacctgttggggagggtggggactcttgataaatgaggatagtaattcaagttctttggctcttgagttacttttggacaagttgagcttcaagtagctagtacataggaggagcttaataaatatttattgaatgaatgaacatgtaagtaaaaatgtctaataggtacctggcaaagtggacttcctagtcaggaaagagaggttggttggagatttctattttgaaattttcaatgtatatatgaaagtaaaaacacaaggagtggttgtgatcatccaggagaaggtatgcagaggagggaagagggtctaggggctgaatcctggggtacccacacctgagaggagggagaggaagaggggctctcagaagagcctgagcaggaagggccattgtaataggactaaacactaagcccctgaagtcagctctctgggggcagaggtttttgttctgtttattttgggatgcctgctgttgaccagattatgctcccctacccacccaaattcacatattgaagccctaacactcaatgtgactgtatctggagatagggtctttgggaggtaattatggttaaatgatgttttaaggctgggaccctactctgataggactgtggccttataaaaagagctctctctttttctgtcctcctccttctacctcctccaggacccaccccaaccccacactgagaaaataaatcgctgttgtttaaatcacccagtctatggtattttgttacagtagcctgagctgaccaaaacagttctccgcacttagaaatggtcctggtaaatacagctaatcaatatttttttgagtgaattgaatgaatgagtcattcactggcatgcttataaatgcattactccctccacagtgtgattgtcattgagcaggttgggagaagggaggagctctcgcaaacatggaagtcctgggtgcttagggagaatgggaaggtgccgtggtcacaaaatcggaagaaagagctgaaaggctgaaaggctgaaaatgctaaactgctcaaatctcctctgtctttttttaaaaaaaatcatttggctaggctggctctgaaattggggatggttcttggttgattatgtggtgtgtgtgtgtgtgtgtgtgtgtgtgtgtaaaggcccttcttaacattagataggactatctgaatctaagtgaatttaggcacaatctagatattgctcttcatagagaaataatactctaagctggcaatgaaattcctcaagtaaacaacagataaagggaaggagagggacacagtgtaacaataattggaataattggaattcttgtatcactcatggcacttacagtgaaagtactttctacattgtcttctattacatgcaacataggtacattatataaaaagatcctaaaatattgttaaaagaaattttcccagaaaatgtaagataaaagttactaaattctattaagcttgcaagttaaatccaaatcattcattgactcataatcaagaacagtcatgctgcctgacaaccaaaaaattcaaactgtcttcatcaagtcctgggtgggaagccaggaaatgggatctgagatcacaggctttgtgagagtcagggtctttggcgtgattcttggtcacaaatcatgcatttttttccttggagagatagtgggaaagaaaaggctgtttaaaaacatgttaaagaatactgattccatttgacttcttgttaatgtgtacccttgcagacttgggtaaaacttgatcatgttaaaagccattgtacttaaagattcatgactagagtgttaggacaattctgtggccttgggggtcccattgcagcaagaagagtctgactgagaagaggatagctccgtcctttgatgcctagtaacctgcatgcccagcactttgctggctgggccattggtaggaaatgcggtacatgcacttcaatctgtaagagatcatggtccatagagatcatagatttattttgccacctggcccagatggtgatagaagtcaggacaatggttgcctagaggggttgggagtttattagaatgggacacaaagggaaatttctggggtgatggaaatactctatactttcattgggatgattgttacatggacatatccatctgtcaaattcatcaaatggtatgctttagatacatgtatttcattgtatataaattttgcctcaagaaacaaaaactcaaggtcaggtgaaaaaagtccaggagctaatcaaaaacccttaaaataagtgaccaaactatttgtgaaaatgagcagaaacttaaagggaaattctttgttatttttccacattagaggaaaattgatggtatcagataaatgctcaaaaataagcttccaaacagagcatttataatcagtacaataataagtttgaacacagacaaaccttcatgtctcagagtgaaggaaccatttctagtagtataagctattacggagatagttccacatttattttctttcatgtttcttttggaggaataatgtttttgtaaatgtaaaatgcttttaatggagctagagaagaagctatgtttggtcatagtattatctgcttgcgaactaaaaattcagagctctcttgtgaatcatgctgccaagaattgcagacttaagcctcaagattgtacgaatttaaattttgactttatggcctcagttggcatgaagatacaaagataatcttctagcaaaaacagttttgaaagaccgggcgtgatggctcatgcctataatcccagcactttgggaggttgaggcgggtggatcacctgtggtcaggagttcaggaccagcctggccaacatggtgaaatcctgtctcaactaaacatacaaaaaaattagctgggtgtggtggcggacacctgtaatcccagctacttagggaggctgaggcaggagaatcgcttgaacccaggaggcagaggttgcagtgagccgagatcacaccagtgtactccagcctgggtgacaaaagtgaaactctgtctcaaaaaaaaaaaaaaatggtagaatgtcacatggaaagttaacttttagagatagtaatccagacacctataatattacattgtccttttaagtatctatatcaataaattaaccaacatttgttgacttaacatggccagggacagtgctgggttctcataattcccaagtaattctagccagaccttgtcctcaaggagcttatgagcagcatgaggagataaaaaacagataaataactctaattcaggaagaatttgataaatgcatgataactactactagaattcagaggagaggaaattttctttgaatagagactaaaggaaggaataatgaatgtggtagcatttgggctggacctattacaagaggcatgctttcccctgacaagccaagaaagtggggatttaaggtagaagaaaagaaaagccttgagttcttggagtattaaaattttgcttggctgaagcataggttacagtcggaggagatggactaggaaggatcgttatgggcagagaggaagccctgaactcatgggggaagctatgatttgggttaaagacagagctgggtcatgtcaagatggatcctgaagcagtaaaaaaaaatccaagaaagtaaacaggttgcagggtttaggatgaagtccgggaggaaagggcagagtggtccttaggaggccgttaggacaggtaaggtaatgggtctcaaagggagtggccgaaatgcaatggaaaaagagagattgtaaagctagaaggcttaggaattgcctcttgattaggtgtggaaggcaagggaaaatcagccctcgaagaagacagtgagattttaatctgggtggctggagagacagtgatgctgggcacagacacggggaagttgagaggaacaccatgtttgagaatggtgactcatatttgaacaagcctgcaatgcccagcagaccgctggaaaagtggggctggagacacattcaacggaggagccagatcaatctttacccttcttcacctgagagagccagtaagtcacggctggaacgtgtgtgtccagcaggagagggtagggagggaagccaagagagctgggagcccgagtgaagtttttgccaaaggcagaagaggaaagtcggcgtagcacagtatactttcccacccatgctcaccaagcccagggacaaggctcaccaagatgagtttggaagagaatgctggagagaaagtggttaagaaaactgcctttactgaacttcttgggctaactttgattgtaagtctctgaacaatcaaagcctgtgaggagacagctaaccttcttattcttcctatgtcaatagtgaacaattgcagatcccctttcctttccttctcctttcccctgttcctctctcctccctccctgaatactcttgcttttttctgggactggtctagagcatgggtggccattgttgacctacaggaggcaccactgtcaccaacaaagggtaacagtctttcttttcaatatttatttatatccagtatttattttcaatactgactatggagagagctctcctgtgctcaaacactgcaatactgggggtctttcaaagcacaaaaacatatatttgcatgatggcatcattaacatttttatggctttctatttcttttttgtactggtctcaagagccactcataaatctctcagtaactgcatagtgtcccagggccagagaccggccactcctggcattgtgattagagtcatttaatatccaaggtggtgactaatgtctggcaacaaagcctccattgggtgtcatgtgtcctgggaccctgagcgtgggcactctaggagcacctcagtattgcgtgttagtactatggccgagagaatagttgagaaagtggtcaagaggtggatccatgtgaacgccactgggaaatgagagacctcgttcccaatcacggtcagtgcaactcgaaagcctaaaatcagtttaaaacaaaggtatctacctttatcttatgttcatatcctaggcttttaataatacgtatttttcacatgtttacagaaagcagtcaactgagctattcatggaaaggtttgtgggtttggttaacgaagtggaggagtattacatttcagctggaaacacatccctagaatgccaaaacatttattccaaagtctggtttcctggtgcaatcggaggcatggcaatgcctctgttcagagactgggggctagggccagtaaggcatttgatccacatgtatcccagaaggcttttattgttaaattatattctttcggaaaaaccacccatgtcctattttgtaaacttgatatccatacacttttgactggcattctattttagccgtaagactatgattcacagcaagcctgtttttcctcttgcttggggtggcagcagaaagcatagggtactttccagcctccaagggtaggggcaaaggggctggggtttctcctccccagtacagctttctctggctgtgccacactgctccctgtgagcagacagcaagtctcccctcactccccactgccattcatccagcgctgtgcagtagcccagctgcgtgtctgccgggaggggctgccaagtgccctgcctactggctgcttcccgaatccctgccattccacgcacaaacacatccacacactctctctgcctagttcacacactgagccactcgcacatgcgagcacattccttccttccttctcactctctcggcccttgacttctacaagcccatggaacatttctggaaagacgttcttgatccagcagggtaggcttgttttgatttctctctctgtagctttagcattttgagaaagcaacttacctttctggctagtgtctgtatcctagcagggagatgaggattgctgttctccatgggggtatgtgtgtgtctcctttttctttcaggacttgtaggattctttgtgccatttgcatataatttggcaggttcacattttttaagagccctatgaagtgctttttgcatgtgttttaaaaaggcatttgaaaattgaaagtgtgatttatggaaattaaatcatctgtaaaaaattgctttggaaagtaatgattgctggccataaagggaaatatctgcgatgcacctaatgtgtttttaaccctttatttgctgacaatctatagtcattaatgctaaactcgattttggcttcagctacatttgcatattgtccaacaatggtctatttttgtaagaattagataaaatgtatacttgatataaaatagtcaaaaatgtaactcttagtaacagtaagcttggcatttagatagaccatgaacacttcgtcagatactctgttgggtgtttgggatagcaattaaaacaaagtattgatagttgtatcagagtctattaggctgcagcaaaggaagtttattcaaaagtataaactatccaagattatagacgcatgatatacttcacctattttttgtctccttaatatgtatatatatatatatatatatatatatacacatatatgtgtgtgtgtatgtgcgtgtgcatgtttaacttttaattcagttaaaaacttttttctatttgtttttcatctggatatttgattctgcatatcctagcccaagtgaaccgagaagatcgagttgtaggactaaaggatagacatgcagaaatgcattttaaaaatctgttagctggaccagaccgacaatgtaacataattgccaaagctttggttcgtgacctgaggttatgtttggtatgaaaaggtcacattttatattcagttttctgaagttttggttgcataaccaacctgtggaaggcatgaacacccatgtgcgccctaaccaaaggtttttctgaatcatccttcacatgagaattcctaatgggaccaagtacagtactgtggtccaacataaacacacaagtcaggctgagagaatctcagaaggttgtggaagggtctatctactttgggagcattttgcagaggaagaaactgaggtcctggcaggttgcattctcctgatggcaaaatgcagctcttcctatatgtataccctgaatctccgcccccttcccctcagatgccccctgtcagttcccccagctgctaaatatagctgtctgtggctggctgcgtatgcaaccgcacaccccattctatctgccctatctcggttacagtgtagtcctccccagggtcatcctatgtacacactacgtatttctagccaacgaggagggggaatcaaacagaaagagagacaaacagagatatatcggagtctggcacggggcacataaggcagcacattagagaaagccggcccctggatccgtctttcgcgtttattttaagcccagtcttccctgggccacctttagcagatcctcgtgcgcccccgccccctggccgtgaaactcagcctctatccagcagcgacgacaagtaaagtaaagttcagggaagctgctctttgggatcgctccaaatcgagttgtgcctggagtgatgtttaagccaatgtcagggcaaggcaacagtccctggccgtcctccagcacctttgtaatgcatatgagctcgggagaccagtacttaaagttggaggcccgggagcccaggagctggcggagggcgttcgtcctgggactgcacttgctcccgtcgggtcgcccggcttcaccggacccgcaggctcccggggcagggccggggccagagctcgcgtgtcggcgggacatgcgctgcgtcgcctctaacctcgggctgtgctctttttccaggtggcccgccggtttctgagccttctgccctgcggggacacggtctgcaccctgcccgcggccacggaccatgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacaggtacccgcgcccgcgccgcccgtcggggtggccgccgcgcccggcaggagggagggagggagggagggagaagggagagcctagggagctgcgggagccgcgggacgcgcgacccgagggtgcgcgcagggagcccggggcgcgcggcccagcccgggggttctgcgtgcagcccgcgctgcgttcagagtcaagttctctcgccgggcagctgaaaaaaacgtactctccacccacttaccgtccgtgcgagaggcagacccgaaagcccgggcttcctaacaaaacacacgttggaaaaccagacaaagcagcagttatttgtgggggaaaacacctccaggcaaataaacacggggcgctttgagtcacttgggaaggtctcgctcttggcatttaaagttgggggtgtttggagttagcagagctcagcagagttttatttatccttttaatgtttttgtttaatgtgctccccaaatttcctttcatctagactatttgattggaaatatgtcagctatgatgatgactttctgggaagcgattcctgtcacccgctttcccctcctccccaccccacgtcctggggctttagagagcgattgggagttgaatgggtctgatttcggagttagctggctgagtccgcgctggagcggattgctggcatgtgacttctgacagccggaaatttgtaggtgtcccgcgagtttaaaacaagccatatggaagcacaagtgcttaaaaataatctcctgccagcccagtgacaagcctgtcccacccggggagaatgccccggagtggcgtgcgggtcagccagggtctgcgcctcgcagccactgtggaaggagcgcggccggtccaggacacaggagaccactttgtgacttcaatggcgaaggttgtgtgtcctcattttaatttttttccctacaagaattgttctttctccctctcctctccctcccattttctcttgcccagtttctccttttgttttttgttttttgttttcctgatgggcctgcagagggattaggtgggcgcttctggtgaacaccttcctaggtggccacaggacaggtgtaccccggactgggtttggaagcttcagggcgccacatggctgggtcctgaattaggcatttcccaactgtacactggtatccggactggtgtccctatatctttctgccttgtaagccgtggaccagtttttgttcagtattctgtttccagggatatttatagcagaaggaaggggactaaagtgcagtttggccccagaggatactgaagggcagattctgggggtattcagtgtgcatcttcagccgccttggagaaatttagagcatcccacagccacgcagatccaagctgtctttactcaaaagacaaacaatgaacaaaacttttaaaggttggcatatttcaaattaattttacttgttttaatttagggttaaaacagagaaaaaggatttcttctgcccacctttttttttttaaatggaagaacaaagtacagcgattaagtctaattccacacaacatttaaaactgcttgatgtgaaggaaggcactggtatgatgtgaattccataaccttatgatggactccagaaaccattttcttccctatttaattttcagttcttttattgcaaattaatgctgctgaatttcaatgggcactaatgagactgctccttggtagattatttactgccttgctaataattacaaagtgaacctggtcaaatacagaggggatcgcatcttattcaaaattgttcatcatcccagtgataagtggtatcagtgtaatatgccctatcttacactttctgcattacatgatattcaaacactcttagaataataaaaaaagagacaaggaacttaaaaattaaaaaaaaaacttgcacaaatgggactctgtgtggaaattcagttttagaatgatttttcctgtgttttatttcccggattatctttcctcttttgttagaattctgcctgttattatccagcaaggaaaagaagcatctatgcaagttcttcatatggacagatattatttagtatttttcccctctcagtttttctgcttaaatgactctgggtataaaggaaaggattgattgggctcttttaggaaactttaagtttcttaagtagttctcaaaagttttggggctgaaagcagtgttttcaaactgcttgtcatgacccagagggtcatgaactcagtttagtgagtctagaatattttttaaaaggactaaaatggaaaggaatataatagaaaatatcagagtgcatggtatttcgtaaggataagttttgtttcctgaaaatctgttttaattatatgtgcttctgtgtgctgattgtgatgtaaaatgtatttcttactgtggattgaattcaaagaaaaaattagaaagctaatggcctaaaatattatatgttcagtagaaaacaaaaaattcaggcaagtggctggttgtttttacctatacaaatcaaaaggctattttgattgtcttcattttccccttataaattaggttggtgtctttagtcatttaggctaagttttactatctgattcttaacttttctattgtagaatggtgctgtcatgtggactgtcctcccgagtgtcccactggatgttcagagaatttatgtgaaggtcacgtcatttagcattgagatgctgtggttaccttcttccatttcttccataatatgcagccacatctatgtgtgaagaaatgtaatagataaaatttctctggacgcataataatgtgagaaagattgtcacatgtcccagcaaattgttattaatataaatttgttacttggcaagctgagattttgcaagatgttactcaaaatttcacaatgaaggaaacagggagtcatcttatcctgggttccttttttagatttcaaacaacttaggaactttgaataaaactaaagatgaagcttaactatatcaactatcctttttaaagttctaattaggaatttaatgctgcatgcttatttcagttttattactcagtattcttaaaagttagacgtctctcacttctccaaaaaacttggcaaatgtataaatcttttgcatcaaaatcaatgccctgctaatttgtatcctggccatctgcatattttggacaactaatttttccactggtgatcatttgaaactctttctcaactttgaatagagactgatttccaaagtgagatttaagtgactaagtttcaagtttccgatacatttttccttttacttagataacatttcagcccccttcctttctgatcttacttttttattaatttaaattgttactgattacgtgacactttgtgctggtctaagaatagtccagagtcacatattccctggtgaatgagcatattttcggatgaaaacggaatcacatcttcaatccccatttcattttcacctcctccatgtggcttgtacctgtttggaagaaagctcctgaaggataattgccacttattctaatctttctcacactcatttaatttggatccctggctaaagttgttatttacttttgtgattatacttagtctatgacattcataatttgggaaaattctcaggtttgagaattttggcggcttgggatttcttttagtttcttatagttttaaggatatgtaagacaggtgtaagaaactgccaaggggaggaaccatagatatcaggaaaaactagaaaagatgccagacttaccattaatgaatgatgagacaatagtaactttgttaagtgagattgtatatgtgaaagtggtatagaaactaaacaaacattaggtgtttttattattttactcacatgttaatatttgttttggtgctttcataggctaaaaagctgggaaataacagatttaagtggtcaggaattttgttataaatatagaatgatgattatatgaaatcttttcctgtgaaagtcaaatttaagtaaaatctttatcaccatctgcaacatttgtctgcagcctggcttaccaggttatcataaagaacatttattttacagatacattaaagaaagtcaaaaccctgattatgtgtaaacaattttacataaggaaatatatgaattttaattatatttttctaaaatccgtactcagcatgaaattaatacatcttaacccctccctgtgacttcattattatttttaatgtaactttagaagaacccagtagagagagcagcgtgctaagtgtgtttctttcttttccagacaactttgaatggagaggagcaaattagtcttttggtttaattctgtctcagtttgcttatctaaagaaaggaaaacagagtggctacacttgtttagaaccatatgcatactccagagaaagatgctctattaatccaaaaaatacagccacttgaaaccagccaaagcgaaagtgtaagggacttcatggaaaggaggcagttcaccaaagttattgaggggttttatattttaaactccgccagtgaattgacgtgtaatgtcacttacaaaaaaaaaaaaagtatgtctgagctgttcgctacttcgtctctaaaatatactcatactgatctctgaaatcccagaatttaagtgggctggaggttacgggaagcacctttataatatccttaatctcatgagggaagaaaccataattgctgaattctctgccttggataatatcaggagggactctgaagaaagttttgcagtaatcaacaatgttttaaattatgtgtatatttttagatcacctcaaaaaatataggaagcacagaatgacaactattctggtctcaactgacacaattttatgtagtttaataaagtaataatttcaagaaacgtgggcaaataagaaagagtatgactttcttacaacccgcttgtaagtgatgtggtggtggtaatgatccatgattttgatgatgacgatgatgatgaaaatgaagtttttgtctcagtttgggtaggtggtatttctggatgcctcctatggaccctggagatgttcatcctatacagaaatccaatcctttaaatctacttggctcattgttttagaattctaattccatagtctgaaaattttaataatgatattaccaataatattagaaacttattaagtacctataattgctatacaaaaaatttaaaagaacccaaaattccaagcaagactgaaaattttttgtctctcctctgaactatttagagggacaaattagtttgttcttataatatctactttaaataaatgtgccatctttaataagatagtagacttctttgtttggtaatgttctattttttggagatcctatgagttacacttgggaaaattataaaagttcacttaaagttaataaaatccattaagtaatgttcagaactagacatttccaaatgagcccttgaaaagctcaggtgggttctttttgagagttccccaaatgttgtcaaccccaggaggaatggaagacctctgcagttttgttattcagattctcatctccttctcagaagccgtagaactggccgggccctaaggtccacgctccttggttccagttctgtcttccatccttcggtcccgggctcattctgcctgttcctaaacggtggcaagttaggggccccagcagccaacttgtgcttacctggcactacttcctgggcagttttcttggctccttgacttgttgggcggcttgggatttcttttatggccctgaaagcaaaagacaatgttctcttttagtttcctgcaattaaatgatgttagaaatagtcatcttcacattggcgtacttcctctttcttctgtaggtcttttagaattttgagtccattctcatattttcttgtttcatttgctttattttctaatacatagaagtttaaactccctttaaagagtttttggcctcttttaccctattaagctttcttttttcttttctgttttagttgttccatctgtgtattctcagatatttttctttcaccttttctggtttatttctttattgacctgtctcatctgttattttaatgaaatttggaacagggctaaacagagttcctacctcagccagtataagaatataccgtaataactcagagtggtattaactagattaaaagtttcaaaaagtgatgtttttcttgtctctgaggatagaaacttcaacaaaataaagaagaaattttcaattagtagaatttctttgaaagtttgttcattcattcatttggctaccttattccaaattgagtcattcattgagggcttagactatataaagtgtggttttgttttcccagcagttcatgcaacagcattgcacctagcagctgggaagtcttatagcatgaataggtgagattctaataccagaatctcctgcatgtgtaaactaacagtgtagtcttgactgttgtctcccagtaaacttggtttcaggagttttagatccatgtgaacgtgtacaaggcatttttgctaactgtaacttcccacttaatcaacaaaaacaaaaacactcatttctgaacattcagtgcattcatgattaatcttaattacaccacaaaggtatttttcaatggtgattttgcgggagtggggtaacagtttcgaaagcaacattgtcagaaacatagttgattttaaaggttctttctggtgactttgacttctgcttttttagaagaccttacacagagttgtatttatttctcctggaatatttcaagcaattcagagtgaaagggtatacattccaatttgcgtatgagataaaatttagttacattgagaagctattttctttagttacagggaaaaaattgtagggcttttggaagcctctttgatttctaataggaggaatccctgagcactggtccaaacagaaatcatctcttcttcattgctgtatttccctcaagctcttagcaaagtgcatggcacgtgaaagcccggagaagctgttggttgaaagaatggatggtggtgggcaggaagcatcagggacatggtttgcttcagtctattggctgggagaaaggccatttaggaagggatccttagatgccactggaagaatgtgggaagtttgtgaatctctctttctcaggaacaaaagtagaaaaaggactccacacagcattccaagtacagtcggccctcattattcatggattctgtatttgcaaattcgctgacttactgacgtttatttgtaaccttcgagtcaacactcacggtgctttctcagtcctttgcagacgtgtggaatggcaaaaaaatttgagttatatgacgtatatgttcccagctgaggctgagcaaggctcacttctccttgcagccctcagactataaacaagtgtccctcttgctatctacttcgtgttatgatttttgcattttcataatccctgttgatgattttgctgtttaaaatggcccctaagcatggtcctgaagtactgtctagggattctaagacaaggctctgacgtgtcttaagagaaaatacgtgtttgataagctttattcaggcatgagttacaatgctgttggccatgagttcaatgatggtgaatcaacaggatatattaaatacagtgtttttgaacagaaaaacatataaaacaaggttatgtattaatgagttggcaaaaatgctgtgaccaaaggctcccaggaacctaccctattttcccctcaatgcaatggttcagtatttgctaattcagtgtttgaggtgactttatagaacatgagtaccatgaataatgagaatcgattctgtataatagagtgatgaaagcacaggtctgggagccagcagctatatttctattctggcgtgactcctgtgtagttgtcatcactggcaaattgcttaactgtgtgcctcagtttcctaatctgtaaaagctacatcgtttggatgatgtgaggattaaacaaattcatagatgtctagggcttataacattcctggcacataacaagtcattattttttattactacttcggaagggaattgagtactataccctgaagaaggtgagtatgggaattctctacgggtctggaatgtccctatatttgtttattttgccttcaagtgactaactttaataccctattgtgattagaagttaaacttctgcaaccaaaaggaagcaggaagctagtatttcttgaagtgcttattacatgccaggtactgtgctacaaaaacaaaacaaaacaactgtaaaaaaaacttcaaatttggctgcgtgcagctgctcatgcctgtcatcccagcactttgaggaactgaagggaggattgcttgagtccaggagttccagaccagcctgggcaacacagtgagaccctgtctctacaaaaaaacaaaaacaaaaacaaaggcactccaaatcagtaaaaattaatcaatcaataaaaagagtgaggggcattaagtattgtggactgaagcaatcccagagagggaattaattgaagctgaggtaagcagcttatggagaagctatgatgtacagagggcaaggaaggaatttttctgtaatttggaaaaatgggaactgtgagaaagaaggagttggaagctcatacttagggagcatctacaaggacgtctttttcacgttggttggaatatccaaatcaaggattatttcagaatcacccagatgattaaaaaactactgagatccaggttgtatttcagcagttctgacaattgctctgggtcgaagcttgaatcagtagttaagaaaaacaacaaacaaaacaaattttggggcttttctcactgatttacagttaaagctcatttactcttcctatgactttagatggaggatatttccaagtcttcaggatggagacatggagggaagtgagactagtgatgtgcctcaaggttttgctgttgttctaaccatgaggagcactattcaaacccaggtctgctagatttccaagtcttcatttccttgggcctcttggatttcagaagcagagggtaaaaggagtgctggggagaaagatcacagtagctttcaattctactcctcagctttccaaaataagtttcaagactggccgttgcatttgatatggaataaatacaaagaaggtagattgaagggtatgaagatgcagatttttgataccagatatgaagataacattaggaagcaatctaaaacatggacacaaacacacacctgtgccagttagcctgtataattcgatttttgttaagtgtttagataactgaaggtaatttaagccctcatatcttcccttcatagggttctttttccctctggttcatcagagagttgccaccaattcaggctgttagtggtacacataacctctagcattgttgatacagctataaaatcccaaatatcagtacaattgttgattgcataaaatttccagttgcatggttggaaagtcctgtaagtttgaatccttaaaccagtcttaaatgtggaggaggactcaattaaagctctcctcgtgtcctccctctgacgtatttgcaaaatcctttccacaaatagaatactgtttttaatgcttccccagtccaattttgcgttgtagaagacgaatttatggatgagggaagtggcattcaggcactccagcttggtatagaagcccatggtgtctggtcctcagtcctcaagcccgctcatttcctcatgtgaactcagaataagcagctgaaagcaagtcttcaaaatctcagagatatgtataaatgcaagtgtttgggtgagaagtgaacatgggtctcctctagtgcccacactacttgactaacaggttttgggctccacacaatgagggattatcaacccctgtcccagggctctctgggtcttggttctttgtttttgatgctcagcaattgtgatcagtgaaaccaatgttgcttttctatcaagagtccaacccttttctaagaagggttgtgtttgatattagggaatagctagcaaagttatcaagtaacttgtagaaacattcttttgcaagagttcttatactgaatgactgtagttgacagcagtgcagtactggtcattttctaggacatcttaaaaacactgatgagaagtttcctctcagatgtctgtcatgtcattcttgcctttctctacacagggtcagttttctcttattgctgttaggagttcctcattggtttttcagcttttgggctttcaaactctaattaatcataagctactagagtgtactacctaaagtgtgtatatacacatatatacacacacacacacacatatatatacctggtatacatatatatatataatatacatatatcatatatactccccaacctgatctggttcttcctctgcataaaagacctcaggccagtcagagaaaacatgtatgttccatggtgtggcaatcaagcccttgtatttggttccaatcagtctcctaactattactccaagaagctcttgttgaaagagccatgtttaaatggcatgttcctactttcttcttcatagtgatcttcatctgtaccatgtacccttctttcttcttgttccatctctgttaggctgattctacccagaagtcaaggttcagctcaaatgctatccctatcaggtgaattttccacctggcatttgttcggtgtgcattgtgtgcatacagcaccttttcccggtacctttactgtaatcaccagataattcctttcattttagttgtaaatagagttgtcttccccctctatggaatagattttattaatgtatagagcagcagtccccagcctctggaccatggactcgtactggtttggggcctgttaggaactgggccgcacagcaggaggtgagcagtgggcatgcaagtgatgcttcatctgtatttacagctgctccccatcgcttgcattatgcctgagctccgcctcctgtcagatcagcggtagcattagattttcataggaatgcaaaccctactgtgaactgtgtatgtgagggatctgggttcttcttatgagaatctaattcctgatgatctgtcattgtgtcccatcacccccagatgggactgtctagttgcaggaaaacaagttcagggctctcactgaatctacattatggtgagttgcataattatttcattatatgttacagtataatactaatagaaataaagtgcgcaataaatgtgatgcactggaatcatcccaaaaccatccccagttccatctgtggaaaaattgtcttccatgaaaccggtcatggaactggtgccaaaaatgttggggaccactcttataaggcatattagagtaatttcatagatttcctaattcatttatcatattcattcactcagcaagcattactggatgttgatcatgtactggctttggtggtaggtgcagagattgggaacattgtcatcaaggagtttatggttgagtgagggagatgacaagtggatagacaatgaaaaaacagtagaataagaactgtgatagaaaagagacagccaggagcattgaggagaggcacttaaccagatggaggatcttggtccattgatatggaggtcaaaatggtttaatagagcaagtgaccctttcaactgaattttttaagaatgaggatttagccagacaaagaagggcaggtgaggttgtgaagaggaactgagtggtactcttcagagctccagcccagttccttggacagaataaatgcttactaacttatagagctgaatattgaattaataaaataagggtaaactgttaagaatcagagaaataacttaaagaacactgatagctagtgttttttgaacaccatgtacccaggtgccttgccgaaaaccttaatgatcatcttgtttaaaccttacatttctcataagaggctggtactattgttattctcattttatgggacgtagaaactaagacttggagaggggaagtgacttgcccaaggtcatacaaccagtactggagaattagggattctagatctagaatttggactctggagcttaaggttttaacccacgacattatgcagagaaattgacaggatttttctgttgctgatcaatttacttggcagttagtttgttacttccttgtctttattttagttgtgacaatgctttcatcttagactgtgtcccgaggctgctgcttttatttttatgggaaatggctatttttatgatccttgctaaaagcatgtttaaacaattttccattaagtagggggatgtttttccttctaatatcagaagccaataaatgaaattctacaaagacttgctggtagcaaccttaggaatttctttgcatgtgaaacccatctgagaacttaaaatctgggtaaaattgtagtgtaatttggtgcaatcgtctctttgcacaaataacatcataaaatcatagtattgtcatctaggaggggccttagacatgatggaatcctaccttttatattttccaggtgaagaaatcaaagtctagaaaggtgaaggaacttcccccaaagtttcccagctggtagagacagaaccagggctaggtcctctattctgactcctgaccactacctcacacctaatagatggaggcatgcccagttcctgttcaccgagggcatcagaccatgccatactcattgctactgttccagcatttatagtagaagctcaagcaagcaggatgacagaatacctaattctggtcactacaacattataatgatggctaaagtgaatgccccagccatgcttgtctagacaggccatctgtttaattggtatatggttcacgtgagaatttttaacctctgtttgtcgagtcggtgttagttctctagtgatgaattatttcctatacttccatttagattatttactcttaatttaataaccatacattgtttactttggtattgaagattcccttgtttttcttctttttttctgtttccagggcttaaaggttaggagtgaccttgccagacttccctggagacttacactgtctcctttcagatttctgaagcagttgggtgctatttttagtccactatcaccaatgtgaaaatggaacttgcattatttcattatagatatttcactttagtattgacagaattaaaaaaataatttgatctgtgcttgatctagcagccaggttacaatagacatttttagttacctggtccacatgttgaaaaacatgtgtcttctctgagactaatgactaagcccgatgttggttatatactgtttactattaaattttccccttgtagtttaatattgttccaggaaatgaaatgaaagtttaataagaatggcaattgatggacccatatgtcggaagtataactaatgtccccgttacatgtgttaaagaaaggcatggctggtgggttgtaactgtactacaccaagatgatttgacacaacttattctacagagatatatatttatcaggatagaatttataactaaacaaaactatagcattttttcactttgattttttttaaatgagtcaaagaactgctagaattgtcagttaaaaaattttaaaaggagatatgaaaaaatcttacaattcacaatgctgtaaagagataatgtagggattaatatgttcttgatatcaatattttatgacttttatacatgtagaagcaaaacaatttgaggtaggtgaagttagtatggacttcttgagattgtccttcacatttcttttcctttcggtgaaaaattgaaggccaaaatgtattttcttctggttttgaaaatactgtcaagatccttgcaacaaaatgagttcctctaaggagctgaaaacaaagctcactcccctcgtgatactctgagaggctttgctcagcatcctgcattctggtgattccttggagacagatgatgctaaacacaggaagattaggtcaatggtaactttttctaagtcaatatttcttctccttgggagatgatcattttaaatcttcccgaagtccaggctaaacctttctaattgaatctccatgaaggagagctccagcaggtggagaggaagtgagaaagagaaatgaaagctgcacgcctcatgacgctgtgccagggagttcttaaaggtgagggagtttctttttggtaacctaagctatgtgaatcagaaggttcattagcttgtttctttttcttttttgtaaactcctacataattttagtaaacaggaacagtaacctaatgtgatatcccactggcccaagacttagtgcatcttcaaagttgcttaattatgtccgaaacagacttttgtctcttgatgagaaaagcatggttaaacgtgtgatgatttcctattgtcctgagctcagatctgtaattgtggccagattcatgcatctctgctgccttctcttagaagaatcatatgtaggcttgtcagataaaacaggatgcccaggtaaactggaatttcagttaaataacaaataacattttagcatgtcccatgcaatattatactaaaatattatttgttgtttatctgaaattcaaatttaattgaatgtcctgtatttttgttggttacatctggcagccctagccatgctgcctttctgcttaatgggcttaattttttgaaggctggaggttttctgttatggtgcccgtttccacctgcttttctaccaggaaaggaggcatgctgatgtagaatttgcatccttatttttgtcattattattgattataacagatgacataggtttagattaaacctacaatgacattgctgtcattcagataattgtaattattgctaattgtaaagaaggataattttttttgaaatgactattatttgttttttgtttttgtttttgtttttctttttttctaattatactttaaattctagggtacatgtgcacaatgtgcaggtttgttacatatgtatacatgtgccatgttggtgtgctgcacctattaactcatcctttacattaggtatatctcctaatgctatccctcccccctacccccaccccacgacaggtcccggagtgtgatgttccccaccctgtgtccaactgttctcattgttcaattcccacctatgagtgagaacatgcggtgtttggttttttgtccttgggatagtttgctgagaatgatggtttccagcttcatccatgtccctacaaagaacatgaactcatccttttttatggctgcatagtattccatggtgtatatgtgccacattttcttaatccagtctatcattgatggatgtttgggttggttccaagtctttgttattgtgtatagtgccacaataaacatacatgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctgtttctccacatcctctccagcacctgttgtttcctgactttttaatgattgccattctaactggtgtgagatgatatctcattgtggttttgatttgcatttctctgatggccagtgatgatgagcattttttcatgtgtctgttggctgcataaatgtcttcttttcagaagtgtctgttcatatccttcgcccacttgttgatggggttgttgttttttttcttgtaaatttgtttgagttctttgtagattctggatattagccctttatcagatgagtagattgcaaaaattttctcccattttgtaggttgcctgttcactctgacggtagtttcttttgctgtgcagaagctctttcgtttaattagatcccatttgtcaattttggcttttgttgccattgcttttggtgctttggacatgaagtccttgcccatacctatgtcctgaatggtattgcctgggttttcttctagggtttttatggttttaggtctaacatttaagaagaaggatacttaaagtataagggaaaatgttacaatgtatgaagggaacatgaagaaatagaatctggtaaaaaagagttcttgcttttgggaggccaaggcctcctggctaacatgatgaaacctcatctctactaaaaatacaaaaaattagccgggcgtggtggcacacgcctgcagtcccagctgcttgggaggctgaggcaggagaaccacttgaacccaggaggtgtaggttgcagtgagccaagcttgcaccactgcactccaggctgggcaacagagcgagactccatctcaaaaaaaaaaagaaaaaaaagagttcttgctttcaaaactatggattaggtaacttttgtgaatgagtaagatcatgagtattataaaaatagcacctttcttttttgtcttggggaaattatcttattttttaattggatttcagaaaagagtatttcagagaaataaatctctgaaatgctttttgaagtgtgaaagatttagaagacaaaagcaaacctcctgtctagataaacattaaagagatctgccctcccctcctctacctattcaggttgcaacactttgggggtggctgccttggtagagcttgatcgtgactctggtggcttgggagatggcatgctgcacaagggattcatggttacagcgggcttgtgggactggggctctccaatacgtggttgggtttgtaaagaaatcagagctatggtgtgaacaaaaggatatgcatgggagacagtgagacaaggaaatgctccagaaattattggaatataggtcagataactaactgtacttgtgccattttctgggggaaaattctctgaaggctttttgggaaaagaatggaagtgagaattctcaggtcctcaaaatatttccttttactcagtcctaacctgaggccgttaaagaattcccagagtcacgatggaaggcatgtttgggagtaagagccagagtgagggttagaaatgtgttgttggccaggtatggtggatcatgcctgtaatcccagcactttgggaggccaaggcaggtggaccacctgaggtcaggagtttgagaccagcctggccaaaatggagaaacctcgtctctaccaaaaatacaaaaattagccaagtgtggtgacacgtgcctgtaatcgagctcttcgggaggctgagacaggagaatcacttggacccaggaggtggaggttgcagtgagccaagatcatgccactgcactccagcctgggtggcagagcaagactccatctcaaaaaaaaaaaaaaaaaaaaagaaagaaatgtgttttccagggttctgggtacttaggaatttggttgcttttgcaggtggaagtggaggtgactaggtaacagctgagtgattttgccccagttggacatgagccaggttgagcagaaagccctgggatgcggggaggggggtggcggggaaggaattgaaagttggttgtgtggtttggctttggcttcatggcatgctcacaccttgcttcgcatagcatgcttagactacagcaggagcatcaggaagtggatttctgagctcaatacaaaaagttataaataccacctataagggcaataaagatatatagttgattttcttctttgcaaggccaaatcttataggaacataagagcgaatgagttacagcctgggaatttgagccttatattcagagattttaggttgcttctgattccgctgtctagacaaaaccatgagaggatagtgtctagaaatgagaggaagctcttccaatgcagaggctagaatgtgtcagcctgtgctgcgaggcctgggatagatgtttctgaaaagtaaaagggcagctttcctactggatacttgatcctcaggctctagaaaactctgctttattaactttgttgacttcctaggcaccacatgggatccttgttcttcctccttgtaagcagtaattgaaatcagtttggcagcctggtttacagtgaccatggtggcttgtctcccgtgctcttacctcactctgttgatgttgtaaaacctccagctaacttcatggggtggctgacccacgttgctcatttattcattcaacacatattcattgaccatctactctatgccaggtattgttatcagcactgggaatagatcagtgaactattgatctatttgtctaatgggacaaattgacaaattgggaaagattccattacacaggtgacatttaagcaaagtcttgaataagggagggaatagtaccatgagatatcctggtgaaaagcaatttaggctgagggcacagcagggaagaggccctgatgtgggaacatccctggtgtcttgaggtacagaggccagcatggctggcacggagtaagaagttggaggtgccgggcatggtgactcacacctgtaatcccagcactttgggtggctgaggcagatgggtcacctgagcccaggagcttgagaccagcctgggcaacatggtgagaccccatctctacaaaaaaatacaaagaaaattagccagatgtggtagcatgcatctgtagtcccaattgcttgggaggctgagatgggaggatcaaattacttgggaggctgagatgggaggatcacttgagtccaggaggtggaggttgcagtgagctgagatcatgtcagggtgacagagcgagaccctgtctcaaaaaaaaaaaaaaagaaaaagaaaaaagaaaaaaaaagaagttggaggtgagtaaggagaggaacgtgggggacagagtcctcaggactctggcttttactctgagtgagtcgaaaatccaattaaaggtttgaaagagaggaatgacctgatctgacattttattgtgaacgttttcaaatctttacagaagtggaagagcataacgatccttcatgtacacatcgcccagcttcaactatgatgtttcatttgtaaatatttccgtctacacttccaaaggatgatgactatttttaaaagtccaactataataccattatattttaaaagttaaaacactatgtctttaaatatcaagagtttgtattgattcgcactttgaaggtcgagctgatgaaatttcctgaggggttggatgtgacatgagagaggagtcaagtattgcatggtaattaaaaacctttgcagcatagtccatttaccgaaagactatatgtatgcacttcaaagcaggttttaaagattaacatcaagcatctggcttcatgagttttaacttcttttcataaatgttatacaatgtcatcatctctccagctagagaaaatgctattattcttattttcaaatgaggaaaatgacgcagaattatttacatattatgtaacttggtcccaagtcccttagatactggtttagaaaatcctagtaaactggaagtgacttatccaaaattaaaatttattttgctctattgtcttttgttgcctatgggaactttgtgcaggtaactaggcacatgtcaggactgatttactgacctctcaaggtatctttaattattttgggggatatcacggaatgagttctacacaattcatttgaatcgaattgaacttaagaaaattcaaatgatgcattggctgcctcctatttattacatgctgctcataggcataacagcatagtctaacaagtataaaacctgtgtaactgtagctttcagtgcagtgtgatgagggctgagaagatagtggtacaaagaagagaggtagcagagtgaagctgagtcaatatgatgaagatttctctagacttgaaagggctagaaaaggttattcttggcaggaaaaaaacatgagccaaggcataaggataagcacaggcatggcagatttgggaatgtcatgtaatttgttgctgggctgcaaagtacatggaaggggagtgaaggaacagaaggagatgaatctggagggagaggttaaagtgttccagagagcaatatgtaggtgttactctaagtcaaagaggtcgtaatagcatgtccagactccaaaactctaaacaagtcatagaattgctgccttggtagggcatatcacacacatcaacccaatcctctgtcaccatgacatccatataactgcaactctatacatttcccagcctatgttcccagagtctccagatgacattgtctgcaaactgcactgcagaaggctctgctatgtcttcttaaaagtaagcaagactgttttcctttgttacatgagcagcaaaaggatagggtgctctttgacctcacttactgtagggtggataggaaagtcaaggaagagtaacccagaagatttagttttaactttcgcatcaaagaggtcccttagcatctgctcagagatgtcacaatttctggtgtgtgattatgtttaagaattcggccttgccactgttgaagttgttctgtggaaaaagaacctctcttaattttacatgatgcccaacttctcttttattccagaatcactcatatgctgttggactctttccagccatgtgtgctaacctaggcaatgtcataatagatgaattatgtttactttgtctttgatatctcagctcttttatcttctattcaagttcccacctccatcattactgatagtgttcgttgaacaaagaatatgtcagatatacagaagtgtttctccccttttctctgtctctcttttccttcctttcctttagtttcctttctctgtctgttttctgatgcctcattttagaaaagtgattttttttgtgggaaaatcattttagcattagaaacgcaatggctatcactgacagcttcctctgatgaaacggccatttgtcatcattacacggtcatgggagtgctaagaagacttaaatgcagggctaccaccccttcccaattcatcttttatccattttatttctctaaggaaagggtttgaaaaatgggctttgccctcttggatgcagtgaagaaattctagctggctacagatgttattgttggtcggaggcaagggataaaatcatggtcacaccattgtagcgccagatggggaatgtagcaaacatagttgtaatttctcattttacagatgaagaaactgaggtgcagaggggttcggtgacttgtttaaggcatgtaattgttattggcagctttctgttcagaacttaagagtatgagtcagtctagatcttttcatcacaatactctgctcctcttactttttcctgaaatttgtcacattgacagcaatgtgatccctaatgacacacagattcccaaataatttttgtagtaaaaatttccatttgcaattctggacatgtgtgtgtgtggaattttatgtgatgacatattggtcctatcttttgaataggatcataaatgaaatgacttatggatcacattcaaaagcaggccaggggccaatgtgtaagcaggtgggttttcatatttggagttctgtacttttgtgttagtcagtgggtctaggactcttgtagtgtatttcccaagggccaaagtcttctgccttgaggtgtcagctttccaaggcagaggctggatgctttctcttccttctgggctcctttctcttaggcttcccccttctcttctcctccatttgtatctgtcctttttctcggtactttccctggctggtctcagctagatgctcactcaatgctgttgaataaatgaatgaatttcgtagtaattctgcaggtaaatcaagttattgtctcccaatacggtgctatgctttctgaggaaattagactggaagtcaggctttttaaaaaagaagatgtggtgtcaaattgcagctctctctctctctcgacttaccttttttctatcatccatatgccttctttcttgtatctttgggttcccagacctcaccattcattagcacttggaatggattggtaagaataaagaaaggagaggtggtgaaactcagcttgggtcatctggttacacattagtaactgacaaaagataaaaagatacagactaaatgggtttttagggaactttttccagtctattcttgtttcccattagtgtgaaaaatcaacacttgcttgtattttggggtgaagacatttttcttaagtgagtgggaaagcctcttgacattttaccgagagccttaaattttgaatggtgaatgctaatgttctttgtgcataaagaatttcagaacttgtatatatgagcattaatgatgcatcattttctatttgtgagttaaactaggtattatctgtaatcatatttttaggaaacattcaaactttcatcaagtcattctcttatatgactctcagctccattaactctgttttcatggaactcaacagagttcttaacgtttgcattataaattaaattagcatttcccctcaaagaagtattgctgtccttacaataaataattgtagacaatttcttttcttttcttttttttttttttgagacaggttctctctctgtcacccatgctggagtgcagtggcacagtcacagctcactgcagccttgacctcctgggctcaagcaatcttcccacctcaacctcctgagtagctagaattataggtgcacaccagacctggctaatgtttaaattttttgtagagttggggtcttgctatgttgcccaggctggtctctaactcttgggctgaagcattcctcccaccgcagccttccagagcagtgagattacaggtgtgagctaccatgcccagctaattgcaggtgatttctaatgggatttagtatttctgggtttaaggatgagatctgaggtaatgactttgtttccagatgtgaaataatttgctcttgggttgtgagccctttgggtgggctcccaaggatcctgctctcttccaggagcccaggctctggggtcagactgcctgggtccttgactccctgttttctgattgtacaactttggtgagtggcctaattcctctgtgccttggctaccttggttactatttctaaaacaactggtgttgtagtagtactgcttagagtactttcaagggttaaatgaattaatccatgtaaaacgcttaaaatagtgcctgccacaaccatcaatttagtgtgaaaatctgctcacctgcttggccagcccctttcactttattaaaccaagggtcgtgctgggttttccagaagtctaagttgcggtctaatctttgtgcagaagctgaaatagcagccataacgttctccctagatgatttcgtggagcttctttgaactgtatctatctccagtcatttttgtggaagaaattttcttctgtactttttagggatgagaattacctgccttggtttattaactaaaagacaccatgattacaaataaaattaaataaatattgtatcactaaatagataatatgagatagatgtattaagttttcagataaacagtataaaagagctagagtaatttgtaaaaagttgggaggacctattttgtcatgcaggaaacaatttttaacttgcctaccccagaacatagctaccacatggttagggtttgcccaaacctggcccaggagtcatttaccttgagctttcctaaaaaggaggatcaggattttcctctccagactctatcattttaggtagagtccttcttgtcaattctttttaagaacatacatttacttttgtggaaaataaatagatacaaaataaatacatacaaaattgcatagcaattagaaatacccaggaggtatgttatggtcacagacacaaactgcctccaacttctgtccatccatagtgatatttaaagcagagagaggtacacaggtaaccacatttagatggactgggatgttgccacacatacaagcattgataactggcttctcattacctgaatacattcttctgtcagagcaacagactcagctatgcttctggcaaaattgttcttaattctctattgattaatttattcggtaagtatttattgggtattttctgtctgaaaagtgcgattccaggtgctttatgtgtctctgtgtgtgggtgttatataaatacttataatactgtatccatactcttgaaaagcttagttgggaaggcaaggcatgcaataaggaacacagaattttagtcattccacaaccatctgttgaatggctgctattgttagtatcgtggtggaaactgagaagcaaagatgactataataggatctcttttctggagatgcacagtggacacgtagttatatgatgatgataaggactccagaatagttctatacatgatgctctggggccacatgcagattctgatgagaaacaattaactctttttggctgctacctgagaaggggtaattgtcactcaggaggtttttgccttttgaccaacatagaaaggagtgtgagtgaaggctagaggtgtactaacttggtcagggcagggtgacacataaaattaaccatcacagggaagggtagggctggagaggcagactgtggccaggttacaatgcgctgaggctaaggagactgtgtttatcctgtaggccagtgggtcttactctgaagtcttttgggtgggacattcatggacttcaagagacctgtgaatgccctaagattataagtaaaatctgtgagtctgtaactaaagctaaagctatttttctggggcccaccatctaaagaagattctgaagccttagggtagccgtggaggagacatgaaggtccattttgcatggtagaaccctgcctggctcttgctgcagtgtgggaggacaggtttgcaatgtggaggtgtggcaggcatggatttgggaggattggcagaggactcaccatgtccatacactcactgagatggcaaatatttattaatcatccaactgtgtatcagacactaagaataagctgggaggccatggcaagtgaggtcaccacagtccctgccacagtggaggttatggtatacaggtaaggcagggaagagcactgcaaagggtttgcccattgcatcagtcatttatttatgcacatgttgattcaacaattatttctatgccaagctgtcttcaaggtgctggaggaaatgaagcgtacatttcactggggaagacagacaataagtaaacacattaaaatctggcttggcttgatgttggggaggggtgagtgccatagagaaaacaaaccatttatgcagccaacaaacatatgaaaaaaatctcatcatcactggccattagagaaatgcaaatcaaaaccacaatgatataccatctcacgccagttagaatggtgatcattaaaaagtcaggaaacaacagatgctggagaggatgtggagaaataggaacacttttacactgttggtgggagtgtaaattagttcagccattgtggaagacagtgtgatgatccctcaaggatctagaaccagaaataccatttggcccagcaatcccattactggctatatacctaaaggattataaatcattctactagaaagacacatgcacacgtatgtttattgcagcattgttcacaatagcaaagacttggaaccaacccaaatgcccatcaatgatagactggataaagaaaatgtggcacatatacaccatggaatactatgcagacataaaaaaggatgaagtaatgtcctttgcagggacatgggtgaagctggaaaccatcattctcagcaaactaacacaggaacagaaaaccacacactgcatgttctcactggtaagtggaaattgaacaatgagaacacatggacacagggacgggaacattacacacctggggtctatcagggggttgggggctaagggagtgatagcattaggagaaataccaaatgtagatgacgggctgatgggtgcagcaaaccaccatggcacgtgtatacctatgtaacaaacttgcacattctgcacatgtatcccagaacttaaagtataattaaaaaaaaaagaaaagaaaacaaaccagtgtaagaggatggaaagtaataggctcgtttagaatggtgtgagaaagccaggcagggagaaggcgctgagacagggaggtcctggatgtgtttgtggaagagctgtggcagcacctggaacttggggagcaagggaaggagtgtgggcaggcaagggtgagggtgcagggggtcatgctgggccttccaggtcacggaaggacttgagctttactcttgttgtggtgagaagctgctgagggcttggagttaggggagtgaaaagatctctactataatagggagagttcgggatctgtaacttaaccccaggagccagcaaagctccctggaggaaatgcagtttaagctgagaatgggaggataaacaggtgtttttcagagaagaggaagggtgctctaggcacagagaacaacatgctggaatgcttctactagatcataggggcaaaatgggagtgcaggagtaggagagggctttctgggaaagatacttattttaattttgcatgcattgagtttttgaggtttctttggtttgttcatgtggaggtgcagagtgggtatttagcacataggtctgaagtccaggggaggggtgtgggacagcagttggatgtggcagagattccacaaagagcaaatatcatctgagaatggcagagggctgagggcagagccctgaggaacactggtgtttaggagcctgctggagaaagaaaatactgcaaagggaacggaagtggagtggttgccagacatagaagctagtgtctaactagatgtcatgagatgtggggaaggtgttacgtatctaagaatgcaaagttgaacccctgtgaactgtaatacttaagataagtcgtataaattgtctggaactagagcttgattttccaggagagatgaaatgtgtgtaggtgacaggaaacaatgaatatgtgggcgagtgtagtgtgagcaatttctcagaggtgaatttgacagcattttgcttaggaagctacaaagagaccaatgctagttggtgcaaggaattcaagaatttggacttaagtctatataatgatgattttttttttttaacttgagtttcccggtttatcactcccagaatataggcagaagtttgagatttttatgtgtattttctggaaaagatagtttcagtgttttttacattctcaaacaggtttatgatccaaagaaaaggcagtggtcacagatacatgaaacgacaaggtattcaaaggagaacgttgtactttatgacagttctttgggcagtggcttgcaggatgagtttgaggaatgattggaggcaggagagtaattctagtaattcaaatgtggagtattgttgatctctcagacacaaatggaaaaacaaggaattcaaagaaagataggcagagtgttttgaagaaataattgatgaaatttggtaatgagttagatgtaggagatatatttagcaaatatttattaaggactgtattaatctgttatcatgctgctaataaagacataccaagactgggtaaattataaagaaaaagagatttaatggactcacagtgccacgtggttggggaggcctcacaatcatggcataaagcaaaggaggaacaaagtcacgtcttacatggcaatagagtgtgtgcaagggaactgccatttataaaaccatcagatttcatgagaaatattcactatcatgagaacagcacagacaaaagcctgccaccatgatttaattacctcccactgagttcccccaggacacatggaattatggaagctacaattcaagataagatttaggtggggatacagccaaaccatatcaaggacctactgtatatggttaaaattgggagcaaatgagacatgattcttgccttcttggagtttactgtttactaggggaacatacacttgtcaataatcacccaaatataggattggaaattgtggtaagtgccatgaaaaacaagtatagggaattttgagtgtacatagctttggggacttgatttgatgagggagccttatgaagttattgcactagaactgaattaaaccacatttctaggaagtggacatctatttgttggttctttaaatttagctttacagaaatatttcctttaaaaaccaaggcttcttaaatttttaaaactgcttggctaatcaggggaataatgcttttggatagctggtatcgttatttatggttggaaaaacaacagtatttgattacattgagctttaaacttttcctttgattaatgaaaattttattggcccatagtttttattatgctctgtttttacttggtccaagagattctattctctggacccaatatgaataccttcagacatccctctttttttttttttttttcacccaggctggagtgcactggcacgatctaggctcactgcaacctctgcctcctgtgttcaagcaattctctgcctcagcctcccgagtagctgggattacaggcacctgccaccacacctggcttatttttgtatttttaccagagatggggtttcaccatctcggccaggctggtcttgaactcctgacctcatgattcacccaccttggtctcctaaagtgctgggattacaggcatgagccaccacacccagcccagacatccctcttaattatgttgaatatgtaatatcggtgatttcatttgaaaatatttagtagtcgaactagatcaaggcagttaagcttcctatttccatagatgcagtggtattgtgtcttttttatatgatctctcatgcttctggacatccttttttctgctattcttcattccttagctacacttggtgcttcgtggttgtaatgcattgtcatagatgcgttcatttctcattcgatcttcagctctatttctttccagagaatctctacaggcatctgttaggttgaaggacatctaatgtcttaatgtgtagcttggtaaaccagtcaactttctatctgagtcttaagagaaagtgtccaagatgagaaacggtacaggtttggtgacaactcagtgagaaaaagaagaattttacaaggaaggaggtatcttagtaattttgctaaagaagtaggtaaaccttcacttataataaagggatagggctcggttagggtttgtgaagtctccccttaggaaagcaaaccctgaaatattttgaatcttttaaagaaggaaaataagagtcttttaaataaatttttaaaatttattttatatattttttatagacaggctctcactctgtctcccaggctggaatgcagtggtgcaatcatagctcactgcagccttgaatgcctgggctcaagcggtccttctgtcccagcctcctgagtagctgggactgcaggcatgagccaatgtgcccagcaagagacattcattttggtactgtgatggtacagaaaaacaaagggcctttgaggccgaaggagcagaagaaggatggacttagacatggtataggcactttctactaaagagctgtgaagctaaaaatgccaggtctatgacaggtgcagtgggccaaggccaggtagagagcagcaggaagagaggaggtggggacctgtacctaggcccatctgctgggactgatctagccataggtactcagagaagcccagattggtgcctgacccacccttatggcccagacatggacacctcccagtctgttccttcctgctgcccatggatgggctgtgttagtctgtattctgaggacacagctctctgtctagaggaagttatgttatcttgatctgatggatactcaacgtgaacattatttcaacgtgccacagggtcttggagcccagaggaagaccgctcttgccttttagtttatattctttgtttttttttaaataacattttgacagtctttatggagtaagtctgggccaaaatgataattgacaatgttatttacatggatttctaagttggctaaaaaagttcctttatggttagtgaatatagcccatgtagtttccccgtcttctttagatgccttctatttctatgcccaaagtctgcagttgattttcagtaagctgggggtcatcttagagataaaatgtagatgaatggcattttgctgacagcatacatctttgctatttctgaggaaaatgggctctcgctattaaatcttttgtcaatatttataaaaatagtatttacatattctatctatattgtggaaactatacatttattgattcagtcatttgatatcaatgttgttgagtccctattccaagtgaggcactatgctctaagcacatggcattttaaagatgaataagacaccaagaactttgcagatagtaatggaaatgagaattaatcaattgaagattaatatagtaagtagcagaagagaaataaaaaaatcttctagagagttcagaacagggatgttgattcaagtttatggggattaggagtggctggtaagggaggcattcaggcaaaagacataaaaatgcagtattcccctcgcactcattaggatggctactatattagaaaaagaagagagtaagtgttggagaggatatagagcaaatagaaaccttgtgccttgttcatgagaatgtaaaatggtgcagccactgtggaaaacactggtgattcctcaaaaaatcaaaatagaattatcatatgatccagtaattctacttctgggtatatatctaaaagaattaaaaatctgggtcttgaagaaatatttgtatactcatagttatagcaacattattcataatagccaaaaagtagaagcaatccagatgtctatagatggatgaatgggtaaacaaagtctgtgtagtatatacagacaatggcatattagtcacatcatggaccttcaggacattatcctaagtgaaatatgctagacacaaaaagcaaaagtagggtttcacttaatgaggtatctagaattgccacattcacagagaacaaaagtagattggtggctgctaggggataggggaaggagaaaatggggaattattgttgaatgggtatggagtttcagttttgtgaaatgaaaatgttctgaagactggttgcacgatgatgtgagtatatctaacatgattgaattgatgaacacttaagcgtggttacgatggtaaattttgtgttatatatatcttaccacaatttaaaaaatatagcattttattatgtaggcgtgggtgggaagatacttgacacattggaacttctggccatgcgtatactgttcactcacttattccttcattcattcaacaaacatgtattgaatgcttgctatgtgctgggcactgagctagatataacaattaataaggcttataagacattgaatctatcaatttcatgcttgctaaatatctactcccacctccaaaggcactaagcttctacagttagatattcatagctgcttcctactgacttgaatcatgcataggatattagtaaacaagcaataaaaagatttgaggttgatgggggtgggttcaacagcatggtggtgaaatggaaagagatgggtaacagaatatgaactagaattgaaaactgtgagccagtgctctctaatgaacattaaaaaataaagaattcctatttgaggctgccaacctcagaactaagttatttagaatggacgaaattggcaaagtcagacgtactcaacccaaggagccaatattttgtgaatattatggcaaatgtagtttgagaaccactaccacaaaattgtgaaccataataatgactgagaaggcagggagaggttatacaatttgggctaaaaggaaagacagggcttgtgaaggggagcgccagtgaaagtcagtgtggttcgggtatttgggtggggactggaagcaggaagcttgagcttcctttgccaagagaccctgctggaagggctatcatcaattgactttagctcatcttaggattttcattttttaaaaaatgttcacaggaaccttcactccatctatactttcaatgtctgcctacctttctttcttatacaactttgaacactctctccattcatttaaatatattatggagtgccaactacatgccaggtactgtgctgggctcttattccacctttatttgattgcacatgcctgccaagtcctgggccaatataacatctactcctatgtctggtctggcgagagatgcaaactcatcttcctctactttccttacctccttccttccagtcttcttcaagttgtcttcattgaggcaatttcttttacctgtgtttttaatcccaactcctctagtttccttcttggctttattcttttatcttcctctttgtgctttcaaacattccctttctcctggcccatgcccttcagtctacacgaggccttctcaagtctcttcattctaaaaaattcattttcttgggtcttatattcttcagctgccaccctatctgtatcttttcctattctcctccaagttctcaaaggaatgccttccctcattttcatctccttacattccatctgctgaattttggcttgtgcctgtacctgtctaaggaaactccttgctaagagtctgctttgtcaggtctgaattcacttaaccagtctttgctttgttggacttctctgccccatttgccattcttgatcatcctctccataaacctttctacttaaagcattttacttccttattttcttggttttcctagaatctccttactgttcattttcagcttcctttctgtgttcctcttctcttcctacatttttttttagctttctactttcttaaagcattttacttccttattttcttggttttcctagaattttcttactgttcattttcagtttcctttctgtgttcctctgattgtctctctttctacattttttttttctgtgttcctctgattttcacgcagtctggagttgtcatgatcaatcatagcctactgcagcctcgacatcctaggctcaagtgattctcccacctcagccttacaagtagctaggactacagtcacacatcaccattctcagctaatttttttaagaagcatttttatagagatggagtcttgctatattgtgcaggctgggctcaaactacagggcttaaacaattctcctgctttggcctcccaaagtgctgggattccaggcatgaaccaccatgctcagtctctacatgttcctaaagaggagttttgaatattgaagaacagtattttcaaattacattattcaagttataaaaactgatatccagggttatgtggcaatgacgtaaaaatttgaattgttatttttttgacacatgttctgtgttgtccatcagttcatctgagttccaaatgtcccagctgttttatgctttgtctctgtttcccagagaccctgagtgtggtctagagttgggatgagcattggtctctaatggttctgaaataattgtatattcctgcaaaaacattaagtctattagaaaccagctaatttcattttgtcatttttataggtaacatattctggtgcaggtagtatgtttttaaaacaagtttgcaataaacaatttcccctcaaggttaatataataggcaacaccttttgctgcaacagacggcaagaggtaatgaaagattagcttacattatgattcattatttcaaaatgtcaggataaagtggatctgctgcatctcccagagagtgcatgttttgcttttctaatgttaatggatttactgtttttttccccccaggccaaattcagataatcgacgccagggtggcagagaaagattggccagtaccaatgacaagggaagtatggctatggaatctgccaaggagactcgctactgtgcagtgtgcaatgactatgcttcaggctaccattatggagtctggtcctgtgagggctgcaaggccttcttcaagagaagtattcaaggtaatagtgtgttgaaaacgacttctatttttgatcctatgagcagatcctaagagccaaagcgactgaggaaggaagacatagaatcagccatttgtacaaaacatgaatccctagtaggtccactagtatctttggtagaaacatggagaagagacaggatctcaggagaaggagttgacacatggcagggcagctgaggctgagtaattccgcttccttcctttggcaagactcaatcagtcttgagcaactctacagaagaattccactagctggatctctgaggaaaaaagaaatgttgtctgtgccctgactggggaatgccagatggacattcatgtttggtaggcaactttgcctatatgatctggtatatgctgttaattgtccatgcataattatctctctactcaggccttgtccaggcaaatattctgttttgttctagtttagcttgttctcccctttctctcttccatctctttcttgtctcaatggatgacaggatattttgctatgagctgactcagtggttggtgtcttgtaatggggagatatcatctttatcaaacagttattaagtatctacctgtagcatttcattttcccgcctgcctccattgttttcttgtctatagtttgccaattatagctaatatacggagagctatactttatttctactccagaaatgtctctattattgcattataataggataccctggggaaacactaatcatttttactacctaaaatacctatgctgaatatcctttatctgataggaacagagatctgacagcagcttaggctaaccaaattcattttttatcttaagtgtggggcatttttctctcttcttattctttaccttttcagcttaagtgaaggttagtataaacactaagaatatttctgatggagttttcatgtgattccttctacaaaaacccagatttaagtaacttgttgaaaaccagagtccgctaagttaataaacactgattgaagaagtgattctcatggactttctgtgatagctctttcctgccctgatatgagatgaaagctgggggatggtatatagtatttatttttccttccgttgccagtgggactttttttttttttttaaaagctgttcatatcttaatcgagtagcatgtgaggtcaacatggtctattttaaaagcattttcttcgacacattgcttttaacatcttttagaactctgctgtgagacacatggacttttttgttggtatttttatacaattaatgatattctcaatagtaatctttgtgtgtgtatatatatagaaataaattctaaatgtaagttaatatatttattatttttctaaacatatataaatatatatatgcacacaggctatttaattttattagatgatgctattttaattcagaaaaaaatgacatttatattttgatttaggttagtataagcccttagaggtgttttgacaactctcttaatttgtggttttactgtttatttgattttatataatctaaaataccattgtttttaccaagcatttaatttggcagtgaaagagcgtctgacagaggtatggttagtagataggtctaactgcacaactggatggattgagctgagactgtttcctcatcagtaaaaatgatttgaagcagtggttggcaaagtttttctgtaaagggccagataataatattttaggctttacaagggccatgcagtctctgttgcagctaccgaactggattatagcctgtaaggtgacctgtaaacacatggaagtgattatgtgctaataaaactttatttatcagaataggtaacagatcagccctggcccgtggccgatccctgatttaatgtttatttatctgatctaaatacctttatttatggaagggaataggggatttttaaatctaaagttttgattattcacattttactgagaacttactctatacctgattagatgttccgagagaaataaaaaaaaagtgtaagacataatccataataccacaaaatttaaaatgtatttaggaaatttatttgaggaagtaaatgtacttgttctcatgatacaatcagaaagtaagtcagtattgataaagtgttacctgtatgagaaagataaggaaaacaatagagagatgtaagaaatgaaaataccagttataaattaaaattattaagattgaaagtggaaatgatcttcctccgagaaacaatggcaatattctcacaaattttttacatcatttttgttcagcatttaagataaaattatataaattcccataacatttagtattgtctctaagcattaagaacagaaaaaacagaaggaaaatatatttctaaaaatcaacgaatacagtgtgagatgtttcattggtatggcattatctcaagttcaaacattttgaaaaatgtctgcttactctttgatagttaaaaacaagtatctcagctggcgtggtggctcaggcctgtaaccccagcagtttgggaggctgaggcgagtggatcacaaggtcaggagatcgagaccatcctggccaacatggtgaaaccccatctctactaaaaatatgaaaattagctgagcgtggtggtgcacacctgtagtcccagctacttgggaggctgaggcaggataattgcttgaacctgggaggcagaggttgcagtgagctgagatcatgccactgccgtccagcctggtgacagagtgagactccatctcaaaaaacaaacaaaacaacaccaccaccactaacaaaaacctcttatcgccgtcttgtatacgcagaccagctagtagaattttactgaaacagtagcctataaaaatgcaattccacttggtttcagaaacttcttgtgtatcatagtgtgaagtcacttatcttaggcttttaaaatgggataaatattgagtccaaagttctggaagaagcctagaaagaaggcagagttattaacttttagatatagggaggaaccttaaaattattcagttcttcattcattcacttattcattgactagctttactaacaaagccctatgcaagaccctggaaatgcaatgatagaaaaacctggtccctaccctcacagaacttgtgaggtaaagggggatacagactgataaaccagcaattagatgatggtgtcaagatagaggtgaaggcagtgtcttataggatccaaactccactcagtcctggtggtggttgagtctggctatcagaggtttcctgattaaatctggagggtgagtcaagggagcatggtgaagaaggagggaatgcatgtttagccatgtgaatgagtccatgagtgaagaccaggaggaaaggcagagcgcggggaattctatgcgtaatatttaacaaaattaatgtactgttaaacaaagacatttctgggccatggatttaatcctagactgtgtaaaaaccaagtaattgatttcctttatactttaaaagcatttccatgtatttgatttgtttgtgtgtataaaagggaaataccacaacaagtttaagggtttctagttctgctttctcatcatagtcttgataacttggaactaaaaagtttttgctgaaattgtctgtgactctttataaatcacactgcccctcaaacacatttaaggatggtgaagggtctgacacgtaggtgggaagttctgaagatgccgcagctctccctgttttccttgttacttaagaagagagctagaaatgagtgtacatcagattattctcatgttctaagtgttttggttgaagaggtaaagtgtttggcttgaaagcatacaaattttcatccactacttagtgtacaaacttgattacttaagagattgagtaatggcctccagtgaaacgcattctttttaaaaagcaaagtgaaggatgctatttaagtcagaaggggcaaaattggatattttatgagtttattaatcattgcaggcatagaagtagtgttccttaagatgtgttttagacagagtccctgggatgagttatataagcagatctggttgtagcttcagcagccagatactacctttgagtattacttcaaggaaaaaggactccactgagctcactgcttctctttcattattatttcagaaggttgtgtggcgtagagggggctcaggcctacctatacaccactagctatgttgccattttatattatttctataaggtgccaacagaagctgctcatcagatcagacagacatagcccaggcaagtattgatttacagatgatctttggccaggaagacatggtatcagggtagagtctggttatgggtcaatgcagtggggaccttaggtcctacaggtataactgagagcctgatccaccaggccttagaaagcttcagggtgagacagtccagcaccctggatagctcctttaacagctgtggccggtaagcaggcacttatttgctaaagaactcaagcccatttagctggcttcatctgctttgtagagctctgttaaaaagagttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaattcctaggttttcttctagggtttttatggttttagttggtgggactgtaaactagttcaaccattgtggaagtcagtgtggcgattcctcagggatctagaactagaaataccatttgacccagctatcccattactgggtatatacccaaaggactataaatcatgctgctataaagacacatgcacatgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacttggacacaggaaggggaatatcacactctggggactgtggtggggtcgggggaggggggagggatagcattgggagatatacctaatgctagatgacgagttagtgggtgcagcgcaccagcatggcacatgtatacatatgtaactaacctgcacaatgtgcacatgtacactaaaacttagagtataataaaaaaaaaaaatttaaaaaaaaaaagagatcttagttcttttgggcttggggactcactcttgttcacttaaagtggattggttcttacatttattttcatagttgtgtctggtcaccttctggcttgatgtatgcccctatgtctggaaaaggttagagaatggggtagaagtggaggctgcccgcccatcatgtaactgttttatcttttcagagatacaattgggatcctaactctttggtctccgtatttccacacttgctcttatacgattcagtttccatgcaacagcaggagagatattttagatatattaatcaggtcctatggtcttgagtttacagctctcagtgtaaatcttactctcaagagaaaaattttccttctgcagctgaaaacattcgacatattctctctcctattccttctcccccattcactgtactccaggcacaccagcttttatttttatttattttttgctattccccccaacacgccaacatgttccttcctcaggatctcagcacatgtggttccctttttccctttgcttgaaatacccagatctttacttggctggtttcttgtcattcagattctgcccaaagtcactttctcagaagtagtgttacccttccacgagtaatactactcttacttctctttacagctctcaaattcttatgaagttttcctatttattcatttgtttgattattgtctgtctgcatcaggtaccgtgcaaacttggatgtaaactcagtgatagctgatttctgttcagcattgtttgttgctatagctccagtgcttttagtcatgttgggcacgtccctactaaatagtagaatatggcgaagggtcagagtcatgatagatagccggatgtggtggctcatgcctataatcccagcactttggtaggctgagatgggcagatcacgaggtcaggagttcaagaccagcctgaccaacatggtgaaaccctgtctctactaaaaatacaaaaattagccagttgtgatggcatgtgcctgtaatcccagctactcaggagactgaggcaggataattgcttgaactcgggaggtggaggttgcagtgagctgagatcgcgacactgcactccagcctgggcgacagagtgagacttcatctcaaaaaaaaaaaaataataatgatagataaaaactgctagaggctctctgagaaggaagaaatgtcactgggttaggttggtaagagaagtgttaatgcaagtggtacatttgatataagcatgcaaataaatggtagtttggaggaaaattccagaaatgtgaaacagtattgagaaattgagtaagccagctttgagagaacacacggcttattgtcctctccttctgttttgctcctcagctctctaaagtgggcattctctagggtcctgtcttcaatctcagcttctttttcttcttcatccttctctttccacctagtttcctagggaattatatatatatatatatatatatatataattttgtatatatatacaaaattatatatatatataattttatatatatataattttatatatatataaaaaattatatatatataattttatatatatatacaaaattatatatatatgtctggtacaggctgaattgtgtctcccagaaagatatgttgaagtcctaatgctcagtgcctcagaatgtgaccttatttggaaataatgtcattccaggtgtaattagttaaggtgaagttatactgtggtgtaacccacagtatacttccagtatatacttcagtatatgggcccttaatctaatgtgactgatatctttagaataagaagaaaatttggacacaaacacagagaagagaatgtcatatgataacagagagagagagagagaagagagagagggaggagagagagggaggagagagagggaggagagagagagagagaaggagaaagaaagagaggagacagaagagaaacatctacaaagcaaggaacaccaaagattgctggtgcctaggaaactaatataataacataatatttggggcctaaagtgttacagctgcaccaatatctcccaaatcttgctcctagctcctgccccagcctgattttctcagtgactcccctgtgtttccctctgccaccagcccctccttctgcctgctgtgtgtgacagttcccttgccactccctccggcatccgtacttcaaactggggagttagttatttccattgtttcttattgcagcctctggctctgacgtttccagagctgttgcatagctctattgagtctatctccttaaatgcattttcatccacttaccattgctgagttagctgcattacctttcaccaggatgcttgcaataatttattgtttccatttgccttctccttcatctaagccgtttgcttatgtcttttttcttgttgcgagacattctgcacattgccactctattagtggtcataaagcaaatcactgatcatgtcaatacgcagtacaagatcctttaatgacctccatagcccatggaatggtccttaaacaagagttcaaggactgccacaatcttgttctagcctatctttctagtcattttaaagtcaccatttttacttgtgaaataggcactccagacacagtgaattccttgttcttctacaaatatgatgattccatttctttgctgggaatttctttccagatttacctgtaaaaattcttcgaaccctaatcaaaagtgactgttgttaagcccctgaagataatgcagaaattctctctctcctgggacctcgatattagtttattccattgtattgcatatatttgattgcccatgttctgtcccatactgactgtaaagtccttaaaggtgagggcccaatattctcagagtcactcaataaataaataaaagaataaatggaaattaggatcagtttgtgggctttagcaacacaaaaacattatactttttcaacatgggagaggtatgatgaaggagtttttttttttttttgagacagagtctcactctgtcactgaggctgcagtgcagtggcattgtgtcagctcacaacaacctccgtctcctgggttcaagcaattctcctgcctcagcctcccgagtagctaggattacaggcgtccaccaccatgcctggctagtttttatatttttagtagagacggggtttcaccatgttggccaggctggtcttgaactcctgacctcaggtgatctacccgccttggcctcccaaagtgctgggattacaggcgtgagccgccgcacccggctgatgaaagagtctttaatgcagattaatctggcagaggtatataggagggaccagagaagggaaagaatcaaagcgtgaagaccaatttggctgatattcaactagcttagatgtactaaaaatctgtactttttggtatttgtgaaatggaaagaaggggaatagaataaaggatattataatgaaaggatatacattgcttgaaggtaattaaatatgggttatccaggagataaaagagttaaagaggttcagacatagactgaatgaactgagaaatgaatgacttggtcaccaagaggaaggccagtcatcagggggtaggataagttcaattctagacatgctgcatttgagatgatagctggatgtccagatggaattatccagcagccacagaaacagaatcagctctctgcggatattccaggggtggggatttgaattaatttcctcaattaattttaaagaaacttgatgaaaagaatggtctgaatacttcttgaaggttgcacattattaataatggagaaataactctaaaaccttcctcttgattttcataataatataagcattccctgaatcttaccaaaccttgtaagaaacactcttattataaaaagtgtatgtgcaaagcccttctaaacaggaaaatgataaattagtcctacagggccaaatgcagctctctgggagcttacaattcagaaagaacatcctgctaccagcacattaagctgtacaaatagtaaactgcagaaacaaatataagcatttttatgatgtccaaacaagaaccaagcaggtgtttttttttttttttttgcagattatttatactgtggcagttcatagcctccttttcggacccagagcttgcataatccttcccttatttctacttacgtgttttactctccatcatgtgttaacatacatactgtgcaacagaaatgactatggaggctgagggcagcagagttttagtgtgtacacatatgagctgtcatgtaattttcaagtgaaagcctttgcaatgaaactttttaaaagaaagtcatggccgggtgcggtggctcatgcctataatccagcactttgggaggctgaggcaggcagatcatgaggtcaagagattgagaccatcctggccaacatgatgaaaccccgtctctactaaaaatacaaaaattagctaggcatggtggtgtgcacctgtagtcccagctactcaggaggtggaggcaggagaatggcttgaactcgagaggtggaggttgtagtgagccgagattgcaccactgcactccagcctggcgacagagtgagactcgtctcaaaaaaaaaaaaaaaaaaaaaaaaaaaaagagaaagaaagaaagaaggaaaaagaaagaaagagaaagaaaggcgggcattaacttcaggtattggtaaatttgctaggtgtttggctactgtttctcatcagagaaatagaaagacacaccatgaaagtcaaggcctgaaaacctcattccatgtaagaatgacatccccagtgttaagtgcttgttagtggttaatgcgatcctgtgaaacttagatgtgtttgtgcacacatgcacgcatatatttgaagaactcagaagagttaaatcacagcctttcaacctgtgaaatgacagtagttcttcttttttcctctccctttggctaagtcatctttatcttggagataattaagacaaaaatgcctctgacaaataaaatcagtatagaacccctatttcttggcagcttttgtggacacagctgaagctttcagaggtcttgaaaaaccatggcaacaaatgcctttgaagggtaagcaaaggttccaaatgtttttaatcgctggtgttttttctgctaccacttcaagcatttttcttcattttttgttcatctgatcaaaattaaatttccaatttccctactaagtggttctgtcctggtcatgccattgactatttccattaaagtagtagagtttgtgcccacatatggttgttaagctcatcaacaattccattagaaagctttgtttatcagtggcaataatttcccataaaaattatagataggttttaatgggcacattttcaaaaggcatcaactcgtcctcaaaattatgtgctgacactgttcttacaaccatggttcgtggcctaattccaccaaatttctctctttttcatagagaactgttgtcagtagctttatatccttttaaagagaatggtctgtatctctgatactcattcagagaaatgagtattttagacgtaggttgctaattttaagctatatactacactatgtcagcactatataggttatcttgtaacctgcttgcctggctatttggctgaaaaataacaacatgtaaggaaaatctatttcataagtctaacatttactttgtaaaacttgttctggctactctgttaattttccacttacgtgtgggttagagagcagatttgatttttttttaagcgaaagatatggcttacctgagaaaagaacatagtggggaaagcactcctattattttcctcatatttccattttcctttagcggaaataaaaagacatttcagtttttcagttgctaagaaatgaaggaaccaaagacaaaacaacttaattattaaattacaatttatttctgtaataagcactcgttctctctgttttcctggggaaagagtatgtggactttcaattttatccaaataagcatcatctttctctgattagtgtggcagtttcaaaatcatgtattaggaagtacagagtgaatgagtagagaatttctaaattagcacccaaggttgggtggctagattatgtttataaatatgaacttttgtattaagtgcaatgatttaaaagaatgcctgcatcactttagggcatttcattaagtgctgtgcacaatatttttccttatacatcataaaagataaattatagttcataaaatagtataaattcctaattattttgtgcttttgacacctcagagttactaataagggatttcgttttaaaatgatatttatttatttatttagagacgcagtctttctctgttgcccaggttggagtgcagtggtgcgatcttggctcattgcaacctctgcctcccaggttcaagcgattctcctgcctcagcctccagagtagctgggaccacaggcatgggccaccacacccaactaatttttgtatttttggtggagacggggtttcactgtgttgggcacactagtctctaactcctgacctcaagtggtcctcctgccttggcctcccaaagtgctgggattacaggcgtgagccactgtgcctggctcgttttaaaataatttaaaagtatattttgccaccactattaaccagttaagccatgatggtatattataatcaccatggagatggtttttctctttattttattttgtttgttttctgattgctagcatgctgattactcttcctattctacaagtgcctgcaggccagccccatttttgctctcttcacttcatttttcatttctccctgtttcactcttcatagcacatttgtactctgtccacacctagagacctccctgttgaagttcttcacattctcttccctagagagggttaacttgttgagctcagagacttaaacttaaaataaaatgtaacagatatgtattgaatgactattttattttagctctaggagaaatgcaaagatatatcatccatagaccctgaaatccagctaagggttctgcttatacacaaggtgaaaggttgtgataatgcacattaaacaatagaagagttaaattcagcactataagtgatgcctcaaagcagcataatgggaaaaaggggtatttcagaaaaaaatggtatgagttcagaggcaagagaaaacagaatgctctagattaaactcaaagactttatggaggaggtggtgtttcaatagatacctttccacagaaccatgaagagagttctacttaattgtaagtggcctgtgatttgtcgttagtcattgcatgctcaattctgcatgtgtgataactgtgtatttttatggcaaaatcgcaattacttttgcaccaacctaatagaatagtgtgggtttaaaaaaactatttgtaatatattcgaacatatttcttatatatatgtttcaccatcattagcagtaaatctattttgcatccagagattgaataatattttgtttctaggatgtgagtgatgtactattttaacttacttttgaagtttgacatgggagtgatattaataaaatctaaagatgctcctaaagaggagcaatagataatgtaggtatagataatgtagctattatggaggtaagtgtatttgatactttttattatgatatgaagggaaacaactagtcccaagctacaatttattaaggtaggcttagcttatacgccataatttttatgtttgcaactttcttgattttcttcctctggctttacttctatgggatatttatgaaaggatgtttttaaaaatggctagagacttttgcttctaagagttgacataaacttttccacaacatgaacaattagtagatgatacacttagatacactcttgaatttttaaaattgtggcagtaaaactgatctcagagaaggaagaaaatgctttggccagcttttatcaattatatacaacgtgtttggaagattcagttcctctcgccttctttctccctatataatactttttcttaaggttggtactattgatgcacttggtgtaaacacatgagataatagcaaaatatgaatctaggtcccagaaatgggcttctttcactctgccacctgttctgactgcatttctcctgactttctgtaaatcccggggaggagctggaagagcaaggtgtgtgctagcataactttggggatgaagtacccttctttttttctgattttgttcccacatctccttactggaccaagtaagggcatcagtgtcaaacttcctgattgaagatacatttttgccctaccatgaagggctctgggtaacatttattgcttataaaatgcttttttggtggctactttgtttctgaatataaggcaagataaaaagtttgattcaagagtttcttgtaaacactttgtgtgtgcgtgtgtattcatatatggctgcacacgtacataagtccatacataagtacagtccaccctccatgtttgtgggttcaacatccatggattcaaccgactgcaaatcaaaactatttggaaaaaaatggatggtagtgtctgtgctgaacacatacagagattttccttgtcattattccctaagcaatataacaactgtttacagagaatgtacattgtattaggtattataaataatctagagatgttttaagctatatgggatgatgtgcgtaggttatatgcaaatattatgtcattttatataagggacttaaacatctatagattttggtgtctgaggagtcttcgaacaaatcccccacagatcctgaggggccactgtatatatatatcttcataaacacacccacacacacaaacacacccacccacccacacacacacacacaccaatgtgtatatacttttttttcttttttttaattcgagaccaagtctcgctctgtcgcccaagctggagtgcagtggcgcaaacttgcctcattgcaacctctgcctcccgggttcaagtgattctcctgcttcagcctccctagtagctgggattacaggcgcctgccaccatgcctggctaatttttgtagttttagtagaggcagggtttcaccatgttggccatgctagtctcgaactcctgacctcaagtgatttgcctgcctcggtctcccaaagtgctgggattacagatgtgagctaccacacccagttgcaatgggtatagacttttgaaatgtgtactacaaaatattaacagtgactatctctgaatgataggattatggataaattttgttctttttgcatatctgtatttttatttttccacagtaaacatcttttacttctgtaataaaaacttcattaaaaaatccatgctgcaattgattaattatatactaacttttttttactcttccctcagtacagaaagattattctgtatttaccaaatctttacactttatttgcaaatcattttgactgtctgtttgcaagaggtcaaatttgcactcaagttcagctttcgttcattatccatgagcccaagagaaattgtgtcaggtggacatcaggtagctgaggccaatacaatattattcctttgggttgttgagaaatcatagcagaggaaagcctgtgttgataatagagtaccaccaggaatctaggtctttacagctgctggcctgaccagcaagggtaaaatatttcagtcacgcagccagtgattattaaccctagctctatattccagagaggaagagctagcctttttgggttgtgatctgtcactgattgcagttgcacatatactagccatgaggtctacacacatgtgaagagcatgctacacacatagactagatacactgactcatcagcctggaaacagtgcctgaccctcactttgattgtttgaatgtgtcctgacccattaccctgcctttggatccgttcctgtttttttttttttttttaaagcattttatctgtgaattaaaatagtactttccattgcttcatttttttttccctgaggagtttagctttgtttaattagaaacaagacaacaatcattactggtctggtgcaatcttgtttaggactcctcttttgcttagaactatacctggattagggatcactgtgatttagagtgtgcagtatgaggttatttaaatacttaatagtatatttgaaatgaaaagagtagaaattaaagactgaatcatttaccaagaaataacagaggagaccaatttacttctgtaagatttagtagaggctgttcccttctttataattggctttgtttcagttaccagttaagtggggtgaactgttattaaaaggctatgggtaaggttacagtagcattcttctaagaaaaactacaggagtagtcactgtgcagctatctgctttgtacctgccaatatggcagtagatatggaagggtcagaaaaacaggacttcatgttcaataacttttcctttttcctttctttcccttatttttttcatgtcttgtatgcaagatagcatgcctattctttaccttcaatgtatttttgaatttttaatccagatcatattttatcacaatttgtaacatgtagctaataaaaatggttattacatgagaacttgctttacaaattatagatcaaatttttatacaaattattatgtcaccatagaaaaatagttacgatttatctgtttagtcttagaaaaattatttcacatattagttaaggcttttagttttgagtgagcaaaatccaattcaaactagctttgggtagaggtgggggtaaaagagaggaatggatttcaatggaaggtttacttgcgtgtcttggctaactgcaaacatggcagggtgcaaccagaccttagtgatcacagacccagggactcagaccctgtgaggaccttagccttaccgccactcttctccatgtgtcagcttcgcgttctctgtctgcaagtatgcattttccctaaggtgggaagcagagttggcaacagctgccagggttgacttcctgtggcattcttgcagttagcaaatattagagaaggactctgcttggcccagctttgggacacacctctggaccaactagctgttctcaggaggcagtaacatgtacagaggtgatccctggggctcgccctgtgaaatcattgtgagccaatcactacctccctccctgatgctgatgtctactatgtttgatgtctctgaacttccatttcctcaattgtgaatggcaccctggttcctaccttgctggatagatgtagtgattagagttcatgcttaacctacaggtgctctgtaaagaatcattggcatcattacctcttgttggctctatcccattccctatagatatctttctgctctgagactaagcagagaaaataatttaacatttaattattgtgcttctaaatccacttttacctcttctttctttacttttctctttattatttttaattatttcaaaaataaaattgtatatatttaaggtgtacaagatgttttgatatacatatacataatgaaatgattactgcagtcaagctaattaacatcaatctcctcacctagttatcatttttggggggcatggagtgagagcacctgaaatctctcttagcaaatttccagtgtataatacagtattgttaaacatagtcatcatgttgtacattagatttctagacttgttcatgctacataactgcaactttgtaccctttgaccaatacctctctattttctccactattccatgcctgaaattgtgggatataggtatatagtgtgtgtgatatatatagagggagtgatatatgtatatataattgtgtgatatatatgtgtgtatatacaaacacacagacatacacacatgtacatatgtatatacatgcacacatacacaatgggatattattcagctttcaaaaaggacatcctgccatttgcaacaacatggatgaacctggatgacattatgttaagtgaaacaagctggacacaaaaagaaacatgcaccttacttcttagacacaaatttctttctcatagccagcacctgaaaatagggccaagtattttgcatgatttacaattgactgtataaatgtagcatagccagttatatgatgtgttaccatttctgctataaaatcaaaagaagagatcagaacatttaaaaacttccctgtggatttctacctcttacctaagctttgttcttgtttttttaaacctcatgaacacgaagctttagatagcggaggtcatgtatccttgggctcaaatatacagtttcttagcaatctttgattgctacattgcccttttttgtgtttttaactggccttccctgacttaaaatatactttaaaaaataacaaaggtggtatttagtttgcacagtatggaattaaaggtaaacaactttaaattaaatttggttggatgtataaattattaaaatatcctttctctcatggctgggtaagtctgcattttccattcagcctgctatgtctctttccatgagaacactcccgaagaatggggccctgcttccaaacaagccaagcattttgtagtaaattttaaaaagctaaatttcataataacctttataattgctacctgaaaatggagtttggaatggcaccaaattattaatcagtagaaggagaatagattgcaaaaaggtaattatatcaaattgaatgcttcttgaaatatattctgttaaataaaatacagttcctcttccctgttctcatttgtaagcaatgaggacaattcaggtagcatgaatcaggaatcagagtacttttctgttccgcagattggcttaatcattttgggctcacttcaaactgtagatgagcattgtcctttaacctgccgggcagcagaggtgaccacgttcactgcaaagcccagaagtgagttgttcatctgggttagggtctcaggaagaggcatgttatgacttccccacattcctggacagtttagactgtaattcttggttgtttaaaaaggtgtttgaatgtattttgttcagaggcttgagtaaatggctcttattcttacacttttttttttgcctgctttttccagcattagaatagtttcagccctgacaattagccttatgctgactggagtggattttttgcgtaggaccaagtgttttgcatgatttacaatggactgcataaatgtagcctaacaagttatatgatgtgaagaaaattacttaagggtaaaaatggattgtttactgagaaaatgatgttattataaactggtttgagggtattgtggtttagatgctgtccttacaaatttgagctctgttggtttggagatttaatatctaataataatagttaatgtgtaatgaatacttgccctgctccaggctctatgttacgtgtcctgaatgcatcatctcatttaatcctccataaaatttgaagcagtcagcattgtaattaatctcacttttcagatgaggaaaccaaggtatgtaagaaacaaaaccagtgttgaatctgactagtacgactgcaaagcctgactcttaaccattgtgttctgttgccttctccaagggaaaggagtgcttccagaaaggccattggaagtgaggagtgtcacctgataatagctggctcctcatcccactaggttaacaggcaacagatgggggccacagagttggctggagttagtcctggttgccaagggtaaatggggctgttaccatgcaatggatagaaactaggatgctcctgtgtgtctccttatatcctaccaggtgtagcatgaaggttaaggacaattccgtcctcttatttggagaggagaccaaggccctgtaggactaaaggtttgggtgagctgaaagccaagggcaattggcccagcttggggaggagagttacaaatacatttgtgactatcagaccagaaacagactgcggtgttcacctgcggtttgggtacctgctgcttgttctttgctggggtatctgaagactgaaaacacagctcacacttagcctttttcctattctgtgtgaaagaactgtagtagttttctcttgcttaacaaggttctagtggtgaagtttattgcttagtctgtgagttgtagggaaataaccacaggatgggatggtagcagaacgagaaaagaaaagaagattgtagatgccaggctggtgtcggcttgaaatttttaaagtatacagttcttctttatggattattaaaaaaaaacagcaaatgaatacacaagattaaatgttaagcagtacaacattgtacatgatgaaaggttaaagtctttctctggtctcattcaaaaatctacagtctcttgtagtatagtttgaagtcaggtagcgtggtgcctccagctttgttcttttggcttaggattgacttggcaatgcgggctcttttttggttccatatgaactttaaaattctgtgatgaaagtcattggtagcttgatggggatggcattgaatctataaattaccttgggcagtatggccattttcacgatattgattcttcctatccatgagcgtggaatgttcttccatttgtctgtgtcctcttttatttcattgagcagtggttttgtggttctccttgaagaggtccttcacatcccttgtaaggtggattcctaggtattttattctcattgaagcaattgtgaatgggacttcactcatgatttggctctctgtttgtctgttattggtgtatagaatgcttatgatttttgcacattgattttgtatcctgagactttgctgaagttgcttatcagcttaaggagattttgggctgagacgatggagttttctagatatacaatcatgtcatctgcaaacagggacaatttgacttcctcttttgctaattgaatactctttatttctttctcctgcctaattgccctgtccagaacttccaacactatgttgaataggatggtactggtaccaaaacagagatatagaccaatggaacagaacagagccctcagaaataataccacacatctacaaccatctgatctttgacaaacgtgacaaaaacaagaaatggggaaaggattccctatttaataaatagtgctgggaaaactggctagccatatgtagaaagctgaaactggatcacttccttacaccttatacaaaaattaattcaagatggattaaagacttaaatgttagaactaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgttctttgctggggtatctgaagactgaaaacacagcaaaagaaactaccatcagactgaacaggcaacctacagaatgggagaaaatttttgcaatctactcatctgacaaagggctaatatccagaatctacaaagaactcaaacaaatttacaagaaaaaaggaaccccatcaacaagtgggtgaaggatatgaacagacacttctcaaaagaagacatttatgcagccaacagacacatgaaaaaatgctcatcatcattggccatcagagaaatgcaaatcaaaaccacaatgagataccatctcacaccagttagaatggtgatcattagaaagtcaggaaacgacaggtgctggagaggatgtggagaaataggaacacttttacactgttggtgggactgtaaactggttcaaccattgtggaagacagtgtggcgattcctcagggatctacaactagaaataccatttgacccagccatcccattactgggtatatacccaaaggattataaatcatgctgctataaagacacatgcacacgtatgtttattgcggcactattcacaatagcaaagacttggaaccaacctaaatatccaacaacaataggctagattaagaaaatgtggcacatatacaccatggaatactatgcagccataaaaaaggatgagttcatatactttgtagggacatggatgaagctggaaaccatcattctcagcaaactattgcaaggacaaaaaaccaaacactgcatgttctcactcataggtgggaattgaacaataagaacacttggacacagggtggggaacattacacactggggcctgttgtggggtggggggaggggggagggatagcattaggagatataactaatgtaaatgatgagttaatgggtgcagcacaccaacatggcacatgtatacatatgtaacaaacctgcacattgtgcacatgtaccctagaacttaaagtataataaaaaatatttaaaaaatctacagtccctttctcaataggtaaacactattaacaatttcttctgaaaattacatatgtacacacacacacaccccacacatagatattttgttaacatacattaccttatgctctacacattattctgtgcctagcttttctcatcgaataatgtgtattggagatctttccatataagtacatattggtctcactcattcatttttaatggctgtatattagtccatagtatggagtaataataccttttattggcacaaagttttgcagttgacaaagggtttgcatatattgtttcattgggttgtatagcagtcatcaacggacatatcaagaatcccagaagggtaacctgggcttcacccaggatcgcatggagcttgggactcaaacagctaacattccctaaacaggcccatattcctgcaatttagtgcagctgctacaacatttaggtaaactctttgaaagcagtaaaaagatcaccaatctgggacatcaagaagccagacgacaaggagacatagacctcaggtgagtgagaaaagagaataattgaagtttagaactgaatgggcactaacgaacaacagatacatctctttcctttcaccgatgaggacctgggtgtggcctgtggatgttaagtagcatgtttaggccacacagctggattgttttctttcctgaggctagctctggagaggggaggaaacggagatgctagatttttccgggctctcttttctcatcagctagaatgggatgtggatggaatgcagcttgagaagccaaacacccttgagaaatgagaactctgctttctgatgtggggcgcatcctatctgagataactctcctgccagcgcagtatgaccattgcgacttgagctgtgtgggtgcccaggtggtgtagaccttaaaaccactcctgcttttgtttactgaatgtctaatattcacacagttctttgtctgagtgcagggccaaagcagcaaataacgaagaagctgtgcccaaccataagaactatgaaatgctccagatcatctacgctagtttgagttaaatttaccatgcaaataaatatagaacatttcttcttatgcatagattgtatttgttctattaaacaaccatcctgtaaaggttttattcattcatttatttttatttgttaggagaaattgttatttaagctaagaaagtagactagtagttatttctttttttttgcttattatactttacgtttggggatacatgtgcaggttagttacgtaggtatacacgtgccatggtggtttgctgcacccatcaacctgtcatctaaattaggtatttcttctaatgctatcccttccctagccccccaccccctgacaggccccagtgtgtgatgttcccctccctgtgtccatgtattctcattgttcagctcccacttatgagcgagaacatgcagtgtttggttttctgttcctgtgttagtttgctgagaatgatggtttccagcttcatccatgtccctataaaggacatgattgcatccttttttatggctgcatagtattccatggtgtatatgtgccacattttctttatccagtctatcattgatgggcatttgggttggtttcaagtctttgctattgtgaatagtgctgcagtaaacatacgtgtgcgtgtgtttttagaatagaatgatttataatcctttgggtatatacccagtaatgggatggctgggtcaaatactagaaggctacagtaaccaaaacagcatggtactggtaccaaaacagatatctagaccactggaacagatcagaggcctcagaaataatgctacacatgtacaaccctctgatctttgataaacctgacaaaacaagcaatggggaaaggattccctatttaataaatggtgttgggaaaactgactagccatatgcagaaaactgaaactggaccccttccttacaccttataagaaaattaactcaagatggattaaagacttaaatgtaagacctaaaaccataaaaaccctagaagaaaacctaggcaatacaattcaggacataggcatgggcaaagagttcatgactaaaataccaaaagcaatggcaacaaaagctataattgacaaatgggatctaattaaactaaagaacaactgcacagcaaaagaaactatcatcagagtgaacaggcaacctacagaatgggagaaaatttttgcaatctatccatctaacaaagggctaatatccagaatgtagaaggaacttcaacaaatttacacacacacacacacacacacacacacaaacaaccccatcaaaaagtgggtgaaggatatgaacagacagttctcaaaagaagacatttacactgccaacaacataaatatgctgccaacaagcatatgaaaaaaagctcatcatcactggtcaagagaaatgcaaatcaaaaccacaatgacatactatctcacaccagttagaatggcaatcattaagaagtcaggaaacaacagatgctagagaggatgtggggaaataggaacgtttttacactgttggtgggagtgtaaattagttcaaccattgtggaagacagtgtggcgattcctcaaggacctacaattagtagttatttctaggtctgacgggctgtcttttagtttgttttcttattctgaggtggacttaaaccaattttaaaaacagggatgactgaattcgtgtgttaatcttgtactacaggaaccctttgacattgattcagaagcacccaagtgtttgttcattaatccttttttatttttgcatattatttatttttcaacttttattttaaaaatcaggggtacatatgcaggtttgttacaaaggtatattgagtgatgctgaggtctggcatatggatgaatctgtcactcaggtaatgagcatagtacccaatgatagttttttgtacccaatgatagttttttgttttctttgtttttttttgtttgtttgttttttgagatggagtctcgctctgtcacccaggctagagtgcaatggcttgatctcggctcaatgcaacctccgcctcccagattccagcaattctcctgcctcagcctcccaagtagctgggactacaggcgtacaccaccatgcccggctaatttttgtatttttagtagagatggggttttaccatattggccaggctggttttgaactcctgacctcaggtgatctgcccacctcggcctcccaaagtggtgggattacaggcgtcagccactgtgcctggccccaatagatagtttttcagtccttgcccctgttcctccttcccacttctagttatcaccagtgtctattgtttctgtctttatgttcatgtgtaccaaatatttagctcccacttataagtgagaacacatggtatttggttttctgtttctatgttagtttgcttagatagacctccagctgcatccacgttgctgcaaatgacacgatttcattcttttttatggctgtgtagtattccgtggtgtagatataccatatattctttatctaggataactgatgggcaattgggttgattccatgtctttgctattttgagtagtgttctgatgaccatatgggtgcatgtgtcttttcaatagaacaatttattttcattactcttatcaggatacctgggaggaacttctcctacgaagttaatttggggggactcctgaagatgagtgaaaccccttattaagcacttagagggtcgaaagtgtacaagggaacgttcaggtgtgacagcttgagagacatgcatattccacccccacaccagagcttagtgaaccgtcttttctattttctcccaaagcaccaaaatggcccagaaattggaagatggaaaatggacttatttatgagtctgggaaggcagggcagtaagcacagtcctgttcagggttctgagttttaccctcttgctctgattgcgagatcattttcctcttccttgcttcttcagcttaggacaagaacagtttggaaattgtttctactactttggacaccatagtttagatttcaaatgagtacaagtgggaggaaagcttggataattctctggaaataatcgaacagagtgaaggagaggggtctacaggtgagctgaatgctgcatggcattgaagtaatcacaccagtcgtcacaattctctcctctttgatggttatctgttgtcccagaaggaacaatttcagaaagtccttttctggactgtagaatagcacttgcttatttgatgagccctgagaagcattactgaaagcggttcattgtccctgaggtattacaatgagatggtggtcactgatttcattatgttttcctttattgcagctgttggtttgatcctttgccaggtgcttaaaacaattgtggttttgcagatggtaagttagaggttggacaaaaaaagggatcatgtcactgccctggccaaaatttcaacagactggggtctagtgagggcaaatagatagaggctttcctcttcactttgtgttatttagaaaaagaaactttccaggacaaatttctttcctagaattccttttttaaaaattttttttctttgaaaatttacttagatgcaaataatatatttttcttccttttaaataataaaagtaagatgtctcttggaggtggtggttgtcactgacaagattaactagaactgactagctgtaaaaatataatttgggatgcattattaaggcatgccatttttatttgcatgccattgtgtacagatgtggttgtgaaatagttcaaatcatggcacattgaatgtcctcactggatttttaggaatgtgttcactgagacagccaaatcctatttcattttctttggctcattgcattggctgtaaattggagatattcactttaatatgtgagtcaaaatttatttccaaacataatactgcagttgttctgtcacagaatataaatttcttatttatttccttaatacgttgctttctactttttctttttttctttattttattctggagtatgtggaaaggttttccagaaagatttgcatatgccataatctactgatgaatactttttttgggttactctttcatattttgggagatataactatggaagtgttaggaatcatgggttctggaaatagttttattactgcttctgaaatgccctcccaatgataccatatagtaattccatcagggaataatatttttattatagtttaaaatataacttaatatttaggtgctcttgttcagtcatcgtcaagttctttttatttcaccaaccctaccatggcactcctgaaagacttgtgaatgcgacagacctggatttaatcatggctttgccatctgctagccaagagaacttgaacaagtgagtcaacttcttggagtctcattttctgcttctgtaacatgggaactagggtaatctaactcattgcttgtgatgattagatgaggcaaaatgctgagttcacctagcccagcacctggtccatgggaagcatgtgggttctgctgctacccagtccttggcccagtgcatggtgcacagaagggaatctgaacaggccaactttattcctattcttgacccaccccatgtagatgcttcctacatcttcagcttcttcttcttcttctttttttttttaaggcagggtctcactctgtcccccaggctgaagtgcagtggcacaaccacagctcagggcaacctcgacctcctaggatcaagtgatcctcccacctcagcctcctgagtaactgggatgacaggaccacactaccacacttggctaatttaaaaacttttgtagagctggggtcttgctatgttgcccaggctggtctcaaactcctggattcaagtgatgccctcacctcagcctcccaaagtgcctggaaaacaggcctccacacccagccttcaacttcattttaaaaaattgtggtaaactatacaattcatccatgaaagcagaaaccacttgtaccccaaaagctattgaaatttaaaaatatatatattaaaaataaaaataaaattgtgataagatatacataatatgaaatttactactttaatcatttttaagtgtacggttcagtggcattgagtacattcacatttttgtgcaaccggaacttttcatcctcccaaagtgaagctctgtacttattttttattttattttattttttgagatggagtttcactctagtcgcccaggctggagtgcagtggtgcaatctcggctcactgcaacctctgcttcctgggttcaagagattctcctgcctcagcctcccaagtagctgggattacaggtgcccaccaccacacccagctaagtttttgtatttttagtagagacggggttttgctatgttgggcaggctggtctctaactcctgatctcaggtgatctgcccgcctcagcctcccaaaatgctgggattacaggcatgagccactgtgcccggccagctctgtgctcattaaacaatgactccaagttccccttccccacatctcctgctgacctctcttctactttctgtctctgtgagtttaactattctaggtacgtcatgtaagtgcatctatgtgatatttgtccttttgtgtctggcttatttcacttagcataatgtcttcatgattcattcatgttgtagcatgtgtcagagtttccttcctttttaaggctgaataatactccactgtatggatagaccacactttatttatccatttgtctgttgatggacatttggatgatttccatcttgtgggtatactgagtaattttgctatgaacatgggtataaaaatatctatttgagtttctgctttcaattattttgggtctacacctcaaagcggaattgttggaagtggaattgctttccacttgttggaagtggaacatggtctcccacttcattttgacacaacttccaagcttcagaactgtatttacaacagcgtgctgggaggtcgctttgagtttatgacggaaatctcatatcaacaggttttaaattgttccatacgacttcttgccacccctgtcccaattcagatcttttttttgattaatggtatgaacaattttcaaaatatcctggcacaatctattagaatatttgactttctcctcctcctccctttagccctaactatttggcaaagctgttgaaaacttcttcacatcttctctctgcctcatctactttgctactcaaagatgattagtagatgttttggtatgattttttttccttggcataactgtgaatacttttaatccttcatgttttatgacaatcatacattcccacttttgtgtaaaaacattttgaattcttctttctataacaaattctttgccagtcttccttttctttttgcttttagtgagttccaatgatatcattgtttgaacctgttttctaattctatgctgctattcccatactccctctttgctttggttacagtagataatgtgggtggtcctaccaagacaaagcatcactcaggagtcaagggctggggtagatacagacactaggtactgcagaaagtcaatatctttctcagagtgtaaggcaggacaagacttctgttcccttgtaccgttgtggctggggagttggactgtgcatttcatccttgtcatataagtcaaagtattgcccaaataacttaattttggtgtggtcttagtaagtatttgtctcgtagatatgttaaatagaagacagtaacattgggttggctgtgttaattcctcactttttctttcctatacatgagcttcctaagaagcggaacacttggtggtcagacagttgcagagattccttgcatgattgcaatctggaaagtagataccattcttgaatgaagagcttgccctttggagaagctgggctttccatatatggaggttgttagaatgcataagagttcagcttctggaatgaaaggagaccttggttcaaaacccatctgccacttgcttgctgtgtggcttaaatcaggcttttaaacttcaattataattttgcatctgtataataggattaatataattccttcctcataaagttcctagggggttaaatgaaacaatcaatgtataacacacttcctggcatgtgatgttcagtacctagaagactcggtttccttggtagagagaatatttggctagacaagcttatggaattacccccagataggaagtgagcacaagtgtgaaatgaacaagccagagcaggaacggctcttggaagcgtctactcaggcctgggcagttgctggtttatataacagtgctttgaaaattcacgtgcagattcttactattttcccaaatgttacagctcaaaactatgttgtctgtaccttaacacctaaaggataatatagtctttcactgataaaactaaaatgtcataggttttcctttggccaaatatgtatagaaacttgtgatttcacatcagatttaaagctgtatttaacactctatgaaaacatactgatgcttagaagtagaaaggaagtcagattttgacatcttacttgtcaacttaaattatttatagttcctggatgcttcaaaatgtgataaaccatagttaattttatgtaaatattcgatgagtgcctttaataaggagactgtaaaggtagccaagctttatatatgttagctacatttatgggtcaatcgggtataaaaaataggacttcgaaaataaaatattattttgtcggactcctccaatgaggctttttcgcaggattagctaaaattggctcttatttgatgtgtgagtgcttaaacattggagaattcatttttcttttagaattcatttttatttctgagccttaaaatatgaacagttagctaaatgtttgtatatgttgataaggaatgctaagtgtttattccttaatgggacgacaccttttcccggtttacataacttgccttttaatctaaccttatgaaagtctccttgactttaattttttttcagagtactgtatatctctttagggaatgcatttatttaaaaaattataaagcaagaatagatgtgatatattttgaagttttctagtcacaaattaaatccctagatgtgttgtagtttgtggagcactttgaaatgtgccaattcaagatggaaatagcaggaaagaaccattcaagtacgatttctgactccataaagttaggaagttatgataaaggaaaaataactacaccacatacttatggcacagaattgcattattgggacaaattgatcttcaaatttgtaggctatgatggaagcaaatatttgtagtatcttaatattcaactgttaagccaggagacgagtactctgaacttcagcttctcataaaatcagtcagttacatgacagtttatgtagtttatatgtaagaaaccctttgatcaagatatgccttttcttcagccttgttaatacttcatttataaggatttttatttctaggaaaataataccatagacctattttatttaaagctaaagtgtttcctggtgatggtggtgaatggggagatgattcaaggaaactgctaatcttgtagagtttagtaaaatcttggaatagaaattttaaaaagttaaaacacactatgaaaacaaatcattattagtaaaatgaaccatattaaaatgtctccataaccaacgtattatagcaggggaaaatggcattttaattcagaaaaacatttctatataaaacaagctttggaataatttgaatatgttgatttttctttggggcaatcatgaaatacagtcatattaggaaagaggcaaggcctcaaaacggaaagagtagtgaggataattcatgagcaatgcgtggcttcatggatcccttcctggccctcttcatctatgaacatctgctttatgttcatgtctggcctcacccagtgctgaagagcagactgcccctgcttagaaccaagccttgttcttgtggatttgagttttggggtcctgaggtagaatggccatcatattgttcagggtcctcaccttcccactcattacttcctttatagaaccccagtcatccccctcaggaggcctgcgctccacaaatgaagttgggggtgaggggagctttagcatctcagtattgttcagatattggatacttgttgagctccactatgtgtgtgagaatgcgctgggctcaggatcaatagccataaatgagacagatatggcccatcccttgccatgcctaaactgatctgggcattgagacaagcagttaaaacccaacatagtaagtcctatgatgagacacaaactaagcatggctggaagggcagataagatttcacagaggaactgacatcttgactggcacacttagaagatgagtaggagtcagttgggccaagaggagaaaaagtgtgtttccatgaagaagaagagcatgtgccaagtcctgggggtgagaagcatggcatgtgtcaacagaaagacatgatcagagcttggatgggagttagagcggggagagaaggcaaggaaaaacataagagctttgcaaactgtgaaggcattgcatttagatgtcatttttagagcttggaggagcctcaggacattgaggcaggatagtggcctgatggcgtatgattttaggaaaaatcactgtggccaccctgtggggaaggattggcgggggaaggctggaggcaaagggtcctgcggtgggctgtggtaatgatctgggctggagaaggtatggtggtgcccagcgcaaaattggtttcgctttgaaaaataattagaaaatatttgttttgatctgtgtgcctgtggtgggaggtggggagggagggtcaagtgaggaaggagattgaatctagaataatgcccatgtttcaggcttcacgtgcagacatttcttggttcagctgggaagtgaataggaacagactggcgaggaaagaagacagtcgtcagttctgtctggggcacatccatcttgacgagtgtgagagagtcaagtcttgatggacaggggcaggtggacattcaggaaactcaggaaagagatttgatctgaagtgaccaccagaaaatactgacggaaaagaggtgacaaaaggagagacctgcaatattatattggctttctctcaggcaactgcttggcctgtctttatattccttttgaatctctgcatatgtacgggccattatttattttcacaactaacaaatgcagactttctgtgtaatgacaacaaagccaaaccagctgctaccaaaggagggaaaatcagaagagaaggaaaaagaacaagggaagcttggggaaaagctgaatgtgggtccttctgttgctgcaggggctggggtgggcccggtgattcctactgagaggcgttttctctccccgcttcctgtctttctggttccatctcattcacctcctgtcccctccacttcctgccagtcaaaccttagattcctccagaggctttttatttttatcttttgatgggcaagaaaatagtgcggattatttttccaaaccttcacctgaacatcacatcgtggctttggccctatgggcttggttcatccgggcctgcacagaaggacttttcgggccagtctggtcacatacatcgagtcctgtcttttcagttaaaaaaaaacacacacacacacactgctatgtttcactaagacaactggtgtgagttgttttttagaaaatcaactctacttcagtaagattttctcaagcattatcttgagaagaccagataataaaatttaaaaagaatttcttcttttttttttattatactttaagttttagggtacatgtgcacattgtgcaggttagttacatatgtatacatgtgccatgctggtgagctgcacccactaactcgtcatctagcattaggtatatctcccgatgctatcttaatgcaacttaaatcaattgctttaataacacatattgaccaagttacactcattaaggaaaaaaaactactttgttgtttttcttcttctgacgtgagctgaagacttagaaatagttgttaatagtgtttggttaataagaatttgttttaattgcatatatcaaatatgtatttattaaacttttctttttgtcagtttatcaattctagctttgtcacaaaaggtttgccgtatgaacatgattctgttgtacatctatttccatttttgttaagagacgaattcaattgtaaaaatctagtaccttttattcattaaacatgttagttcaggaatttcacttggttctacaaagatacatatctacagtggatggccagtgcaaacatgagactcagccaactggtctctgacccaattcagttctcctgtcttcttctggcttacaaagtaactggctctggggagaaagtgagtcaaagtaatatttggtttgaatggttattgactattttcttctgaaacttaatgtatactaattaattttttattttattcttttttttttagagatagggtctcgctctgttgtccatgctggagtgcagtggtgctatcacagctcactgcagccttgacctcctgggctcaagcgattctcctgtctcagcctcccgagtagctaggattacaggcatgtgccatcatgccaggctaatatttaattttttttttttgtagagacaagatattgttatgttgcccaggctggtctaaaactcctggtctcaaactatcctcccacctcagcttcctgaagtactggaattataggcatgagctgccacacctggccatatactcattttttgttaaaagctgaaatatatcagcatatactgcataaataccacaggagactaaacactgaaagtttctttagggtatcagaagaatacactttttgcttgcagttagcatctgcacagataagttttgtttctggttctattacttcttcagtttgaccctattaataaggacaattctaaaaataataactgtgtctggatatctgaatccgtgtgtggtcttttactgaagttacaggtttataactctgctgactagtttgctggtttctgttatgcaatagaagagtgcaaatgttaatttgatctgaagcccgtgtatacagtgacttttataatgtatatttaaagatggaaagccaagttttatgaggccagcatttcttgtcaagtcctcactccaccctcttctaattgggcctgacccttaagttgaataaagaacaaagagctctgtagttaaaacatttcactgcatgttgcatcttgcccttagtaaatggaaaaaaatagagacttaagcagagaatctgaactagggtgtgaaatatatattcagttttggggtgggagaatgagaaccatgttttacaatagtatacataacttccttagtctaaattcaggacatttccccaagatatgtaagaatttagacttatgcagacagactttataaaaacatgccaatatttattagtttgtgaattttaatattctgctccctataaaccagatttattttgagggataaagggatggaggtgacttctaaatcttagagcagaaacttcctgtgggcagctggacatatgtaccaggagctcagagaagagggttgtgttgggagcgtacattctgagtgatctgcatttggtgatgatggaagccatggacatgcactagattgtcttgtgggagaatatggagtagtaagagaagaagaagacctaggattgagccctgagcacctctggcttaatgttggatggaggaaattgaatctgtaaacaataccgggaggctgcagcctgagaggcagaaggaactggggtgtttgggattatggaagccaagggaaaaagcctgtctcacagcgggaagggaggtatcaacattgtaagctgcttcagataggttatgtaggatgtggactgaaaaatacctgtaaaatttggcaacgcgattcattggtaatcctagggaagttgcttttttggggtaactaaggtggaaaacagattggtgtgggttgagcaatgcaagagaggtgaagaaaaggagatttcatgtgcagacgtttctgagttcagctgggaacaagggataagatagaagatggaagttagagagcatgtggggcaagggagactcttttatgggacagtctcgcatgtgatcaaagccaatgagtaaggagcatttgagggagagagagtcaatcaacaagagagaaaagaaagagggttcatcataaaataacggtaacaacaacgaacatcttttgagtgttttctatatccggggaactatggtaaactcctaacctgcattctcacattcaattcttagaatcgttggatgtggtgggttccatgatttcctctagattagcgaggaggaaagagagatctagaaatgtcaggtagcttgctcagagttctccaggtagtcagtcatggactaatttgtgaactgaaggactgaacttcgtcaccacccagcccaccaagccggcttgactttaggtattctgtgctgcatgtgagtaccgacttaaattatattttaagaagggctactttgaaactctctctctgaaaactctatttctaaaagctctaccctcacaacaattttggcaagcagtcttggtaaaaccaaaccaaaccaaaccaaaaccaaaaaaccttatctgctgagaaaatataaccacataaaatatggtgctacaaaatatagactgtgtgaactgaaggtgacttgcccaaaggactcctgaagcaattggctgctgtagaaattaagtccacgggaggttttttgttctgtttttttttttttttttttgagatggattctcactctgttgcctaggctggagtgcagtggcgcaatctcggctcactgcaacctccgcctcccgggttcaagcgattctcctgcctcagcttcctgagtagctgggattacaggtgtacaccaccatacccaggttttttttgtatttttagtagagacggggtttcaccatgttggtcaggctggtcttgaactcctgacgtcgtgatccacctgcctcggcctcccaaagttctgggattacaggcatgagccaccgtgcccggcccatgagaggttttgtttgcacttcaagaaggacagaaaaaggcaggcaggctggggagcaacatagtaaggctgaggaagtgataggaaaacagcctccaaaaggtttccctgtagattctgactggctaagtttcctgaaataatattaattctgtcctcttgcttttaataggacataacgactatatgtgtccagccaccaaccagtgcaccattgataaaaacaggaggaagagctgccaggcctgccggctccgtaaatgctacgaagtgggaatgatgaaaggtggtaggtacatctctcccaggggcccttggggatggccctggccaccgcccagtgctggctctacccattggaataacaccatgggaattttgtgtttttttcttttaattgttttttttctattcttatttttctttgcaacaaaagtattttcataatccattttattttaaaaaggtggaagtgtctggaactggaaattctaacatggcattttgtgttttggattttcaatgtaaataattatattttaaatcaaaggtgtgtgggaggcggtgatggaaggaaacgaagagtgcttagtaaattattctagaaatatttttcagttactgtttatgttgcaaatgctagaaaatgatatctgaggataaactttccctaaattgagacttgtaaatgtgaaagctgagtagctaatttatagccttccagtctgttatcatcccttaaggaatgtgaatttcaatcaaaaggcagttttctcctttagaacctgagtgaaccagccactttcttaacctcagtgtctagcatggtgctggcatagttgattactgagcactacactaacaagtgtcagagcatgcatggtttgtgactgtgggtttgtgtttttgtggtctttgtggctgtgtgtgtgtgtggttttctgtcttctcatgtatccgatcttccagttttgtcatacaggaatctggaaactgaatcccagttctgggaatattaggagccccataaatgtggttgcctgattgacctcattgtattcttgggagtctcatcttgaggaacattgcttctagtcttggatagccttcagtgtagtggaagagaacaagtagaaaatgtgtaattaaaataaagtcatgaggctgaggtgggcagatcatctgaggtcaggagttcgagaccagcttggccaacaaggtgaaaccctgtctctattgaaaatacaaaaattagctgggtatggtggcgagtgccagtaggcccagctacttgggaggtggaggcaggagaatcacttgaacctggcaggtggagggggcagtgaactgagatggcgccactgcactccagcctgggtgatagagtgagactctgtctcaataaataaataaataaataaataaataaataaataaataaataaataaagtaacggattcatttagtgtttcagaaggatactgaagggagggaagggctgatgatggtgctacctgctgattgtaatagggaaaagcccgtttcttttctgaaggaggtgaagcttggggtgatttaaggagaacaaaatttcaatgaaaaggaatagtgattttgcaaatagtgggcagctaacctttaaatcattcttactgggacgcaggaggaaggagaggaaagaccaagaatggagattatgatgaagacaagcttgattgttaacaagcttacagtgacaggtttcatagtcccggggtcataaatacgccagacaggttgaggtttggaatgcagcatttggaataaattctcctggtgaagagatgcaatgttgaatttacgcattctgtgagctgtgactatgactatacatcttgaacatctgaaaaagcagctttaattcaaagggtaattaattccaagaatttaacagctacattcagaaaatgacacttgagtcatatggattaaatatttaaggaattcatctttctttgtactgttggagaattagtcaggcttaattaaacttacaaaatgcgtcttaaggtaacttggtaagtgacaggaatataacagctgcataagaaaagctttatttgaaacagtggagtcgaggtttaatattcttctttggcgattatatgtaggttaagcacaggctcttccatacattctccttgaaagctgaaataatcaagtcatgaatatgtccaaaacaatttttaaaatgtgaggggtacccatgcattgaccccatttcataaaaccgattctgtttttttttttgtaattaatatccagatacggtctggctgcatgaatataaattacgcattctcatttttaatctaacaaaaattcatatatgcaaagacataataaaagtctccccactgttttctcctaggaatctagataatttgactgtacacaacagactgtggatggctccatacacacttgcacatgtatattgatgactgtaaaatatatatctgtattagttttctagggctgccataatgaaataccacaggctgggtggcttaaacaacggaaattaattttctcccaattctggaagctggacatgcataatcaaagtgctggaatatttggtttctagtgagccctcccttttttttttttgagagatggagtcttgctctgttggccaggatggagtgcagtggcactatctcagctcactgaaaccttcacctcccaggttcaggcgattctcctgcttcaacttcccaagtagctgggactacaggtgtgtgccaccatacccagctaatttttgtgttttttttttttgtagagacggagtttcactctatgttggccaggctggtcttgaactcttgacctcaggtgatccgcccacctcggcttcctaaagtgctgggattataggcgtgagccaccatgcccggcctgtgaggcctctcttctaggcttgtggctagccgtcttctgcctgtgtcctcacatggcctttcctctgcgtccgagcactcttggtatctctttctcttctcacaagccctgttggattaggagtccacccttatgacctcatttaaccttagttaccgccaaaaaggccctatttccaaatatagtcataccaggggctagggcttcaacatacaagttttgtggggacacagttcataacaggctgccctcccaaaataccatagactgggtggcttaagtaacggaagtcaattgcctcatagctctggaggctgaagtctgagactaaggtgttggcaggtttgatttttcccgaggcctctctccttggcttgaagatggctgccttctctctgtgtccccacatggccttttctcggggcatccacagcttcttcttcttcttacgaagacaccagtcatatcggattagggccccacacacaggacctcattgaatcttaatcacctcacttaaggtacaatttccaaatacagtcacattctgaggcccagggggtaagatttcaacatatgagttttaagggtacacaattcagtatgtggcaatatcccataggggttactcagtgattgttcagtatttctttacatgtaaggaaaacatgtatctttctggcagtttttatatgtacataagttttaaatgaagctttaaattcataaaattatagcccgtgagaacatcttattttaatgatatgtataaagtacttgccataaatcaatataatttattgtattttctacaacatggaataccacacatggccacaggataccctctataacaactccttgaaaaatcccattgaataaagccttaatttacaactggaagtacaatgataactaactataaaatgtgcagtcacatggcaaaggccagctgtgactgaataaatctttacaacatgttttcaaccattagggttcacaacaatccactttcttaaccaggctggttaccaactaggatattgaaactctacctatgaaataaaaagtttagtttcagttaaaagagaaccacagacctactccctattttcatagcaaggctgaaaaaattcactgaagatctattgtaaagatccaaaagagtgcatgatttgtctccatgaactaacaattttaatctgttataatacttactgcctctgaaaatcccagcatcattattagatttggttctgaatcatggtagttctataagatgcaggatttgaattgcactttcgggaatgtgcttttctatcctagtacatgtgctggtttctctgcattgctttttcctcttcatttgtctccttcctcttgaactttaggttgtagattacatgtctcttcttcaggaaggcctacacagttacctgacagttcctgaggctcgaagttcaaaatcaaggtgctggaaaattcatgttctagctttaatggcaaacagctcttctcttagctcttatcaccattattattagtcattcaatgtctgtctttacatatggtccataaactccatgatggcgcgggggtggggggtctctgtgtcttgtttaccgatcttgcatgaaacaagtcacaaggtaggtgttcaagaagtatttttttgcactaattaatgaattgattcaattcatttaaatagttatttgtgtagggcttcttatatgcaaacccttgggaataaagcaaatatgaataagattgtagtcccttccctcaatgtcctcacagtataaagagaacatttgcatgggaagcggcaaataaaaatctcaacggcaagtggagactgggttgcaagatggctcaaatattgaatgatcagaatgggagtctagagctttaaacaaccactcccaggtttagtccaactcagagtattactcagacacctgacatccaagacatatattattactcaagaatgtggcctttttgctgagtttggtagaaagaggaactcttccaaagataaatgtgttcaaatgctggctcctcctcaaacttgctgaacaaccttgttaaagtcacttttatgagcttcactaatttcaaatatgaaatggagataaataaattttattgtccaagcacggtggcttacgcctgtaatcccagcactttgggaggctgaggtgggcggatcacctgaggtcaggagttcaagaccagcctggccaacaaggtgaaacctcgtctctacaaaattagccaggtgtgatggcagaagcctgtaatcccagctactcaggaggaggaggcaggagaatcacttgaacccagtaggcacaggttgcagtgagccgagattgcaccactgcattccagcctgggcaacagagtgagactctgtctcaaaaataaatatataaataaacaaataaataaattttacttaatgagtttgtcatgaagatgacaaatcgtaacatgggaaaatataaatctaaagtgccacacaagtgttagctattacatatcttttttgtcttaaaaataattactatcttagttaaaaatttcatcatatacgagcactgctgggttttttttttcagctgaaagaaagagaatggcaatttcatcacttctacaagatataaatttctaatttctttgtggagaataaaaacttggcttaaacacctaagcttttttttcttttctgatctcatatgctgaatatagctgaatgacaagtgagatgtgttatttatcattttatgatgccagagatttacacgaatttgtgaaaggttttttcttaccatagattcagaggcgtgtttgaggcaaggttttcattgtgcagtgaggaaattggcacatagaaatcaattgatgtgcaggactcttggactgactattctggttatgtttccttataacacattaagaagaaatttgagataaagtagtaattgtcaactagtctttatttattttaataacaaatgttgcagtataatttttagaaatattccaaaataacaaataaatccaaaaattaacgggataattttaaagtgagaaaataacatactactaatatagacagggaaatatacatgtgtccagaatgattcagaagcccaatgaaacactggaaaataaaatattttcctgttgcttgggtttaatatttatcactatgagttatcgtaatttgctttattgatggataaactcccaacctggggactgcgattggaatcctctttaatcctacattggctatcctttatcaaaagtaaacaaccggctggccatggtggctcacacctgtaatcccagcattttgggaggccgaggcgggtggatcacctgagatcaggagtttgagaccagcctgaccaacatggtataacctcgtctctactaaggatacaaaaattagctgggtgtagttgtgcccacctgtaatcccagctatttgggagcctgaggcaggagaattgcttgaactcaggagacggaggttgcagtaggccaaaatcacaccactgcactccagcctgggtgacggaatgagactccatctcaaaaaaaaaaaaaaaagtatacaaccaattattaatgttcatgatggtagaatcaaattaataaattaaaaatgtagatgtgaattactttttttggattgccgaataattgtggaagatttgtagctgcatgtgaatccaagtttcctcaaaaggtaggttggggtgctcctatttaggattgaatttaagaaaaatgttaaagaaaagctagctgctctttaccaaagagagactggttgttttaagcagtaatctaatctatatatttatgatattgaaactattattttattaattcatataatagatatttattaaaaactccccatattataattttttatttgcaaacaaatatactgaatcaagtaagtgaatcacatatggaccttaaagactaatgaatccaatgtttgacagtattttatatcaatcaagctctggtttccacaagcagaagcagatcgtcatctatgaaacagataaaagttgatttggcataccctctctttattcattatgatgttcatgagaaaccttcttagaaccctagggctccaaggaacacagtttgcaagccactgatctaatctaactccttcatcctctaggtatgaaaatcaaggccctccattacctattagggatgaaggcaggtcagcctctgtgactgtcagttcagctggaggaagcatgagtgtaggcagcacaacaatccctataaggaccatgttcttaagctggttttttttttcctagtagtttttacagtttcaggtctaacatttaagtctttaatccaggttgagttgatttttgtatacggcatgagataagtgtccaatttcattgttcggtgtgtagatatccagtttctctagaaacatttatcaaagaaactgtcctttctccattgtgtgcttttagcagctttgtcaaaaattaattggctctaaatgaatgaatttatttctgggttctctattctgttccattggtcaatacatgctgttttaattactatagctttatagtatattttgagtcaggtagtgttatgcctctagctttgttcttctagctccagattgttttggctattcagggtttttttgtggttccatacaaatttttggattgtttttccacttttgtaaaaaatgtcattgcaattttgataggcattgcattgaatctgtagattgatttgtgtcatatggatatttttaacaatattaattcttccagtctatgtatggtatatctttccatttatttgtgtcttcttcagtttcttttattgatgtctatagcttttagcatacaattctttcacttccttggttaaatttattcccaaatattttgttttatttttatagctattataaatgaaatttcttcttgatttctttttttggatagtttgctgttagtgtatagaaacactactgatttctgtatgttgattttctcttctgaaactttactgaatttgtttattagttctaatagttttttgtgtggagtctatacttacatgatctatgtgtaagatcatgtcatcagcaaacacgggcaatttaacttcttctttttcaatttgcatgcctttattttttttcttgcataattgctctggcaggaactctcagtactatgttgaatagaagtggtgagagtgggcatccttgtcttgttattgatcttaggggaagacttttcaaattttcaccattgagtatgatgttagctgtaggcttgtcatatatggcctttattgtgttgaggtacactctttctatatttaatttgttgagagtttttgatatgaaaggattttgaattttgtcaaatgcattttttcctctattgagatgattgtatggtttttgtccttcattctgttaatgtgtgtaccatagttatagatttgcatatgttgaaccatcgttgcatccctgggcaaatcccactcgatcatggtgaatgattctttttcatgtcatgacaatcaattttgctagtattttgttgtggatttttgcatctatattcatcagggatattggcatgacatttaattttcttgtaatacccttgtctggctttagtatcacagtaatgctggccttgtaaaatgagtttggaagtattccctcctcttcaatttttgggaagagtttgaggattggtattagttctttaaatatttggtagagttcagcaataaagcccattaggtcctgggcttttcttccatagaggactttttattgctgattcagtcttctttctagctattggtctggtcagactttctatttcttcatgattcagacttgctaggtttatgtgtctaagactttatccatttattccaagttatccaagttgttggtgtgtaattcatcatagtactcttataattttttgcatttctgtgctatcagttgtaatgtctcctcttttatttctgattcagtttatttgtgtcttctcactttttttcttagtctagttaaaggttaatcaattttgtttatctttttaaaaacaaattcgtagtttcactgatcttttgttttgtgtttttagtctcaattttatttatttttcctccgatctttattattttcttccttctactaacttggggcttagtttatttttatttttctagttatttgtggtataacattagattgtttgagatcttcttctttgatgaagacatttattgctataaacttccctcttgaaaatactcttgctgcatcccacaaattttggtatgttgtgtgtccattttcatttgtttcaagatatttttcaacttttctttttatttcttctttgacccactggttggttctgagtatgttgttttattttcaagtatttgtgaattttccaaaattattcttgttgatttatagtttcatattatttatggttggaaaaaatacttgatatggtgtcaatgttcttaaatttattaagacttattttgtgtcctaacatatgaactatactgttttttttctttttttttttttgagacagagtctcactgtgttgcccaggctggagtgcactggctcaatcttggttgactgcaacctccgcctcctgggttcaagctattctcatacctcagcctcccgagcagctgggaatacaggagcacaccgccatgcctggctaactttttgtattttttagtagagatggggtttcaccatttgggtcaggctgctctcaaactcctgacttcaaatgatctgcccaccttagcctcccaaagtgctgggattacaggagtgagccaccgtgccaggccatgatctatactgttttatctaacattcagtggataatgttccatgtgtatttgagaagaatgtgtgttctgttgctgttggatgaaatattctgtatgtatctgttaagtccatctgtgctaaagtatagtttaagtttgaactttcattattgattttctgtccgaataatctgtccattgctaaaagtggggtactgagttccccaatattattgtattacagtctatcttccctttcatatcaattaatatttgtttcattcatttaggtactccaatgttgggtgcatatgtatgttcacctgttatatcctcttaatgaattgaccctcttgtcattatttaatggccttctttgtcttattttatagtttgtgacttaaagcctattttatttgatataaatatagctgtctctgctttcttttggcttctattttcatagaatgccttttttggtcccttcgccttcattctctgtgttttcttaaccatgcattgaatctcttctagacatcatataacagggtcttgtttttttaaatccatttactcactgtatctctttcttcctatcttgctgtcttcctttgtgattaggcgattttctatagtggtatcctttgaattcttactttttgccttttgtatatttgctacaggattttgctttgtgattaccataaggcttacataaaagatcttatagttataccaggctatgttcaactgtttataacataactttgattaattttttaatactcaatttatttgattgcttatttagagataattttgattcctatcagaagaaaactgaggtatctttatgtaccttttcaggaatgaccacgtctcaccttaccttgaatgttacaagaaatgctggcagtgactcaaggccaggcaaaaatttcagaaagggtttatcttgtttgtacaattttcttttgcaaaaataaatgattcttgatatgatgtaaggactttttccgtagatagaacctataaaatgcagaactttggggcagtaattatatgaatgaattgctactttaaaattctgtaagtccccaggaatttccatatgcttttttttgtttgtttcagtggttgtgatcaggctaatgggtagtttttagagctgaaaagaacttaaagatcatctagtgcacctttttgtttttcagttggattgttcttgtccaaatcactaagctaagttaactgctcagacaggaaaccaagtctcctgacccatggtttaatgctcctttcattgttatgcgtctgcctggctgacctgttagtaacataaagtgtcatgagagatagacatatgcatgagtaagatattaatatcccataaaccaaaactgtgacttaggaaatgttacggtgggcacaggatattactcctcttcaacaaaaacatcaatcatatgttggcttagttgcacagcagaagtaccaaaataaatttatatagacggtgtcacagatactttaaaaagacctacttaagatttaattacctaatattatttaatatttaatataatttaaaaggggcatttttatctttcagccaaggttttaattgtttttagataattctatttttgaaagtctgattttgttttaaaatgcccattctggtatataaaaacatcattttgtcaaataggagtcccagctaagggccaagcgtgcaattaaacttgactctttacctactacctaggaaccttgggcagatcacatactttttcttcactcagtttttacttctgaaaaatgccagctgaagtatgtttcaaatcttaaattttatgttttatgatctaagttcagattaacaatggaatggttagaatccaaagctaaaggtagtatatacaagtgtatattgggggttgggagcaactgccgcagctatcatatttacatttcaagctcaatttagaacaactgcgggcaactgtaaaaaccggtaggaatgggcagagttattgtcttcactagtcattgtggaaagtgaatctcttctgaatggagagtcacaaaaatgagtttgatgctttcatgatagtgaaatgagaagatggccatatattgctataaatcaccagcaacataaaagaaaaaattcaaaaatcaagtttgttgaggcaggactctgaaaagataactaagcttttttttttttttttttctgttagagatgtaataatcatgactaagactggaatcccaagagctggtgagactttctagtttctgccttgtggaaagagaaaggaagaggccaaaaaagataatgaattttggaaagttcctgattaaatatcgcataggctagtctggttatgtctgcttgaaaacttatccagtaggtataaaccaacacacttgaggccagtctttttggaaattacagaaatatatgtcagccttaagagacatcctatgatgaagagcagagggagttgtttataaagaaatgttctcattggctgggcatgatggctcacgcctgtaatcccagcactttgggaggccgagctgggtggatcacttgagatcagaagttccagagcagcctggctaacatggtgaaaccccgtctctactaaaaatataaaaaaattagccgggcatggtggcgggcgcctgtagtcgcagctactcgggatactgaggcaggagaatggcgtgaacctgggaggcggagcttgcagtgagccaagatcgtgccactgcactccagactgggcgacagagcaagactctgtctcaaaaaaaaattagccaggcatggcggggagcgcctgtaatcccagctactcaggaggctgaggcagggaaattgcttgaacccaggaggtggaggttacagtgagttaagatggcaccattgcactccagcctgggtaacagagctagactccatctcaaaaaaagaaaagaaatgttctggtcatgcctggagataatacatggtttagtttatgcttgattcagcaaataaaaattggtgaggaacatacagaattatatttaggtgattatattttttatattttatatataaaatttatattttttatattttaggtgattatatttttaaacgcttgctttacaagactaatcattattacttttttaagttttgtgatatattttatttaactaatataccccaaatagtatttcaatacagaatcaacatttaaaaattattgatacattatgtatgtttttttccttcactaagacttccaaatcctccaagtgtttcacacttacatcttattttggaccagccagattttagtgctcatttgaccatgtgatctgtgcttaaggaggctgctggagctgaggctgggctgcagtaccaacatagaagtctttatctgtcaaaccaggagtttgagatccctgagggatatgggaaccataaaggatcttaagcagagaagtgactttcttaattttgaacctatcctggtgttctcatagattagaggagagagatttaggagtgagggatcaagcaagaaggtggctccacattgttttccatagtagttgtactagtttacattcccaccagcagtatagaaatgttcgcttttcactacatccacaccaacgtctattattttttgattttttgaaaatggccattcttgtgggagtaaggtggtattgcattgtggttttgagttgcatttccctgatctttggtgatgttgagtattttttcatatgtttgttggccactttgtatcttcttttgagaactgtctattcatgtccttagcccactttttgatgggattgtttgttttttttcttgctaatttgtttgagttccttgtagattctggatcttaatcctttgttagatgtatagattatgtctccttctctgtgggttgtttgtttactctgctgctgctccttttgtgcaaaagctctttagtttaactaagtcccacttatttatctttgtttttgttgcatttgcttttgggtttttggtcataaaatccttgcctaagcccatgtctagaagggtttttctgacgttaacttctagaattttatggttccaggtcttagatttaagtccttgatccatcttgagttgatttttgtgtaaagtgagagatgaagatccagttgcattctcctacatgtggtttggcaattatcccagtaccatttgttgaatagggtgtcctttccccactttatgtttttgttggctttggcaaagagcagttggctgtaagtatttgggtttatttctcggttctctactctgttcctttggtctacatgcctatttttataccagtaccatgctgtttcggtgactatggccttatagtatagtttgaaatcaggtaatgtgatgcctccagatttgttctttttgcttagtcttactttggctatgtgggctcttttttggttccatattaattttaggattttttttctagttctgtgaagaatgatggtggtattttgatgggaattgcattgaagttgtagattgcttttggcagtatgatcattttcacaatattgattctactcatccatgagcatgagatgtgtttccatttgtttgtgtcatctatgatttatttctttgagaggtgttttgtagttttctttgtagaggtccttcaccttcttggttagtttttgttttttttggtttttttttttttttgcaactattgtgaaaaggagtgagttcttgatttgattctcaccttggttgctgctgttggtgtatagcagagctactgatttgtgtacattaattttgtatcctgaaactctgctgaattcattaatcagttctaggagctttttgggggagtctttagggttttctagttataaaatcatatcatcagcaaacagcgacagtttgaattcctctttactaatttggatgtcctttatttctttctcttgtctgctccggctaggacttctggtactgtgttgaatagtgagagtgggcatctttgttttgttccagttctcagaggaaatgctttcaacttttccccattcagtattatgttggctgtgggtttatcatagatgccttttattacagtgaggtaccttgtataccgattttgctgaaggttttaatcataaagggatgctggattttgtcaaatgctttttctgtatctattgcgattattgcgatggtcatgcgatttttgtttttaattttgttcaggtggtgtgtcacatttattgacttgcatatgttaaaccatccctgcatccctggtatgaaacccacttgatcattgtggattatctttttgatatgctgtttgatttggttagctagtatttcgttaaggatatttttttgagatggagttttgctcttgttgcccaggctggagtgtagtggcactgcaacttccactttctggtttccagcgattctcctgcctcagctccctgagtcgctaggattacaggcacctgccaccacacccagctaatttttgtatttttagtagagatagggtttcgctatgttggccaggcgggtcttgaactcctgacctcgtgatccacctgccttggcctctcaaaggactctcaaagtgttgggattacaggcgtgagccacagcgcccggccagatttttgcatctatgttcattaggaatattggcctgtaggtttctttttttgttttgttctttcttggttttggtacaagggtgatactggcttcatcgaatgatttagggaggattccctctttcttcatcttgtggaatagtgtcaataggattggtaccaattcttctttgagtgtctggtagaattcagctgtgaattcatctggtcctggactttttgtgttgttggtaatttttaaattaccatttcaatcttgctgcttgttattggcctgttcaggatttctaattcttcctgacttaagctaggaggtttgtatctttccaggaatttacctatctcttctaggttttctagtttatgtgtgtaaaggtgttcatagtagccttgaatgatcttttgtatttctgtggggttggttgtaatatctcctgtttgtttctaattgagcttatttggaccttctctcttcttttcttggttaatcttgctaatggtctatcaatttcatttatcttttcaaataaccagcttctttttgtttcatttatcttttgtatttttttttcaatttcctttagctctgctctgatcttggtattttctttcttctgctggctttgggtttcgtttgtttttatttctgtagttccttgatttgtgaccttagattgtctatttgtgctctttcagagtttttgagtaggcatttaaggctgtgaactttcctcttcgcattgcttttgctgtatcccagaggtttggatggttgtgtcactattattgttcaattcgaagaattttaaaattttcatcttgatttcattgttgacccaatgatcattcaggagcaggttatttcacttccatgtatttgcatgttttggaaggttccttttggagtcgatttccagttttattccactgtggactgagagagtagttgacatagttttaattttcttagtttttttgacacttgtttgtggcatatcatatggtctatcctagagaaagttgcatacgctgatgaatagaatgtatattctgtggttgttgggtagaatgttatgtaaagatctgttaagtccatttgttccagggtacaatttaaatccattgtttctttgttgactttctgtcttgatgacctgtctagtattgtcagtggagtattgaagtcccccactattattgtattgctgtctgtctcattacttaggtgtagtagtaattgttctatacatttgggagttccagtgttaggtgcatatatatttaggattatggtattttccttttggacaaggccttttatcattatataatgctcttctttgtcttttttaactgctgttgttttaaagtttgttttgtctgatataagaatagctactcctacttgcttttggtgtccatttgcatggaatgtctttttccacacccttaccttaagtttatgtgagtccttatgtgttaggtgagtttcttgaaggcagcagatacttggttggtgattgcttatccattctgcaattctgtatcttttaagtggagcatttaggctatttaaattcaatgttagtattgagatgtgaggtactattctgttcatcatgccatttgttgcctgtataccttggattttttttagtagtatttttgttttatacctccaatgagatttacacattaaggaggttctgttttgatgtgtttccagcatttgtttcaagatttggagctccttttagcagttcgtgtagtcatgtagtgctggcttggtagtggcgaattctcttagcgttgtttttatctgaaaaagactgtatctgtccttcatttaagaagcttagttttgctggatacaaaattcttggctgctaattgttttctttaaagaagctgaagatagggccccaatcccttctagtttatagggtttctgctgagaaatctgttaacttgatgggttttcctttataggttacctggtgcttttgcctcacagctcttaagattatttttcttatcttaactttagataaccttatgacaatgtgcctaggcaatgatctttttgtgatgaatttttcaggtgttatttgagcttcttgtatttggatgtctaggtctctaataaggctaaggaagttttcctcaattatccccccagatatgttttccaaacttttagatttctcttctttctcaggaacaccaattattcttaggtttggttgtttaattctgtcccaaacttcttggaggttttgttcatttttttttttttttcttttcttttttttttttaattgatcattcttgggtgtttctcgcagagggggatttggcaggatcacaggacaatagtggagggaaggtcagcagataaacaagtgcacaaaggtctctggttttcctaggcagaggaccctgcggccttctgcagtttttgtgtccctgggtacttgagattagggagtggtgatgactcttaacgagcatgctgccttcaagcatctgtttaacaaagcacatcttgcaccgcccttaatccattcaaccctgagtggatacaccacatgtttcagagagcacagggttgggggtaaggtcacagatcaacaggatcccaaggcagaagaatttttcttagtacagaacaaaatgaaaagtctcccacgtctacctctttctacacagacacggcaaccatccgatttctcaatcttttccccacctttcccccctttctattccacaaaactgccattgtcatcatggcccgttctcaatgagctgttgggcacacctcccagacggggtggtggccgggcagagcggctcctcacttcccagtaggggcggccgggcagaggcgcccctcacctcccggacggggcggctggccgggcggggggctgaacccccacctccctcccggacggggcggctggccgggtggggggctgacccccccacctccctcccggacggggcggctggccgggcggggggctgacccccccgcctccctcccggacggggcggctggccgggcagaggggctcctcacttcccagtaggggcagctgggcagaggcgcccctcacctcccggactgggcagctggccaggcggggggctgaacccccacctccctcccggacggggcggctggccgggcggggggctgacccccccacctccctcccggacggggcggctggccaggcggggggctgacccccccacctccttcccggacggggcggctggccgggcagaggggctcctcacttcccagtaggggcggctgggcagaggcgcccctcacctcccggactgggcagctggccaggcggggggctgacccccccacctccctcccggacggggcggctggccgggcggggggctgacccccccacctccctcccggacggggcggctggccgggcggggagctgacccccccacctccctcccggacggggtggctgccgggcggagacgctcctcacttcccagacggggtggctgccgggctgaggggctcctcacttctcagacagggcggttgccaggcagagggtctcctcacttctcagacggggcggcccggcagagacgctcctcacatcccagacggggcggcagggcagaggcgctccccacatctcagacgatgggcggcagggcagagacgctcctcacttcctagatgggatggcggccgggaagaggcgctcctcacttcctagatgggatggcggctgggcagagacactcctcactttccagactgggcagccaggcagaggggctcctcacatcccagacgatggcggccaggcagagacgctcctcacttcccagacggggtggccccgggcagaggctgcaatctcggcactttgggaggccaaggcaggctgctgggaggtggaggttgtagcgagctgagatcacgccactgcactccagcctgggcaccattgagcactgagtgcggttttgttcattttttaaattcttttttctttgtctttgttggattgagttaatttgaaaaccttgtctttgagctctgaagttctttcttatgcttgttttattctattgctgagactttcaagaacattttgcatttctctaagtgtgtccttcatttcctgaagttgtgattgttttttatttatactaactatttcactgaagatttctcccctcatttcttgtatcatttttttgacttccttaaattggacttcacctttctctggtgcctccttaattagcttaacaatcgaccttctgaattctttttcaggtgactcagggatttcttcttggcttggatccattgctggtgagctagtgtgattttttgaggggtattaaagaaccttgttttgtcgtattactgggattgtttttctggttccttctcatttggtaggctatgtctgagggaagtactagggctcaaggctgctgttcagattcttttgtcccacaggttgttttcttgatgtagtactctcccccttttcttagagatgtggcttcctgggaaccgacctgtagtgactgttatttctcttctggatctagccattcagcagggctaccaggctccaggctagtactgggggctgtctgctcagagtcctgtgctatgggctgttttcaggtctcacagcgttggattccagcacctgctctgatagaggtggcaggggagtgaaatggactctgcaggggtccttagcttttgttgtttaatgcactatttttgtgctggttggcctcctgccaggaggtggcactttcaagacagcgtcagctgtggtagtatagggaggatcaggcagtggccagggccttagaactcccaagagtatatgacctttgccttcagctaccaggatggatagggaatgaccatcaggtggggcaaggctaggactgtctgagctcagactctcctcgggtgagtcttgctgaggctgtgctgtggggcaggggggtgaggttcccaggtcaatggagttatgttcccagaggattatggctgcctctgctgcgtcatgcaggctgtcaggaatgtgggggaaagccggcagttacaggcctcacccagctcccttgcaacccccaaaaccggtctcactcctgtgccctaccaacagcatcaagtttgtttgcaggcagcggatgagcaaggctaagaacttgccgcaggctaccagcctcccagcaaagaatgtaagtagggctttcatgcctcccttcctgttgaatctgtacaccaaattcactccctcccccaagttctggccaggtgacttcatgtttggttggaattgttacaaagttcagctggaggtttccttctcgctgtggtcttttcccagttcctctggccaccctccccaaggacccctgtgagacaaggtagaaatggcttattaggggacccagagagcccacagggcttttccccttgctttctctaccctttatttcactcagctgtctaattaaatcagctccaggtaagttcatatccttctcccatgatctggagctgcagattccccagtgagggtgtgtgttcgggggtgggctatccccctttcctactttcacagcttgggcactcacagtatttggggtgtctcctgggtcctgtaggagcaaactgcttccttcacagggtctgtggattctcttggctttcctggtatattcctgtagtagttctggagcagaagtttatggtgtgagtttccacacactgctctgttcatccaagtgagagctgcaatctagtcctgcctcctttccaccattttttggccttgacgtattacatttattttatgtttgaagttttggcagttttattttgaaaattttacataacaaatgccaagccaaatccaaacttcttggcctaaatcatttacagataacctttactgagcatttactacatgaaggtgttgttgacacaggggatttaagatgtgatcactgaccacaacatccaggcaacctaaaagtgaaaagaggtcattcacaaaaaataggaccaaacttcctccattcctcaagggacctaggactggagttggcctaaaaattcctgctgtatcacctcacccaccagttttgatcttgctctcagggatcaaggaagctcaaggtttctggcccttttggctcatgttcttggaggtatattctattgtcaagttaaagtcgtacccatcctagatctgtttctctctctttgtggttccagtctcatagaaaacataactatgtgaaaacaccaactaccccataaagctattctgagactcaaagacatgaactctattttgataatcacaaattgatgtatagatgtcagatatcattcatgtattatgtagcattgtggtttaagtcttagctgttggaatcagactacttgcattcaaattttagctctgttgataggtgtgtaaccttgaacaagatacgtaacctcttcagacctttgtctctttgtttgtcaaataacgacaataataatactaacttagtaagtatgtataaggaggcatgtaaagcttctattgtatttggcttatggtgagcccttcatataaattggttacaatgggtaatgaaaagtacgttcaatttttcccacaaggatttaatctaatctctaaataaaatgccagttttagtatactgtcatcattataaggaaactataattcttaagtaattaattactttggttccctttggataattagtgatacataaaatgcagtaccttgccctgaggaacctacaagttagcctccctctaatcctggcattcaaagtcctccaccttccgaattacacctgttttttcaggcattgtctcccactttcctagcaagcctttggctccaggaaactgttctgttcattgacgacagaatgtattttgtcccgtatgcctcccttcaatctgaagttcatttttagtaattttttttattagtagtgactttccccatttactaatgcctttctctttagctcatttagaattccctggaagtcatcatgttttccttctgaattgctatcatattctgtctctgtgtctaatcagaaagttaggtgagctgctgtctcagctcctgtgttaatccaggtactgagctctttgtaccctgccagcttgagggcaacttggatgcgctggtgtgtagtgatttgcaactgtgagagagccgtttccatcaacaagtgacagcttttggttctaaacactgcttgacctcattctggtttgaacatatactttggcctctgccctctacctcacctccagttctgatcttgggcatgccacagaaccccatctacactaggctttcattttggacttctaagtcctttacttgaccacttattttctttaattgctagacttaatcatccatgcatatgacagccactcagctctgaccccaatacttcattgaggctcatgccagtctgacctctcacagggaagagcacccctgccggtgagcccctggcccttggattatgctgtcccaccagtgcccagctggctgcttggcactgcatgtgatgtatctttgtttattgatcgcttaattgaatgggatataggattatattccatgttccagatcaagttgagccaagctgacaacttagtattaaaaaaatatatttatctcctatctgtccaattaaaattttaatttctagaggtagagacagtcacattgctatttaattcctagcacagcagtatttttgtcaatatttgttattagtggtgagtttaaattataaaggaaaaaagagaagtggtgatttatgtcagcgcttggctaaactattcccttgatataagtctattattcaggtcacataagcatgactgaagtaatatcacaaccataatatcataattatctctcttgctgtctctgtcactttctcacttttgtttgtgcatagtgcatagacctgtagaaaatttattagtaatctgaagcataaaaccaaatattacaactatcataacaaataaataaaactgtgcactcctttagggagtagtaaagccatttctaaaattaagtcaaagtaagattcccttattattgagatattttagtggtatacactatcataagtaagatgaataattttgttagcagctgacactgctatatagatatttatcttgggaagttctcagtgtaacatctttactgtgtttttctctttagattatacttttatgtttattattttgtttcgtgggggattcaaaaatatgcattttatgccatacttggggattccctataaattattagttgtaatatgacagttccatcatgaattttccaggtattcttttatgcaagcagataatagctcattttggtttttaacacattcatgcatattctttctctctcaataaatatggttttaatttattaaatgaaagatttaaaaatgtgctaagcattttaataataatcgattttggattaacttgttatgtttactctagggctgtagttcaccatttattcagttaagtccttccccaaattcaatattgaacatgtggaattgattcgtttcacgtggatgtatcatttactcccaagatgttggtttttggcatttagtactggtaatgggccaggaaagtgctcatctatatttgttgttattcactgattgcatcttgcccttgcacccactgagacgatgggaaagtagcaacaatactaggtgatttctttgatttaaacccaattaaaagaattagagagttgtctgatacaaggccaaagaactaagaacagaaacaaaagcaaaacaacaaacagcagcacaaactccagtgagataaatttttaaaacattgggaatatttaaaaaataaaaacactccaatgaaccacccaggttttattaaagagtagagaactcaaacagcagaaggcagagctggtggaggaaactcagcaactgctcagaaatgaaacaacctaggaaggaggtgcgagtgacctgaaactccttttaaaaacagaaaggacaaaaagaggtatgggctgacaaaaggaaagtggtagattactgatgtattgcattatgcttagaatgtctcagaatgcgagaggcagtaaacacaccagaagaggatacaatatccggaccatgtgcaactgcaaataaatgtttgggttaaaacttggttgattctaaattacatgaagagctgatgataattgaggcagaactgatagacctaacaatagaaaaaaatcgatttaaattcagagaagaggtcatttaagaaagtataatgaagccacttaataaaaggaaatattcctctaactaaagtttgagatttagggcataatcctcaaagacaggctaatataatctattttttgattaaaaaaaggaacttttggtttaaagtaagatgttcagctgctcttagagtttatttctccatatttgggcatataagaatttaaggaaaaatatagaaatataagaaagatttcatgagaatcacaagcatagtttataggcaagatagccttttctgtttgaaagcgaaaaatactatttcaacatgtaaaaacctaagtcagttttcactggcatgtcccacaatcatgcctgaaataatggttgaagacagatgtgagacatttcaagggcaatagattaatacatgaaacccacttatgcctagcgttccattattggaacgctaagcatgtgggagttatttatatcctattgctcaaggtcatctccaaggtctgagttttcactcatgcaaaaattcaaaaaattgcaacctcggcgtaaatgggttaacaaaaagttaatgctggacagtaaaataaactactaaattagacacaccatattttttaaattataagagattaagaactatgagatatttaaaaagccacccacagaagtagtaggacaggtagagaaggataaattctaacaatcaactgtatctccaccccaccttgtaaatgacaaattagtttacttagtcaattcaggaaattaaacgtatacattttgtgttaaaacagaagactttttttaaaaaagtgtgttagttaaggttaattttgacctagttaagaaaaagcagtttagagtcttgaaatggaaatgagaaatacataattacccttaaaaataagttgatagtgaattttatctaggattcttaagacatttttaatatttaatgaaaatgaactacacaattattaaaaaatagttgcctgggtttagaaaaatgatcccttaataagacatatacaacagcctgaatttttatttccaaatactatagcaacaaaataccggcaagaaaaatgcacagaaacattggatagtctcttcttactaatcttttacagatatttatatattctgaattctaacttttaatttattttatgtattataaatgtcatctagtatgcagcttgactttgctttatggtatcatctgtttcacagaaaattttaagttgtggaatttatcgtattttttctttatagtttgtgctttaagacctgtctaataaatctttccttccctggacgctataaagttatttgtctatattctgttaaaaggaataaaactttgctttttttcacattttgttacttatttcacctgaaagagaattttgtttattatgtgaggtaggaatataacttaatttttttccattgaataaccaaattgtcccagagcaattaagcaatacattctttccctgttgatctgtgaagctacctccattaggcatgaagttgtcctgttgaagagaatctgattctgagctctcttcactatttctttatttgtctatgtctacactaaaagcaatttaatttctgtgtctttataattactttgactttataatccttgaaagggactttgttcttcttcaaaattgttttggctatttatggctacttttgctttcaaatgagtttttaaatcaaactttaatgagattgcattaaacttataaattaatctgaggaggattgacatcttcatgatatttagtcttcctacccattaacattatataactctccatttattttaggtctttttgaatgacttctaataaagtttttcaattttctccaaaatatcttacatattaaaatttactcatagctgtctcatcttactgatattttaaagacatatctttttaaaaattatattattaaattgtttcaggtatgtctttttttttgaagttttacaaatttgggattatactgcctcttcattcaacattttcccatgctgttggggatccttcaagtcaaaattattagaggagctgcattaatattccagcatggacatactataatttatttaattatttcccgaattgtatgtttttgtttctaacttcacagttttcaacatgactgggaacagcttttcttgctaaatccttgcacgccacagtaattatctcactgggccaaaagataggtactttttcatgactttcgccatatattgtcaaaatggaaccaatggtgatttgttcagaaatcatggtacatcatataaaaagattactctgcaagcatcacaaactgtgatatatagaaatgtgtttattgacatgaaatagatcatgaagaaagtgattacaaatggtatttaagcattttaagttatataggcttatactgagcaataacaaagagggtgaataaatgaatgaatatgtgattctggaagggtatgtaacaaaaggttaacaatggttagccctgggtaaggggattatgtatgacttttatttccttctttttttcttcctttccccttatgtttttaacaatgtacatgaatcgtttatgaataaaataaaaaactttgatattcttatataggtttagtaggataacatttctccttcatttctttcatttttagaaatctttcttcacggaaattcttttttttaaatgtttatttctgtctttgaggagtgagattgactggctatcttttaatacctgtgtgtattatcattattgtatcttgctgataaatttcacaacagttaattattttattccccatttcatacttagctctattttaggcaagttcacaaatatcattgaatgagttcattcaatgtcatcatgatgatattgaaatgtcaatagcagatgacttgtttctggggtgttaatatgcctgttggttacatttgtgttttttggtgatggaaggcagccactgaggcaaacagcaagaatacagctaagcctctaactgcatactcttctcactcgttgcttaaaactgaagcgtggataattggtgtgcattccctaaaaagttatgtcatgatgcagtagagaaataagttaactttcctatccctgtatcaaagtttcttttgaaggtaactgagacagcgccaaataaggagcagagtttctgtgaatcatgaaatctttctaaacaattgagaaaaaaaaaactgttctgaaacaaaaacttgtgccctatccttttatttgaatgtgttttcttaaggccacaactggcagagatttgatgattttatgtttaaagcaattttttttttttttcatagcaaggagtcccactgccatcaggttttgtttttggagagattctgtaactgacatagggtaacttactctgatggcttgctccacattcactacaagtacatactgttctgaaaaatctcaaagttgaaatatttttatttgggcaacttctgcaatcaaggtaattcactctatctttggagaataaaatggaaaagggcaacccaatctctgtgaccttaaacttccactgaaacttagagacggttagcttagctggtgagagcgtgctgctaataacaccaaggtcgtggtttctatcccattacagggcagtcaagctcaagggaaaaaccctgttctttggcacagcttccatggcctgctagccgtttacagcgaggcaaaagagtagagatgttttagtgaactaggccatgacttggggagtctccaccttgaatctggttgtgggaccaaggaagagaatctgctgaggctgggtagagagactctagagcaccttaggccacaggacagcagaggatgagaataacagaactggcttcagaaagtaggtgtcagtccaaggcactgtattcaatacatgtagcaaagaatgagcttctgacaccaggaaagtcttcagatggcagtgactgcataaaccggtgtcaggatgtctgactataaaggatgggacaccttccatcaggtgagagctctggaggtggagtctgttcctggaagaagcatgggtaaatgtcatcaaaggttccctcagccaccactgggttcagggctgaggtgcacctaggaaggcttgggcagaagcatgacccctggaacttggccaactgagccatcagagagtggtgcaggtgaggagtggtagatgtgtagtgaaccactcagctgtctgcccaggccttgggtgtggaagtagagtcttctgtgtctttgggcagactgaattataagcttcaccagatcgccaagctaggaatgttgacatacctggcttggggtcagggagggactgaactgtaggtggggggccccaacaaatctaatcataagaatctatgagcgtggagacagaaggaccaaagaagggatgctgtaaccaattatcattattgaaaaactaggcagagattacattcaattggcagtaccaccctttttatctctgacatagttccagaaggatatactatgtatctagtgtgacactgtctgatagaattgtctgaaatgatggaagtgttctgtggctacccattttgatagccactagccacaggtggctattgagcacttgatatgttgttggtgtgactgaggaactaaatttttaattcaatttaaattaaatttaatttaaatttaagtagcaacatgtggctggtggttactggattgaaccgaacagatctagatactagagtaagtggtagcagcaaatcctatattggaacaatgtaaattaacaattataaatatatgagcaggacaaagcccaaatgggcctgtactcttagttttgctatatattcaaccataactagcactcattttttaaacttataaaatgcaaactcatttggttgtgatgatgaatgctcaggtaattgttgagtttcaacacagtgacagccaggaactcattttggagacttggattgtgccacagtttgtccctctataaaatgatgatgaaaattttatcagtatctgtctcaagctgtagttaatgggccaatttctaaatattcctgtcaaattgtatagccattgttttcaaagtagttttgaaagtaggccattggtaaagcaatctattaaagtgcaggaagaaagtaatagaatctcttactttttaaagtctcattatgaaaattatatttcagtttgtatgccttcgatgtacataatatattaatacacaaatatattaatgcagcggtccccaaactttttctcaccagggactggtttcctggacgacagtatttccatggattgcagcggggatggtttcaggatgaaactgacccacctcagatcatcaggcattattaggttctcataaggagcacacagccttgagcaggtgcagttcacatatagggtttgcgcacctatgagaatctaatgctgccgctgatctgacaggaaatggggctcaggcagtaatgctcgctcactgctcacctcctgctgtgtggcccagttcctaacaggccatgaactggtaccagtctgtggcctgggggctggggagtcctgcattaatgtaattaaatatgtacatttcttgagagtgtttgttcaaatattttttcctaatagagacgtataacttagaaagtatggaaccctctggtcagtagcatattttatcaaaaaggctatccgtcgtgctaaccaatgtgattaaatgttcattttagtctcagatattttgataacataataatagggaagttatggttattgcatggcttttctttactgtattttcaataactatattaatgggttcagttgttactagttttataattctgttttattctcaatgagtcttcctgtttctccccacgtctttcctatggttcatttccctgcatctttacagctccctggaacattctctcaaatcaatcagaggcttcaaaactgggcagtctcattttgtaacctgctctgactcgcctctgggaggcctccctccccactcacagctgccttcctgcatgatgtaaaatgaatacagtgccagaaagactgatccttggaacctcttccttacttagtttctttatagttctgattttagaaatgaccattttacttccagtgcccttccccacaccagttagctgagactctatgcaggaagttcccagtgatcagaactgttcccatagctcccaggtgattctgacatgcacccggcattgagcaccatggacatggctgctgtttgttatcctcgagctctgcaaagcagtgtcggatattgcttgattgttgcacattaatctactgcacggtccggtaggtagccactagccacatgtggccatttagatgtaaatgaatttaaattaaatagtattataagttcaacacctcagttgcactctctgtattcaagtgctcagtagctacaagtggttggtggctaccattttgggcagtgctactatacaacatttctatcaccacagagagtgctgatgaataatagtactaacaactggaaacattgaaatggagaggtgaaggagagaaggcagaatataagagaaacttcaaagcattcagcgtgtctgataggcgctgtatcttacattatgtttggagcatagtttttgaatttcttaattttcaaattcggttgaaacagattttggtcaattgaagtgaaggactatgcctgctttaatttgcgtagcttacctttgtttcacgtgtctcccttattacagtgtttgtagcagcatctaactcaatccctaacttctttttggtgcagggaccatttaaaaacaatttgatcatagaggttatctcctttgcaatccatattgttttatggaacaggtgaacagctggtgacaatagcctcaaggtttctaatcccaccaaaggaaaatatggtgtcagtaattaccttgtactatgatatttgtgaaatccaagagagggctagatctcaggctctaataatacatccgtataaacatctcagtagggcaccacggaagagtcttaggatatcaggaacaataagagcgggagaatatcgaccttaatattctttacacttattaaaaagtgaaaagacagccataaagcagaatgagttcctgtcctttgcagggacatggatgaagccagaagccatcattctcagcaaactaacacaggaacagaaaaccaaacacctcatgttcgcactcataagtgggagttgaacaatgagaacacatggacacagggagtggagcatcacacaacggggcctgtcgggagttgggggactaggggagggagagcattaggacaaatacctaatgcatgtggggcttaaaacctagatgacgggttgataggtgtagcaaaccaccatggcacatgtatacctatgtaacaaacctgcacgttctgcacatatatcccagaactaaaagtaaaataaatgaaaaagaaataaaaaataataaaataaaataaaataaatgaaaagtagccattttaccagttgagtatttactgacttttggtgaaaatcactttctaagattactagaaaccttatgaccctcggcctctactcccaccacgtgcggattttcacctccacctactttgtcacgtcacatgcccttctgctctttaggacacttgtattgggttcctcccccacacgtaaacagaacacacaggtctgtgaatggacctcattatgctcatttgtctttgccaagaactattgaaaatgatcacaaatgactatgtaattataattaagattttgtacatgcatacactttatttttaacaagtttgtcctgttaaatgtcaccccattttgaatagtaacattcactggtgcaaggaagaattattaaaatgacaatttaactgatatccttgacaggtaagccagttattgtatttcataattgtgattattacaatacctatgaagattaattaggacaatttattctataggacttggttatcaaaatgatcttttttcccattttagtccatacatcttcagttttaatttccttcttccaaagaactctgagtcttgcccagtgtgatacttcagattttgtaaaaatataatgaagaagaataacatgtatcagatcttttttttaatgtactgggctaaaaattataagcaccatcaaattactagaaaattcttttaacactctgcttcttagttaaaaaatgattcctttttgtgataatcttataattttcaaagtatcattttagaaattttaaaaaattattcttgttttcattcagtccatttcatcagaacttagattttttcttccctctacagtatgtggtcttgatgtgctttctccttgcaaaataaaatctttagtttcaggatctctgtgttctattccttcaatttaaaatcataggaaaaataactatcatttccttatgtctgtctccaattcccccatcattttctgtgagccaattttcttctttttcttctgtctactgtaaggaactttttactctgctctattctctgcaattcagggctcacaatttctttgacttctcagattatcctttgtacttgtgtctactttttcattaaaaaaaaaaaggcttcggtcttattttgactttatcatctttatattgccatatttaaaacccatctgcttattgattgaaccaaacttttcatcttacttcatcatactgaatgtataacttctgaatgacttaaaaatcatcacataatgtgagagaattttctatcatattcaggtgactgcattgtaagcaatgaagttgaagaaaaatagcttataatggatataataccaagaaataataagaatgagaatctgcgtatatcatatactgggttaacaagctcacaaggcaaatcaccattttattagatatttaacaaatcatactagtactggaggaagtatagcagaaaaaaggagtatggacattgggattagctgccttgctaatcttttgtcagtccctagtgacatgcttttgggttgagtcattgttacctccctgagctgtttgtttataaaatgggggtaaatatctcagatgtttcagtgttgtgacatataaagcgtcctccatagtacataataccgtaagcactccataaggtaattcttgtccttttaaaaagtatacacttttgagttcaggacacgtacactgtaacctagttgtaaccattttaataaaagaaggttttgatcatttttgataaatgtactacatgaatagttaacttgcctttcacttcctataccaacggaaattttggtaacaaatttaaagaaagcattaggttgaatatcccatctgattaaatgtcaactaaatattgtttctggcttttaaaatatttctaattcagttataaaacaggtctattactcaggaggctgaggcaggaaaattgcttgaaccagggagtcggaggttgcagtgagccgagatcatgccattgcactccagcctggcgacagagtgagattccgtctcaaaaaaaaaaaaggtgaaatgaaaaacaaaaaagaggggtgaaatttctctgcattctccctttctgctgttgggaaagccctttcattaccaagaatgcatggaattctgcttattaatttctccatctatgtgtctctgtgaaaaatactaattatttacaattttgtaagctatgaataaggtctatgttttctctgaaattatagcaacaggagcatttcccccttatttgggccgcaatcttttcattctgattcttaccataacttctgacttctgactttatcatgtcttctgatttctactaaacatgaacagaatgaatgacttctagaaatggatacaggtgtaatacatataaggccagggaaccacttaattatctttacaaagtactaggacttcagaaaaatcaaatgatgaaatggagctagctttagtatgttctacttatcattggactattaatcatgtctgtctgatgagttacctaggacttcaactgtttttatagatttaaagaaaatattataaatgtatcttacctggatttaagactggacagctgattttggatttttttctgctaccctgttgttgatatcactgacatcagcctttgcattttgactggaggctcctttctctctttctctctctctctctctctctctataggaaaccagtagttatgtcaggttgctaagtattttcccactgaaggacaaatattctggagcagtatatatttagcatttgacatttgataaacaagcttgtttgagatattttcaatacaatttcagctttggcaattgtaagcaaaggatccagttggtaattggtgaaatgaacagatgtggacacgctgcctgcatcgagatgcattaatttttctgaaaagtggataagatcttgtgagaatgaataatggaattcaaatcagatggggtgagatatttgatattcaggaacaaatcacagtataatagatctgctactttgtttggttttaatggggagttgctaatgctgaaatatagtcagagaaaaggaacgtggaatttctatagaggagagcctggctctggggtaatactactgtccttggtggaatgttgtcttttctgaagacattggttcaattcaatacatgaaacattcatcgattattatttagaaaagctaatctactgacaagacacagagttaagtagtgaaaatacagagacctagacacagttcttattaagaaattttttaatttaggtggcatatttcagagagaaattctctgcttggggcaataggtacctcctttggaataagcatggtgagaaagaattgcttctggcagattagtgagaagagtgagatattttctttcgatgacctctctattaaaatttgagtggtaaaactttgtgatgattcaggctcttcataattcttaattttatcatcctctaataccaggacttgcccagatcaatattttaggaaacagtcatgcttgctaaacccagggatttctattaaccactagataagacataagtttgtcatgcaacaagtatttattgagtccataatttgcccagcactgggctttggtactctgggccttgatactctaggttgtgtcagagatgtctaatatatttaaggtgacagagttcacaaatgagactttatgaaaatgaatatccctttttaagtctcgagaaatatgatgtgcacccgcttgaggctttattaaatctccagcgagcatgaacttgtttgtgacccaattgtagaattgttgtatgatgactatcccactggcaggcacttcttgtccaagagaatgtaattggatgttggtgactcaagcaatcctgggaagactcctccatgaccaaattaaagacaacaggggcttggtttgtactcagctctacaccaatcagcatgagacaaagaagagatccatggcaaagtggggagactactgtttattttacaagctagagaaggaaaactgcagttcctgagttgcaaaactgctaagaaatgggagaacacagaactttacaggctgaaccttggtgtcttagttattcctcttggctacagaatgccaaccagtaggagattcatcactgagatattacagggaaatgaagccaggcaagaaaaatatgtattccctttcttctcagcccataaattttgttattaataaatcagactcttatagaacagcttgccacggctgtctctagaaatgtttttattagcagaatttttattaaaataaaatacacagtagttttaagagtgaacattatagttttaggtcataaggggtgtcatggagaacacatgtggatgctacttgccagttacttgatctaggccttgactcttggttttctgttgctcggataagttagcatgatttgacatgcagttaaaggtgtggtaacctgtgattgatttcccattcttgatgctccctgcctggacttctcggaaaatttcaaaacaattcattcttctatgagggctgcctccttggttgcttcggctaaacagtgttgagcaacaagttgggaaaggaacgttgcagtaacttttaaaaattaagttagaaacaaatgtcatcaaagtaaatgataatttgccaatatgattgagcaaaaagatgaagatgcacgctccctacgtatttgctttgcagaagaattaatttgaaaaataataacatattttaaaatgaattgtaaatataaacacatgctaattgcagaggggaatccctgtgattattcagcagtttgtgtttgtcaagtgcttttcagtcagtccattccagctcagcagggcagaggcttgggctgttgtaaacttgtgggcagatacccagtgatggggcagacatgagcaggtagggctgacagcatgtgaattgagttttcttcagtcatgctgttgcagctgctcccttccctcattgctgagtttgccacagcaggtaggaacctaactctggagcctgggatgaaggagaacccacattgggcttgaggaacaagatctgccaccctggtaggccctggttaaatctcatgcaagtgtagcaatgagagagggtatgattgagttctaatttaggaggaaaggggataatgtgccctttgcacccccaggagaaatcattgctcatctgtgcctaagtagacttatcaagggcagttggttcacaatggtgtatcaccccaaaggactatagtgttatgagaacttgccagtgtatttgaatttgggtgctggcagatgacatcatgaggtattatggttacccataaatatgctagtttattgagaaggtggtagacatgctagtggatgagagggaaggacagaagcagttagtaaacagcatctgcaacaattcagttaactggtggttgtcacagtagcatggtggaaaagttggcaattaataacttctaagaaaactgaactaatgaaccaatcctgcgtgtgctatgtgtataacctccttctcactattaacagatttgttccaaacttatataagacaatgaaaataaagcttggcaatatagggaagggatggagggataaagctgtaaatcacgtcacaggcaaattaagatataccactggatcaagggatttaatgcagaaagactgatcctaacttatttcttttatttagcaataagatttgttacttacattgattatttaaaatgagttgcattattagaaaggactattttgaagacaactataataaaatgtcagtaactgatagtagccaagatattttaaatatatcaaagttgtgtcattaatattaatgtgtcccttaatatgaagtcctgcccaggcttatttatgtattcaacagacacatacctgttgaagtgtaacagatattctggacacaagcaatggtaaacaagacagatgcagtccctgctttcatgcaatttgcaattgaatggtctttgacattttattgtgattgttttagttatttaattggagaagtttttaatttaaatttgtgttatattcagtgttaaggaacaaaaatgtaatgtgcatttctgagactcagtaacacttctggtttttcctttttcatttaaagaaaaatttagtgcccaagataagctagaatttttggaatcaagtaattgatgacctgggagccaattttattacaatagtgtttttagtggtcttagaacttttcagaggtggtagctctgaaaataacactgtaataaattcacacatacatctatcatccaataaatgttaattgaggcccactacagcattgtgttagattctgaggttacaaattgttgaccccatgtcgaacatgttgaccccatcaatgtaatcagtttgacattacacagtcatttaaacattaaagtgtcagcggatattttagttgtaattttgataagtgctctgaaggagaaaacagtgggtgttgtgaaaagcagtatttggttgattgattattatagaggatctgagaaaacttacttgaggaaggaacatttggctgaactcaaagagatgagtaggagttaagtaagcaaggaagaaaagaagacacatgaaggaggaagaatgttctagaaacacacacacacaggtatatgtatatgtacatgtatatgtatatgcatatgtcttccttagaaacatataaacagctgcaacatgattgaacttatttacccaattaccaaagcttattttgcaccatgaaggtggagataaaggctttttaagcagcaaggatagaatctttgtagtttttatttataggctggttcttctgacaactttaatttttcatctttaccaacttcatggtcttcagtacatacaatgcaatcattattataaaattatattttgactcaaactctaaggtaggatgattcagctgtgcgccatcaacatagcagcatgaatggtagagactagtcattccaaacagtgaaggggcaacgtaaaactaattttaatattatatgaaagtacttcttgcccttgactgcttttttttttttttgaagaaagcaaactttaaaaatttattttagatttacagaattattgcaaggatagtaagagagttctcatatatgcctcacccagtttcctctattatcgacatcttacattatatggtacatctatcataactaatgaaccaatattgtttcattattagtaactaaatctatactttattcagattttctaagttttcctctaatgttctttttctgtcccaggaccccatcaggatatggtatgtatagttgtcatgtcttcccaggctcgccatggttgtgacagtttctgagactttcattgtttttgataccccaggtagtttaggcattttgtagaatgcctcccagtctgaatttgtctgatgttttcctcatggtttgactggctttaatgtgttttggggaggaagaccacagaggttaagtgtgattgtcatcacatcgtatcaagggtacatgccatcaatatgacttatcactgttgatattaaccttgatcatctggcttgagatagtatttgtcaggtttctgtattatacagttactcttctccctgtccatacagtactttttggaagaagccattttgtgcagctcattttttttttaattttaattttaagttctggggtacatgtgcagcatgtgcatgtttgttacatagttaaacgtgtgccatggtggtttgctgcacccgtcagctcatcacctaggcattaaagccaacatgcattagttgtttttcctaatgctctccctcccccaaccccaatctgacaggtcccagtgtgtgttgttcccctccctgtgtccatgtgttctcattgttcagctcccacttctaagtgagaacatgtggtgtttgggtctctgttcctgcattagtttgctgaggataatggcttccagctccatccatgtctctgcaaaggatttgatatccttcctttttatggctgcatagtattccatggggtttatgtaccacattttctttatccagtctatcactgataggcatttggtttgattccatgcctttactattgtgaatagtgctgcagtgaacatatgcatacatgtatctttgtaatagagtgatttatatttcactgggtatatacccagtaatgggattgccaggttgaatggtatttctagttctagatctttgaggaattgctacaccatcttcctcaatggttgaactaattaatttacattccgaccaacagtgtaaaagtgttcctatttctttgcaacctcgccagcatctgttgtttcttggctttttaatgatcaccattctgactggtgtgagatggtatctcattgtggttttgatttgcatttctctaatgatcagtgatgttgagcttttttcatatgttctttggcctcatgaatgtcttcttttgaaaagtgtctgttcatgtcctcttccaactttttaatagggttgtttgtcttttcttgcaaatttgtctaagttccttgtagattctggatattaaacctttgtcagatgtatagattgcaaaaaatttcccccagtctgtaggttgcctgttttctctgatgattgtttcttttgctgtacagaagatctttagtttaattagatcccatttgtcaattttggcttttttttgcaattgcttttggcagttttgtcatgaaatctttgcctgtgcctatatatttattgcatagattttcttctaggggacttcaaactatgctacaaaacttcaataaccaaaacagcatggtactggtacaaatacagacacatagaccaatggaacagaatagagaactcagaaataagaccacacatctacaacgatttgaccttcgagaaacatgaccaaaacaagcaatggggaaaggattgcctatttaataaatggtgctgggagaactggctagccacatacagaaaattgaaactggaccccttccttacaccttatacaaaaattaattcaagatggattaaagacttaagtggagctcatatttaaggagtgagaagatatgctctacctctttaagggtggagtagctctataaattatttggaagtgtctattctcctccattaatttatttagtcaacaattagtatcagccatctagaacccatgaatatttatgctttgggtacagtccaatactattttattttgtagctcatcttgttccagctttggccatttggagatttttcagttggctcctgtatctctttggcttcttacatatcattgtagggttttttaaaagccttttcttactttctgtcactacaagatagttcagacttatcttctgtattttttgccccagttctatgatcagccacttctccaaggagcaataatttccttcaatgaaaaccaagatatgggctgttggtgtacttgttgttattgtgtgttgttacttctagatcctctaagctgatagtgcaaagagatatatgtgtgtgtaccaacctatatatctacacacatataaaaatatttctatttgtaaccatctgtatctatcttaggctaaacctgagtacctactgatgtctccaattctaacctgcaacagcatggaacattctagccttctcctcttacttatctgtcacttcctataccaatagtgagaaacctggctcctaccatctgctatttatttacttaattatttaattccactatacttctatggaagtttcagaattgttaatctgtactcatgtacgaaacaactttatcaactagagtatagtgtttatatacagttcctttgcctttattctaacagattccacttactcattttccgagtcacttaggttagcgccttattttcctaagtccattagtgagtttgcttcatgtatttgtcatacatttaaattcttttgtaatattgtgcattccatcccagtttcccctgacatcctaaattaactttttaagtttggatacattgtggtctattctttgttctgtaaagctttatggattttgacaagtatttaatgtattgtatcaccattatagtaatatagttcctatggaatagaatagtttctatcgctgtagcatagaatagtttctctactctataaaatatcctgtgtttctctaattcaacccctccttcccaccttgaactcctgacaacccctggtctgtttaatatctttcttttgtctcttctagaatatcatataattgaaatcatacaatatgtagctttttcagactggctactttcacttagcaatattcatgtaagtttcatctatatattttcatggtctgatagctcatttctttttaatcactgaataatacttttatttatccactcactggtgaagaatctcttgattgcttctaaattcatggcaattatgaatgaaactgctctaaacatttttgtgcaggtttttgtgtgcatgtgtattttcaaattagttgggtaaatatctaggaattcaatttctgcatcattgtggtaataatgtgtttagcttcataagaaattgccaacctatcttccaaaatagctgtaccattttgcattcccaccagcaatgaatgagagttcttgatgctcgacatccttgtcagcatttgatttttgtcagtgttttggattttaactattgtaatagatgtgtagtagtgtttgattgttttaatttgcaatttctttttcttttttgagatggagtctcgctctgtcgcccaggctggagtgcagtggcacgatcttcgctcattgcaacctctgcctcctgggttcaagcaattctctgcctcaagctcccaagtacctgggattacaggcgcctgccaccatacccggctaattgttgtatttttagtagagatggggtttcaccatattggccaggctggtcttgaactcctgaccttgtgatccacccgccctggcctcccaaagtgctgggattacagacataagccacggcgtccggcctgcaatttcttaatgacaaaaaatattgaggatattttcacatactttttttgccaactgtattttttttaattaatttttatttttattttattttgtaacttttattttagatttggggtacatatgtacatttgttaatacaggcaaatttgtgtcacaggggtttggtgtacagatcatctcgtcacccaggtactaagcatagttcttgatagttctttttcctgatcctctccccactcccactctgttccctcacgtaggccccagtgtctcttgttcccctctttatgcccattggttctcattatttatctctcacttaaaagtgagaacatgcagtatttggttttccactcctgcattagtttgctaaggataatgtcctccagctccatccttgttcctgtacaggacatgctctcgtgttttttttctttctttttattttaatggctgaatagtattccacggtgtctatgtactacattgtttttttttaaaccctgcataccattgatgggcatttaggttgattccatgtttttgctattgtgaatggtgttgcaatgaacctacatgtgcatgtgtctttatggtagaacaatttatattccactgggcatatacccaggaatgggattgctgggttgaatggtaattctccttttaggtctttgagggatttccacactgctttccacaatgggtgaactaatttacactcccaccagcagtgtataagtcttcccttttctccataacctccccagcatctggttttttttgtttgtttgtttgtttttttagtatttaataatagccattctgactggtgtgagatgatatctcatcatggctttaatttacatttctctaatgattagtgatatgtagcattttttcatttgttgccaactgtatgtatttttcaatgaggtgtacatcagatcttttgcccattttaaaagtggggttttgggctgggcgcagtggctcacgcctgtaatcccagcactttgggaagctgaggcaggcagatcacctgaggtcaggagttcgagaccattctggccaacatggtgaaaccctgtctctactaaaaatacaaaaattagtcggacatggtgtcgggcacttgtaatcccagctacttgggaggctgaggcaggagaatcactggaacccaggaggtggaggttgcagtcagctgagactgaaccattgcactccagtctgggcaacaagaatgaaactccatctcaaaatacatacatacatacatacgtacatacataaaattgggtttttgttttctttttgttgagtttgaggagtttttttgtatattttgattacaagtcttttatcagccatgtgtttcacaaataatttctcccagtttgtggcttatcttttcactctcttaattgtttttttcaaagtagaaatttaaattttaatgaagcccaatttattaatttttttcttccatattgtgctattggtgttgtatataaaaacttactaccaaattcaatatcatatagaattttttctgttttcttcaagaagtagttttataattttgcattatatgtttagatcaatgattcaccttaagttttgtttaaggtgtaaggtttgtgtataagtttttctttttccacatcaatgtccagttgcttcagcaacattttctttttatatatatcttaagggtaatcagcgcaatattttctgaaaagatgacctttttctcatttaattggctcttctttgtcaaagatcagttgaccttatttgtgtggatctatttctggacttcttactctgtttcactagtccatctgtttatactttaaccagtaccatactgcctttattactgtagcctttatggtaagtcttgaaatgaaatagtgcaagtgctccaccttcttcagaattttgttcttcttcagtattaaaggctattctaggtcttttgcccttctttaaacatgttggaatcaattgtcaatatctacaaaatagattattgggatttggatttagattactctgaatctgttaattaagttgggaagaattgacattttatcaatattgaataatatgaacatgtaataatattgaactttcaatctctattatctcttcatcattttaagatcttctttcatttttcattgttttatagatttttacatataggccttgtacatactttgttaatttatatcttagtattgaatgtactattataaatggtattttctaaactttgaattcctgttattcatgatgatatgtaggaaagaaattgacttttgtatattgacattagatcctttaaccgtggcatcattacttattagttccaggggagattttgttgttgttgttgattcattggaattttctgcatagataatcatgccatctgtgaataaagatgttttatttcttccttcccaatctatatatcttttatttctttttttgccttattgcacttgctggtatttctagcataatgtataataggaggaatgagataagatatcttagaattatcctcatcttcaggggaaagtggttagttttttgtcattaagaataatgttagctattgtttttttaaatttcctatatgaaattgaggaaatttctgtctattctgaatttgctgagtttttaatcataaatagctgttgaattttgtcaaatagttttcctgtgtcaattaatatgatcatatgacttttcccgttttcactgttaatgtggcagattatattgatttattttcaaatgttgaatttgccatcagacatggaataaatcccatttgttcatgatgtataatttattttatgcatcgtttgttctgtcttgctaacattttgttgagattttgtgccagtgctcaggagagatattggtctctagttttactttcttataatatctttatctgatttgggtattaggataattctagactcagaatgagttaggatgtgttttctctgcctgtttactaacacagattgtagagaattggcacaatttctttcttgaagatttgttagaagtaatcttgccaccacctgagccagatgatttctttagaaggtaattagttattgaatcaatatatttaatatatatagagatatttaggctatttatttctccatgtgtgagttttggtagtttgtgtatttcaaggaattggtccatttcatccaaattatcaaattcgtgagcatagagttgttcataatattcctttattatccttttaatctccaagagaccagtcgtggtgacttctctttcatttatgatattggtaatttatgttttctgtctctcttttttttttgccagagtctaactctgccacccaggctggagtgcaatggtgtgatctctgctcactgcaacctctgcctcttgggttcaagtgattctcatgtgtcagcctcccgagtagctggtattacaggcatgctccaatacacttggctaatttttttttttgtatttttagtagagatgaagttttaccatgctggccaggttggtcttgaactcctggcctcaagtgctctgcctgcctcggcctcccaaagtgctaggattacaggcgtgagccaccgtgcccggcttctttttcttaattagcctgaatagaagtttatcaattttattgctcttttaaaataaccagtttttgtttcactgagtttctttatcatgtttctgttttcaattttattggcatctgctctaatttcagatgctccttgacttatgatggggttgtgtcccagtacatccactgtaatttgaaaatatcataagtcttttgacttatgtaatgcatctaacctaccaaacattatcgcttagcctaacctcccttaaatgtgctcagaacacatacattagcctacagttgagcaaaatgatctggcaacaaaacacactatagagtattgatggtttaccccgatgatcacatagctgactgagagctgcggcttgctgctgctgcccagcattaagtgagagtattgttccatatattgctagcacagaagatctaaattgaaaattcaaaatacagtttctactgaatgcatgcatattacttttgcaccattgtgaagtcaaaaaaaataataaatcaaaccatcttaagttgggaactgtctatattattctttctcttctgcttgctttaagcttatctagtttttttcttctctagtttccttaggtggtggcttaggttggttattgatattatatatttttcttatctaatatatttacttaatgctatgaatttttctctaagcactgcttttcctgcatcccacaaattttgatgttctatttttatcttcatttagctcaaaatagtttaccatttattttgaggctttttctttgactcatacgttctttaaaagtgtgttgttcaatctctaaatatttcgatattttccagctatctttctgttgatttctaatttatttccaatttggtgtgagagcctactttgtacactttctgttcttttaaatttgttaagggtgttttgtgacccagaatgtggtctatcttggtgcgtattccatcagaacttgagaagaatgtgtattaagttgtggtttgatggagtattctataaatattaattagaccatgttgattcatcataccgtttaggtcaactatatctgtattaattttctgcctgcttgcactagcaattactgacagcggaatggtgaggtttctaagtataataatggtttgggcttgtctatttccccttttagtttcaatcattttgcttcatgtgttttgattcacttttgttaggtatacacatatatacacatatttatgattgttgtatcatcttgaacaactgacccctttatcatcatctttatccttggtacttttccttctttggtagtctgctttgcatgaaattaatatagccactccagctttatttttgtgaatgttagcatggtgtatctttctccattcctttacttttaacatatcagagttattacatttaaagtgggcattattactaggataaataccaaataaagtattttgcatgctgggcttaaaacctagatgacaggttaataggtgcagcaaaccaccatggcacatgtatacttatggaacaaaactgcacattctgcacatgtatcccagaatttaaagtaaaataaaaaataaataaataaaaattaaaaagtaaaaataaattagctgggtgtggaggcagccagctactcagggggctgaggcaggagaatcaaaataaataaatcaataagtggggctttttgtagacaacatatagtttggtctttcttaaaattcaatctgacaatttccatcttttaactggtatatttaaacaatttatatttaaagcaagtgttgatatatttgaataaaaataaacctgtgtttattaactatttcatatttgttgccaaacgcttctttttggtctttcgtagttttatttgagcaatgtatgtcataccattttatcttttctcttagagtattaactatacttcttttttttttttttgagacagagttttcctcttgttgcccaggcgggagtgcaatggtgcgatcttggcttaccgcaacctctgcctcctgggttcaagcgattctcctgcctcagtctcccgaatagctggaattacaggcatgtgccaccatgcccggctaattttgtatttttagtagagacggagtttctccatgttggtcaggctggggtcttaaactcctgacctcaggtgatccaccggcctctgcctcccaaagtgctgggtttacaggagtgagccaccgcacccggcttaactatacttctttaaagaatttttgtagtggtgccgctaaagttcacagtatacatttttaagtattctaaatacaccttcaaataacactattcctttttacatgaaatatagggatattataacatagtattctcaattcctccttactgtcccttgtgacatagctgtcatttatttcatttcacttacctatatactataatcacctatacattgctgctattatgattttaaacaggcagttattgtttacgtcaattaagaatttagaaagaatttagaatcctgtgtaaaataaatttccttttattttaccttaattcatgcattctctgattatcttccatgctttatgtagatccaagtttctgacttatatcaccttcctcttgcttgaagaacatcttttaacatattctgcagggcaagtcagctggtgatgaattctctgaatttttgtctgatttttttttaatatttccttcacttttgaaggataatttccctgcatctagaattctaaattggtcacttttttcaacattttatatattttacttcactttctttattaatgtacggtttctgaagagaaatctgctgtatttcatcctgttctctatggttaggtgcttccctgccctggctctggctttttcaagattttctccctgtctttggtttttctacagtttgaatacaatatgcctaggtgttgtttgttttgtttttttgtaaggagtggcatgtatttatcttcttgatactccctgagcttcctggatctgtggtttggtgtctgtcattaattttgaaaagttctcagccattactacctcaaatatttcttcttcgcctttctttttttttctttctggtattccaattatgcatatgcttgttataccttttgctttttcattcttttgattctttacatttcagttggggacgtttctgttgacttatctttcagctcactgattatttccttggccgtgttgaatcaattgattagtcctcaaagacatttttcatttctgttacaccatttttacatttctagcatttgcttttgattctttcttaaaatttctatctttctgcttatattacccatcttttattgtatgttgtcttctttttccattagagccctcaaactctttttttttattatactttaagttttagggtacatgtgcacattgtgcaggttagttacatatgtatacatgtgccatgcttgtgcgctgcacccactaactcgtcatctagcattaggtatatctcccaatgctatccctcccccctccccccaccccacaacactccccagagtgtgatattccccttcctgtgtccatgtgatctcattgttcagttcccacctatgagtgagaatatgcggtgtttggttttttgttcttgcgatagtttactgagaatgatgatttccaatttcatccatgtccctacaaaggacatgaactcatcattttttatggctgcatagtattccgtggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggcatatacccagtaatgggatagctgggtcaaatggtatttctagttctagatccctgaggaatcgccacactgacttccacaatggttgaactagtttacagtcccaccaacagtgtaaaagtcttcctatttctccacatcctctccagcacctgttgtttcctgactttttaatgattgccattctaactggtgtgagatggtatctcattgtggttttgatttgcatttctctgatggctagtgatgatgagcattttttcatgtgtctgttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccctgttgcttgtttttctcaggtttgtcaaagatcagatagttgtaggtatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgtgggctcttttttggttccatatgaactttaaagtagttttttccaattctgtgaagaaagatattggtagcttgatggggatggcattgaatctgtaaattaccttgggcagtatggccattttcacgatattgattcttcctacccatgagcatggaatgttcttccgtttgtttgtatcctcttttatttcattgagcagtggtttgtagttctccttgaagaggtccttcacatcccttgtaagttgtattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagctgaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgacatacgtcccatcaatacctaatttattgggagtttttagcatgaagagttgttgaattttgtcaaaggctttttctgcatctattgagataatcatgtggtttttgtctttgtagagccctcaaattcctaatcacaattgtttatctctttcctgacattccacatccaatccatcagcatgtcttattggctttactttcaaaataaattaaactcagccacttctcagcatttttaaaatcaccctaatacaaaccccctgctacctcatcaactgcaatggcttcctaacttattttgtaacttttgatctttgagttcttccaagagccaagagttcttccaaagctataaaccctatcattggcactcctctgctctatggaaagcagtggcttctcatctctttcagagtataatgcaaagctctcaccttagctggcatggccctgtgggattggcctcccttgtcttactttttccttgttcaggctgctgtgacctctctggtctttggctcttactagaaacctttgaacccgtttccttcccagtgtcagtatttgtgtgttgttcgttcacccttctcacttcattctggtttctacagcacagagaagtagtagtccctgatctaaacaccctctccacctgctttccactttgttttttcccctagcacttaccattatcagatatcatatatttatttgtttattgtctaacttcctcacaaaaatatgacgttgtgaggatagggatttggctttttgccccagagcagtgcctgactctcaataactttgttgtattaagtgaatgaataaaataaaattaaaattgattcaaagtgtatgagcatgtgtacattttacataagtgatacatgacattcttccattccttgggggctcttttaaccattctcaaccagttgtagtacctttaaaaaatcatgatgaagatgattttgagagctaattttggtaggagacagcagttttagcctgtccgctccatgtgcagaataatagcctattttattacatctgatattcaagcactagaatctatcaataggtaaataatttccaaaaataaaagcatcagtgggaaaacagggaaattatttttaaaaaagaatttctagaccaggatgtgtgcaatttgtaatctctaataagaaacgttatagctgataattccagcaattacagaatcatgatcatatccataatggatcagtagaggctctggcttatataatagcttgccctctcaggattctagagccccatatgtaaacacagaacacatttatattgattgacagtgcatgtaggtttctacagattgtgccagtcagtgttttctaaggcagttatgccatggtaattaaaattatgggctctgaaatcagcctgcctgggttcaaaccccagcttcatgtgtcagcttccttggctgtaataaggaatactaatagcacctgccttgtggctttgaaaattacatgatgtaactttgtcaagagcttagatgagcacttgggatatggcgagtgctcaataaatgttagtttaccatcatcatcatcattattattattactgattgcaagcaagacaaactggttctcacttcagcagaaaaagaaattactgaagtaattttggttagatcacagatttaacgtgaaggatgaataaccagacttggaaaacaggtggaaaccaagaggcagtcagcatggcatagcagccagcacttcaccagtgtggtgccttgggggcagcctggcaggagccactgccttcactcctggactgcagatctaccacaggacagcagactgaattgtcctatgtccagacttcacagtcacagggagcaggctgcatgcaggtggggcccaggtcacctaccttcaccctagagtctggagccacagaaaacagtaattgtccttgtagcttttgtgatggaaagcaagtcctgacacccaccaactcacatactagggaattcaccaaatgtaggacggcagctaagatgctgggaaaccaagaattaacaaatgagtattacaccaattagttaattcattacagatttcaatattttccaaaaaacatcctacaaagaacagctcactttaatatactccaacaaatgatgaaatctctccttggtcatcagcttttctaaatttctgtaactttaggtgattctgaatttcttagtgattctgaacttctagaagattctgaaacagaacagtcttactttgggatgtattcaaatcctagagatcagtcacatcaatctgtgccctttttcattatgtaacatgaaacaggaggacctttccaacttgccttgggaacctgctcctacaacagggtatattatcacatttaataaagaaagagtaatatttgcattgtgacccttcatctgaggtcatcgggactgtgctgtcctcccaagctccactgtaaagggatagacaacaaccttgtctcccagtcattgtaatctgtatcagagagcatcattagatgaatgaagatggaaatgttctcacggtcagcaggtggggaaggcaagacttgctgattggaagcaatgaaccatagttcattctaaggcttggggagagcaactttgaggaaatgaggcccctaaacttgccatgtaggagaagttggggggtggtaaattgggcaccctttatctactaaacgtaatctttacttccccaccctctaatttttctcagttgggcttgaaattgtttttgcttgttacactttatgggaaaagaaagggaaatcctaataaggtccatgccagcaaaactctagaagaagaaactaagaatttcaaattgacagtttgttaatgagaaaagacaaggttaaaggattttgttaaacagatgaccaaaataattattggaaacttctgcttctggccaaggtggaataataagggctacatttaccttcccaccagaaaatataataacaaacaaaaactggacaaaacactggacatgacactgttgtctttaaaccttggacatcaatcagtgcaggatgttattttgtaagaaagggaaaaaaattggggtgagccttctgattgtttccagactggagagaagtttcaggccacagcaagtggggaggaacctaggtgtaagtatatgtataaggtagcacatcatagtggccaaatgaatggcacaggaaagaaaaactacaagaacagaggaggtagggccacaaaactagagtggggtccaagattcactatggataaaatggggtgttaatttggttttcaaggccaatacaagaggaggcatagaaaaagaacaaggtggtgttgggaagtagtataaaaaggggcacaggcttatccttgttttataaaaaacaaaggtttttggaagggatttgtagagataagtttgaaaagtagtttgagactatgtgtggaaattcatgaatcttagagtttgattttattcaggagatcagtagcttttaaaatgtaaaataaaaccagtaaactctatctaaaataaattcttcccctaatcccaatataaaaaatacatataaaagcgtagctgctctagacaaaatggcgggtatgagatgaccagaaacctcaacagcactacctctggtagccccatagaactgccaagagttttcagagtatagttaattcctgctgacggctaaggcagtcattgagtgattggaaagaagacggaagatagacaagatcagttaattgggttggagggaagactgaagataggcaaggtgacaaattaggaactgttgcaatgatctaggcaagaaggaacctatgaactaggagggaggcttaaagacagcaaggagggaactataggcagggacatgtgaggaaatgcttagtagttaaggtgagtttgtaggtatgaaaggagagaaggaaagaacattaagtagcattaagtgaaccagataatttatagctccttgacctgaaacatttagaggctgtgataacactaataataataatctataattacataaattacgtagtgtaatgatatatcatgatataatcatcttaccaatgctttacagtcaatgacattgtggtacagagactttggaggcagatagacctcgattgtaacctctgtgctgcccgtggtatgaccttgagcatggtagttaatctgaacttctttcttttctgttaaattggggacaatgacagtacttaaccttatagtacttgaagggagagtgttagaattgatactggggagtctctccacagaaagttgtattagttattgtctttatttcattcttaatgaattagcactcccgttttctttaacatgttgaatttaaaacctcttagtgtatttctttgtcttgccttttaataccccatgaattattgagaaacaaaagaaagtgattatgcaaatgtttgaaatatctaataatacatgaacgtagtcatgggaaactggagaaataactttactgatattatactagttttttttctggaagcatagcatattaagaaaactcatttcaatgaaagaaaatttaaaaattagagtgcattagaagcataatccaatgaattctattcctaatgaatactcaggcagtatgttaactttttctgagatacaatagccaagccaaagaatttaaagaatgaaaaaaacagatgattaaacaaactgtgaagtaattagaggtagtctttgaaaatgcctcattaggcatttgactcattaggacagatccttttattttagggccaggacataattatttaagcagttgatgtgtctttagctcctttcaccttgccacaagttgtcgcctgtactgcctttccacctagcttccaagtccaggccgactttgaagagattccttagggctcacctcccctggagagtgccctctgtaccatctctctccctttcctcctcattcctattgcctgagtttattgttttaataaattcccataagttaacacctcctagggtggattagaatcattcaaatccacattgattgttactaagtagaaattttatactgagcctttctaaatccttacaacaacgtgacgaggatattatagttgctttaacccaaggagatgaaattcaaactggtggcattgcacacttacagtgggcttgcaggatgaaagagagcttggtatctcgatcccttatacaaaacaggtgggtcttgttagaaaaattcttcaataattgttaaggttaaaattttgaaaagtggttcaaagaaatttgctttgatgcaaatattgtctagtcagttacataacttgagctataatgacagtgtacactagctatccagggcacgacatctctattgtgctgttgaatatactgctcaaccattctggaaaatggcatgttcatgtatgaatgacaatgtatcttgtgtgtatggcattccaagccaacatgttggtccctgcaagtaaacttcttgactgtcaagaggctgcctgtttaatatttgcatgatctaaactaattgtttcctttgtttttttcctctgctttatgagctggtagtttgaccttttggcttttcccctgagagttaacaaaagttagacagttggggggtgaacttaagtaaaatccatatcactctatgttgctgctctactaacaattcaagaaaatgtcttggtagaaagcaaggaatgagttttaaattttctctttgaatttcaattatccatgccactcctgtggtccaccattctatataattaagaataagctgtatgttccatagtgacacaggctgttatttctgatttgcagttttcacttaacctagggtaaaattgaaatagaagtcgcatccttttttttttaccttcttccactcaattctagttagatatttttgaacttctataaaatgtctatgcaatattatcaccaataatgtgcaaaattactactcccatgtagaagaggatccattcttcattgaaccatacccttgggatcctatcacatgcagttggccatataatattttatattattgtttttttgttttgtttgttaagtttgtacctacataatggattaaattcaaaatctctgtttaactgaaacaaaatctgtttaactgaagcaaaaaaacaaaatctctgttttttgtttgtacaaaacaaaaaacaataatatttttgttttgtttgtatacttcatagggactttggaatttggaaaatatcgttcatttagggtatatatattagtccattttcatactgctataaagaaatacttgagactgggtaatttataaagaaaaataggcttaatgaactcacagttccacatggctggggaggcctcacagtcatggcagaaggtgaaggggaagcaaaggcatgtcttatatggcagcaggcaagagagtatatgcaagggaactgccctgtatgaaaccatcagatctcatgagacttatttactatcatgagaacagcacaggaaaaacctgcccccatgattcagttacctcccactgagtccctcccacatgtggggattatgggaactacaattcaagatgagatttggatggggacacagccaaaccatatcagtacattaaagaaaatatttgttagcgctaagtgaatctactttcacctacttgattatttgatgattttataaatagtcatctctttcctcatctttccagtcgtattttgttgttccaaagccaaaacctgtgtgtcttgtattcaacaacctgaatcatacagttgtgagacgtaaatgggtgtggtggttccacttacttctttacatagtactacaactaagccatctaagtagtctgctcctaaattcctccaagaagggaaatatcatgatttgatttaaatgtgacatcctttcttagagaagttttctttgtctccttcttccccagtcacttcctcccatccactgtgctttcggcagttcattcgttcattaattcattcaacgaatattgaataacttttgatcaatgtcttcctccctccaagctgaaaacttgatggagggtaacatgatctgtctttgtttaccactgcatcttccgtgaatatacattgtaagtattgaacggatttttactaaatgaacaaatactttgataaaatatttttgattactgccaatatcagtttctgaattgattctaaaattcttctgctggaaagtagattagcgttagtatgactgctgaagccttttaaagtgggtggtaatactacgtttcgttttgtttcattaacctaagtgctgttctttggaatctttttaaagtaagataaattacattcatgaaagaagcatattatttttaaagtactttattttggaaaggtaaaatgcttgtgtagttataatttggttactcttgatttcaccttaggaaaaacaatatcaccttctaaccatttcttttttagtcaaatctcttgcttctatttctctctgtagatccgctattaaagactgtaatcactgctgcatctttcctgtaaggcttgatcgcattgttaatttctttctaaacttgtagagtaggtgtataaatcgtatttgggtaatacactgactaatactgaagaaccaggcattttcttaccccagtcctcacacgaagtagggaaatacaagtcagaacttatcttctcaaaactctgacctcagaatttcctgagaaatctgaacctaaaaagattctttgcttttgacattttttctctggtgtccaccgcaaggctcttgctcttacattttttttttttttctaatgtttcaaatagaagatggtagagtcatatagtacaagctcagcatcggaggggctactggaggtcaactagtgcaaatgctttctgaataatggaatcctttgggaatacccccttgaaagtcttcatctagcctcttcttggaaaccctcagtgatacccctcatcgtctcctatgatggcagcttctatctttgtcgtcagctctgactattacaaactgcttccttacattgagctgtaactaactaaaaagtttccacaccctgcttctattttagcctttgggctcataaagaacaagttgaacccgtcttatgcagaacaacccatctacgggagatgctcaggtttcctccatgttttcctttctctaggctaacccttcgttgttcctcacttactcactatataacctgatttcatgtctccttacccttcttgttactctaacttgagtaggctagtttcaggatccagcaataagtgtgatacatcaggtatgctctgatgagttgagagtagagtggacatagcatctcccttaattcagatattgtgatctaattggcaaatctggcaataaaagttgaaatgcctgatccaggacaatggctggtcaggtgccattgttctcatcttttacttttaggtgtccctcaatttgttaagttagtacctacgtaatgtcctgaaacttgttaagtttgtacctacataatggattaaattcaaaatctctgtttaactgaaaacaaaagcaaacttcttttcagagccagaatctggaatcatacgtaacagagaatgatattgtacaagttgcttcatctctttaagtaacggtttctcaaacttacaagattattgtgagaactaaattagttctaaagtgcttccatgtaaagtgtatgtaaatgcttaaaatatatagtaagtgctgaatgcatattagaaataataataatctttattataatttttactatttcatgagaagtacttattttaatactgagcaaataggaagagttcatggcttctctatgtttttgaagtgtcatttaatatattatatatataaaacatatatatatttcagtcacacatttgtccaaataccttgacaaattaaaacaaaataagacaaaattctcacgctagttatttgttataaagtaatagaacaagtgatatgttataaagagcatttatttctcatgtctttgatattaaaaatagttgtattaactttttatcaaaacgattgcttccttcatataaatctaagaattatgctgtctgataaatattggagagattaacttctttgaaaatatagaagctttttgtctttttaaaatagttgtttttttgcagatgttaatacatttcagcagtacagtatggcctttttcaggttaaggtgctgagcccaaacctcaaagaatcactgcaaaaagattggatcccccctcttcaccccatttcgtaatttagttagtgagaaccacaactggctaaacctttgtggggggccgggcactgtggctcatgcctataatcccagcactttgggaggccgaggcaggcagatcacaaggtcaggaaatcgagaccatcctggctaacacggcgaaaccccgtctctactaaaaatacaaaaaattagccgggcatggtggcaggtgcctgtagtcccagctactcaggaggctgaggcaggagaatggcgtgaacctgggaggcggggcttgcagtgggccgagatcccgccactgcactccagcctgggtgacacagcgagactccatcttaaaaaaaaaacaaaaaaaaacaaaaacaaaaaaaaaaccacctttggggggaaattatcaaataaaacaaactctttttagaattttacaacttttatgttaggaaaaaacaaatacatttgtgaaaagcttaaaatccagtaaatgacttgagggacttggggcaatcctagggtgatgaggagcaggttagtaacagtgaaggacttagcaccccagggggccagaggctgtaatataccttatgagcaagtcattcttatttagtcttgcccattaagaagtctacttggactaaatgcttttaaaaatgcccttttaatttactattaaaagaatattcctagcagaagtagtcttggatgctaaattctattttaagaataactaaaattagaattctgttctttttataacacctgttacacacacacccctacctagtgtgtcggaatcagtttgtatgggctcaccaaagcctactgttcaattttcaggagttttgtaagccatttgatgtcagacaagtggcctgaagtttgttatggtggtggtatttacaccatgaaaattggcatgttatggtggtagtatttacaccatgaaaactgctacaaatagaaatctttttcttcttctcttggagagccacttgttgaacacttaccagctcacctgtgcttgaaagtatttcttcaaataaaatgaaagctggttagctttgaaaattttttgtataaaagtttacacgggaaaaaaataaactaatttttttttccacctgtgttttcagggatacgaaaagaccgaagaggagggagaatgttgaaacacaagcgccagagagatgatggggagggcaggggtgaagtggggtctgctggagacatgagagctgccaacctttggccaagcccgctcatgatcaaacgctctaagaagaacagcctggccttgtccctgacggccgaccagatggtcagtgccttgttggatgctgagcccccgatactctattccgagtatgatcctaccagacccttcagtgaagcttcgatgatgggcttactgaccaacctggcagacagggagctggttcacatgatcaactgggcgaagagggtgccaggtaagaatgcgaagcgcagcttttaagagtcaatagcttttcaagaacttgttgtgatgtcatgggagaaatagtgggggaaaaagaagcaataacatgttatgtaattggtttcaaggttacaggagatgtgttcattttcagtatcaatacactgtaattttccaggagattaggaaataatatttttaaatcagaatctagaagactgaaattcttaaattgacataatttatttttaacccatctcatttaccaaaaagatttagggtggacactacatggtaaaactatttaatagtgtatgttcacagtagcagaaacttttaacactaaatgaactacaaaagtttgtaatattaatgacctttgttgaaaacatctcaattattaatcaaacgattttatcttaaaaagatttttaagattcggtgtggtggctcgtgcctgtaatcctagcactttttggggctgaggtgggaggattgcttgagcccaggagcttgaggccatccggggcaacgtggcgaaaccctgtctctacaacaaatttttaaaaattagctggatgcagtggcacacacctgtggtcccagttatgggggaggccgaggtgagaggatggcttgagtccaggaggtcaaagctacagtgaaccatgtttgtgtggagtgccactgcactccagcccaggtgacagagcaagaccgtgtcataaaaaataaaccacacaaaaaaagagaaagatctttatggattaaaaagataataataagtgtatttactgaatgccaattatttatccaacctggtgtatgcttagtgttttaggagaaagagaaaggcaatggaaaaataaattaaggtatcatccctgaaagaaacttttagaaagacacagtggctgaagtgataccttgttccttcagttgattctctcagaactggtgttctggtaaaattggactgttactcctgttattcagggagaagaactcaagtttgtatggcaacaagactagaaaatgactttctccctgccccagtgtattcgttcaggagctaatgtagataaaccgaggcaagaagaagctaaattttttttctgggcttataggttaaatgagtgatagatttagttggaggttttctcatttggtttcttttaatagatgaaattaattgtttcctatgaagcatgaaatgttttatatgaaactaaaaaaatgtggagtttgtacttgcatttcaagggtcactgctctgttataggccaagtgaacttatgtctggccttagagaatcttacatgtatttgcatctatcagtatataaacatgtgggccgtagaataaggagccagcagtaccagaacccagccttgttagaggccaccattttggtggttgagtggttattagtttacatggaagcatggagaataataggcaaatgtaggttttcagtgtcagtcgaactggcaaacaaaaatttctggtcatcttcagaatgaaaagttttcttgagtacctacatattttagcattttcatatgaagcagatacattataagttaattgttggaatctaattgtaatatggctgtaagttttttctttatatttgttattgccttgttcttatattatagggaaagagaaacaaacaaacaagcaaagaaactaatggtcatatatttgagagccaactcttggttgctgttcagttttattttcctgtaaacatatattttcccttatgaaatcttgggaatattagctctggagcactgctgaactcaagtacagacattttcatgtgtatcagtagattcccatcatgacatttttataataatgttgaagagcattttaaacaactggaattaagctcaaatacattaccagtggttgaagaattcacatcaataatcttctgaatttaggaataaaatggagaagtcaaggaaaggaaaatattatacacaggctagcaatagttaaaatacaattattaaagccagagctagacaaaattatggcaatgagatgtgtaacaaaaccactctgtaacttcatcatgttcgtttaaaagacctgaatgattccaaaatccttagaccaataaactatgtcttcttacttgataattaaaaaaaagaattataaaggcaaaaatgaaattatatgtatgtgtgtttgtgtgtgttccatgggaatacagctgttgtaaatcaaaggcctacttgcctgaccaagcagaataaaaatagtcattgattttaaagagactaaaagtgagggaagaaaaaagtcttctgcaaaagctctacagatggttgtcaaacttttcagaaaaatagacaaagcaacattttgaaaaggatttatatcttttatatattcaaataccatctgttatttaaaaaacatagcccacactgaatatctgatatagacaatataacgtttatgagataatagtttgagaatgacaataataatagtaagttttaaaagaggaaataagccgggcacagtggctcatgcctgtaatcccagcactttgggaggccgaggcgggtggatcacctgaggtcaggagttcaagaccagcctggccaacatgacaaaaccctgtctctacaaaacagtacaaaaattagccaggcttggtggcacacatccatagtcccaggtacttgggatgttgaggtgggagaattgcttgaacctgggaggcagagactgcagtgagccgagaccccacaactgcactccggcctgggcaacaatgagactctgtctctaaataaataaataaagaaggaaatagtaaatgtcattagtaagaagaatagcaaaatttcagttctagaaatacccagaattagctatatgatacaaaaaccctcatgaaacatttggataatcctcagaatacctatcaatataacaaaaactatgaattgacttcattttgaatgatgaatttttaacaaaaatagtcaatactttgggcttagtagctctagaagtgcttctttcttctttcttttaattaacagaatattgtcagaattttcaaatgttgatgattataagttgaattttccttttcattaacccctggggcttattttttgacttgatatgtttctctactcagaattaagatgtgaagagctttgggatagaatgcatcatacaagtgtgagagtcaagttccaatccataaagtacttctggtagacctggataaagatgaccttaagaaatgattttttttctctttgcagtttaaaaacaacagtagcaacaagaatgataaaacctatgaagccagctctgacaaaagatgttttttttataacacatactatgtatctactttttgatatttatctatcgagaagacttttctccttattgtttgctctgaaatttgtttatatttaataggaattttatagccttatccctgggtagaaattcagtttttttaaaagtagataattaaatcttaatttactattattttacacatggtgaaactagtcaataaatgtaatatcattgagctgaaggttaaaaaggaaaaaatatgactgcaagagtggttgtatttttgatttcagcatcacactcaattgcatcattgagtggttcattcttagtttcagtgttaatgaaatacatctgagtttttttccccagaagcttgaattgtgtcaccaaagtgtcattttgatttattgaaagttaagccctttccaaaattcaccataattttacatgtctcgaaagcaattttatacttcaagtctgtgctatagttctatatattttatgaagatttggatagatatctagccctgagttttttattgcctgttaaatacttataacccaaagtgtagcagcctcatgaactgctgctgggcacagatctgggagagtgcactcagagtgttggcccaggaagaggaaaagaggaaaaggggcagttcagtggcagcttggcttcctgtgaaacatgtcaccttaaccacttcctcattcttttagtggcaaactagacgaccttctccttcccctttcctgccgagtccccctctaatcaacactctagaaggcccctcttcctcctcagtcctgactccctgtcatttacttcaggttgcctccttgctcagttttggccccaggggtaggcaatctcctctttctggacatgtctcccaccagccccaagttcagatttcttggaagtttctgtgttgtctcgaggatgcatggttgtgtgagttattccagggctcaaggcctcttctgtgtctgtattccccaggaatccaggaattcacttctctgcctctcatcctcatcctcatcattaaaatgagcagatttgagctcaggaagtgcttgaataaatgaataaatgaacaaatgaaaggtgatttttgaaagtcttaattttaagaagtctctgagccctgttacagctcaattttcccataaactagaactgctctctaaggctgtgacatttctcctttttcctctcctcaaaatctacctgctgttctgatatctccctgacagccaccatagtgagattctatttccatttccaatctctcttttgtaagggacagagaaacagctagagaaatatggagccatgcgctctgaggactttagcaggcttcaactctatctgcaagtgagtttcacttagcgaatgaaattggaaacttaaagtgggtagggatgagggttcccggagaaggtgtaatacctcagtctgggaattgggagcatctacaaggaacacactcaattctgggaggttcctgtagatttcagagatttagcagggcttcccagcactctgcttcccaacctgtcattggaccagtaaaccctgctctcaaactgttgtggtgtccagcatgctttggcaaggtaatgaaagataacatgacatggacatatgggtgacatcctggagagatgacagaagcctctgtttaaggacaagatttgccatttagattttgcacccactgtataataagagccttaggattgggctggaatcgccctagcaggcatgatggcagcccctctggactggcaatatgcagcttttttgcaagtgttccatgtccaagtcaccccacccagctttctactgctcccgtggaagctctggtgaaacgcaaggaaagcagctgctgttgactggatttttctttcacatgaaactttgaagcctcatagatgcttattggcctggatgctattaaacctttaaaaatccctttctcatcttgagagtatttgagaaacatgtctggggcattttgcccaccctcctccaggttctgtgtcagtgagtgatatggtttgcctgtgtccccacccaaatttcatcttgaattcccatctgttgtaggagagacccatggcaggtagttgaatcatgggagcaggtctttcccatgttcctgtgatagtgagtaagtctcaagagatctgatggtgttaaaaaggggagtttttctgcacaagctcttcttctcttgtctgccaccatgtgagatgtgccttccaccttctgccatgattgtgaggcctccccagccacaatggaactgtaagtccattaagcctctttcttttgtaaattgcctactctgggatgtgtctttatgagcagtgtgaaaacagactaatacagtgagtctgggtcagtgtgtgtttatgttgaacgtagtggacttgtggtgtccccagggcaccctgtggggaatgttggcctgtggctttgctacttccagggggatttggcatggagaatgtgtgttttaagtaatagatagattatgattgaagtgtgttatgggctgagttgtctctcctcaaaaagacatgttaaagtcctaacccccagtatctcagaatctgaccttctttggaaatagtgcctttatataggtaatcaacttcaagtgaagtcattagcacaagccctaatccaataaggactggcattctaatgaaaggggaaatttagacatagaaacagacatgcacagaagaagatgatatgaagagacacaggaagaggacggtcatgtgactggagtgctgggtctgcaagctgagaaatgccaaggtttactggctaacatcggaaactagaaggggcaagagtggactctccccctcagagagagtatggccttgatttcagacttctagcctccagaactgtgaggcgtacatttctgttgtttttgaagccacctagtttttgatactttgtatgggagccctaggaaattaatacaaagtgtattaaaaatagaattttcttctattgtatttttgaggcaaaagaaataaggagctattgatttaaggaggaaggtttggctcatctagtatagacttggctaatcatttactcttgtatatttctcttctgcctgcccaagtagttcactgaacaggcttagaagttgatttataattgtaagagtttacacatcagaagttaatttataattgttaacagtttcatgcatctacctcataaataccttgtaaaagattttacccttcagaataatgttttcctctggtactttagtagtttatcctttttttgcatctttgatgcatttgaattcatcctggtatgctgtgtgagctggggctccaatgtcgttttcctacagatggctccacagttgtttcggtttcattcgaacagcctcctacagaagtatttttcagacttcttttatacttgacttccaagtttactactggttaagagcttttaaagtagggggaaagatatgacccattggcctactcgtttgattattttttccaattctgaaatcaaaaattaaaaaatttattcaaagttatagtttcacttaatttatattaactgcatagatagtgtgattcatctgtcctgcttggacatatttagtaacttttaattaatcttagagataaaagatagaaatctatgagacttgagacattcaaataagaccagtactgataagaggtaatcaggtgaagtgccatttggttgtaataggacatcaaaattgttccccaagagtgaaggatgttccattctcacttttcccatctgtcctcccaaattctttcactcttcctgatgctttgaaccaacttgaaaagttagtccactcagaacctcagctgttaaacttttagcctctgcaaacaaactagccgttttcctctttgtccctttaccatcaagctcagttgcttctcctactcctctcccttctgccaggggctccacccttgttcctcattcaacagtggaatcatctgtgtgcctgtctcctctttactgtgtaccattgggtcctcttcttcaccatctctaaatttatgcttcttccctgttccactgtcaccagcttggtctacatcctactttgatcatttggatttaggtcccaccctaatcgagtatgacttcatcttaacttgattgcatctgcaaagacctgatttccaaatacgaccacaagtaaaggttcaggtggacatgaatattaggagagacagcacttcaattaacagtttggcattaggactttattatctagcttagtaattgttttaacagataaataatagtatcccctaaagtttaaaatgcagaaccagattatgcctcagggtgcctaacctgagaggaagagtctttcttcaacagactctgggaaagacctttgtaaaaaggctggtgaccattctatttgatttctactttccaatattaactgcttaagtcagacaatctccttggcccacgctttcccctgccattctccccttcacataatgtcttcattttatttttcccttgttttattccctgaactcccttctctctattcagattccctgcccattttttctcctaatgagacgcctgacttcctacctcctttttgaaacttcaaactgcttagcaaatacaattttgaattgagtttgctgtcacagaacaaaaactagtccttggtccagagtatcttgcaggactgaatcaactgtggtctaagacacaataataactcttaattattttcttgtttccttcatggtatatttgttgctggatgatgagtttatattatggttgaatttcctttttgaaatgaaaagatgaatagtctttattggctgggtatctatttttatccagaagactttgcaaatgagaaatatttctacaatctgagtttaatttgcttaagcaatgaacttgttctttaaaagtcgtatatgtgcaaaataaatttaaattaaataaatcatattttaatgtagtcagggtagctttcatttaaataaaacctatgacaaatatccacgtgaagttatcactcctttaacaaaacaagtgttctccttttttattgaaatactagttttcacaaattgagattccttaatgtgatgaccgcttggactgactatagtatagctgcgttcttagaatggccctgaaaccacaaggcctctccaagatgcatgtggctgactttctgaggtgactgcattgaatctttctggcttagcttattctgcatccagatccctggaagctatttatccccaaacagtggtatatttagacccattgtgtgctaacctctctgtgccctaagtaccaacatagccaagccaaagttcgaactttgctgccttacaatggaggttacatcgtagtgatgaaagaggttaattttctttaggagttgaagaccagagaactgcaaaaaggggagaaaatcagtgtggcctctaatgagagctaagtgagtgaggcaatagaaaacagtgaggaccggccagtgcggtggctcatgcctgtaatcccaatactttggaaggctgaggtgggcggatcacgaggtcaagagatcaagatcatcctggccaacatggtgaaaccctgtctctactaaaaatacaaaaattagctgggtgtggtggtgggtacctgtagtcccagctactcgggaggctgagcggggagaatcgcttgaacccgggaggcagaggttgcagtgagtcgagattgcgccactgcactccagccggagtgagactccgtctaaaaaaaaaaaagaatacagtgaggaccttggagggaatcttacagtggagcagaattaaaagagaagaattcacctatttcctatataactccctctgtaaccgataactttctagagaaagctcactgaatatatttgaaatttgtttcataccacttttatgttattgccttctttcacaggaaccagagagctctaacctgtagatttgctttgttgtctttactttagactacagcctaaactgactgttgatttttggcacaattattacatctctcctttcaccccgcctctagccctttcttaattacccccattaggcatttttcttgctagcgtgaactaaatcccctgtctcaagcacgcgcctgtacattgaaatagaatgttaattcattgacgaaattaactgttcttgattgggaacccctagttccagggaatcttaaggtttcaattctgttgccttggttactaaactgttccatgcagtttgctcaactttgaatggatacttctcttaggaacattctcccttgtaagtaaattgcttgacgtgttaaaatctaagttctgttttacaattcttgagacaaattcaccatgatttagttttaaaaacaagtggccttgtccttttagtctaggatttatcacttagctgtatctagcaaagcccctcacacaatagtaggaaaaagcagaagtgtgattgctaaatgaaggggaaatgtaataaaatgatggaagtgcccttttttagggggaattaaagtttctctttgtagtgttacatgtattcattatgtgactttcataaatacaaaccccaataaaacggtgggcagttccgtctctggagatgttaagtgtctcttcatagaataacatggcacatcataacatttgattccttttacctggtcaagatgtttgcttatggcatttgaaatgcatattttcaaactaggtagatgaatggtttaaatataaaaattcattcaaggccctgagctatagaagaatatcttccaaaacatgcattcaagttctatctgtcagtgtttttctttttgcatcaataaggcagcaatggaatacaatcagatttattttttctttattgctgtctacaattcagagatataacctgaaaaatatgttgtctcttcccaagtagatcttgtaattctctgaactgtgatccagaccaatgccgcctttacattgggtctgtggaagtgggagggtccactgaacctggttatgagaggtttcaaattgaaaagatttacaagtatgtaaataaaatcaaatagtcaattagtatctaacatatacatgtcaaaacacatagccccaatctcataaaatcaaagagatctacctaaatagatttgtttgcctaacaaatagcaagaccactttgacagaatctttagcatgacagtgattgtcaaaatgggtaaatggttattattgcccagttaagtaatttctgatttgctttgccttgattactcttaataaactaaacttaacataccatagaagcaatattttttaaaaagagggtatattctagagctagatagggtgttgtgcaacaatgtgaatgtacttactaccattaaactgcatacataaaaagggttgaaatggtaaattttatgttatatacattttaccaaaataaagaaaagttataatactttccgtagcatatataaaaaagaaacagacatttcatagcaaaaataggataaaaatgatattaaattcataggggatttctcttatctaaaactttagatttgattcttagataagaatataaacacattgcaagaagataaatcaataagccaatgaagtaaggtggaataaataaatagaaataggtgatacttgcggctctgacagcatctgataataatagtacaaacagtttcatttcatttaacagttatttgatgaactcctgtgtgctaggaactgttatttaaaaaaagtaacttttattttaggttcaggggtacatgtgcaagtttgttatataggtaaactcatggctcggggcttggtacacagattattttgtcacccaggtactaagcatagtacccaacagtatttttttttccgaacctctcctcctctcaccctccctcacgtaggcccagtgtctgttgctcccctctttttgtccatgtgttctcattatttagctcctacttataagtgagaatatgcattatcaggttttctgcttctgtgtcagtttgctaaggataatggtctccaattccatccatgttcctgaaaaggacatgatctctttctttgtttttatggctgcagtgtattccatggtgtatatgtaccacattttcttcatccagtctaccattggtggacatttaggttgattccatgtctttactattgtgaatagtgctgtaatgaacatacgcgttcatgtgtctttatggtagaacgatatataatcctttgagtatatacccagtagtgggattccttggttgaatggtagttctgtttttagttcttttagttctgtgtgtgaaaacacaccagagaacaaaattgaccagatctctgccttcacagaacgttcattctactgtaccagttatttcatgaggaatatgaatactgttattactctctgcccatttcacacatgaaggagcagaaatggagcagagtttactaatttatctgttgcagatagtagctaattgtgtgccaggtgctgttccaagcattttacccctgttaactcagctgagtgcttttattttccccattgtatgcccaacttatggatgacagcactgaggtagagaaaggttaataacatagaatagtttagtattagggaaacaatttgaattctaggacacttttactgaaacttagcataggctaaagaagtgatcgtgcatgtttaaagagttgtatcattttatcattatttgactttcttttccaaaaaaaacaacccttctcctttctctctcttccatgtgacaaatacatgtctgtatacatacatatatatgtaaatataaatatatataaaaatatatataaatataaataaatatatatatatatatataaatatatatatatatataaaatttttttttttgagatggagtctcactctgttgcccaggctggagtgcagtggcatgatctcggctcactgtaagctccgcctcctgggttcatgccattcttctgcctcagcctcccgagtagctgggactacaggtgcccgccaccacgcccggctaattttttgtattttttagtagagatgggctttcactgtgttagccaggatggtctcgatctcctgacctcgtgatccgcccacctcggcctcccaaagtgctgggattacaggtgtgaaccaccacgtgcgacccacatgtctgtatattacagccgttgaaggacacaacttttgccattgggcgacccagtcccctagtaagtgttcaaaaatattcgctattatcattgttggtgatttcgaggatttggatataattaatttgagcctaattttttaagactattacataactatacaaaaaaatcatgagagagcctggaattttgcaaaactaggatagaaaccagtttctaaaaagcattttaaacattcagcttgtgtatttcttttcacttgtattttgtgatctgcctccatgctttcatgcctttctcttcaaacaatcttattaccactaaccaaaaacaattaaaatttgattgttttgtttttacatgttgttacagttaagaaaaaaaaattctaggtattgacccctgccagttttcggagttaatactaactagtgatttggggctacatttaagtgctttaagctatcctacaagcttaaagtagttatacatgcaaatacttaaatgaattaggtacaagaatacagaggtaagaaatagaatctattgtagaataaatcctatttcagatgtgactgttttaggatttgaatcaaccacatattacagaaaaccccaagataaagccttggcataaccaagacaaagtttatttttttctctcacataaaattagtccagacttattttaccagtggtatggcaactccacagtcaaagggacccaagctcatctgaccttcgattcccttatcctgggacaggcttacattctcaaggtcgactcctggcctaatggggctactggagcttcagccatcacactctgtgcttcctgttatatctactggtcagaacttcagatacatctgtctaaaaggaacgctgaaaatacagtctttaagctgtgcaattgtacctggaataaatgagttcttttaataaaaagagttgaatggatatttggtgggcaaatagcagtccatgctacaataataaacttcacaattttagaattagatatcttgtaatgaatattctgacgtggtgtcaacttataccatagatagattataactttgaaaaggaattagaacacaataataataaattcacactaaggctcttttggggaaaaaaaatctctaccatttattgagtgtttattatcttcacaacatccctatgagttagggattatttttgtggacattttacagataaagaaacagaggcattgagatgataactagcttgactaaggagtggcggagctctgggcagtgtggttcctgtgtgcccataaggccattgcacaatgctgcttcatcatgtaattcagaaagtattgcaggatgtggcagttggtcatcatgaatgttcattgttatcttgtggctttgtgaaaaattctggtcattcaaacgatttgactgttgagattctgtgcacatgagattgtactgtgtacatgtttctaaaaatgtgtgttatagatcaaaatgcacacactcatttacctctaagaacagttcttatattgaagggaaattatctgtacgtgagagaacaacgtggttttgagtacaagtggtgaacagacattgaatagttgttttcagaaagcatcactcccctgtacctcagaacccagcctcagtgctggttgcgagccaacagctttgatgtcctgaagtttttgcatcacttctcttttgcccctctttgggattcaaagatgataagtttgaagtggagttctaccgcttccattggaagagaaaaagtttccgtgtgtgtgtgtgtgtgtgtgcgtgtgtgtgtttacggagaggagttctatgcatctgcagagggtgctgccatcaacaaggagaacagagtgggatgaagggtttgggaagccaggatgggcatctctgacgagctccagaactctccacctaagtgtgcaagtgtaaacactccctgatgtgtgaactggccatctcaagactaagtatttagcaggaaatgccccctattcaacccttgccttctcaggtgtagaggttgggttgtctcttccatctttgtttgaattatgtcattaatcaaccttagtgaaagatcacttagtcatttgtgacagcataagttcttaattgttaggaatcactggtgcggcacacatctttttctatccatgaacaacgtcaaatgcttattttctcatgagcttttattttttccttttaaaaaaagtttcttaggataaacacagcctttttccttgtctctcccttgccctctcatctttttctcaatctttatattcctatatgtcactgaagagtccccgtgccaacgctgtgcagtgggaggctcctacctccaccagcttttgaggaggttgtagtcctgcaaccttagaggttccacagccaagctgggggtctttctggagcatgggtggtgaatctgagatctatgcacccaggaagcctgacacattattgtggtgtctcaattcttttttttttaattagaaaaattgtatcaaattgcatttggtgagagcaaaaataaactgaagttggttgagctttggaagactacaagccactgtaatatttaagatttcttgacctccagaactaacatttgtcctgtcagagaaaataattactcctgttgagaatacatgcattaaagtaagatgttcactactctatatgatcaccaaacattaaataatatgttttacacatgtatgtactatgtgttcaagtgtttataaatccatggagccaatagaatgtaagttctatgagggcagaaattttaatccattttgttcctagaacagttcctgacacatactggtgttaggggtaggtcttcagattttatggatcaaatggaatctccacacttaaaaaaacttagagaaaaactgccttaatgtgcccatagtctggttggaaatggcagctccaggttcattgattgctttgttcattcggcacttttcactggacatgctatgagcccagcagtgttctgggtttttgggatacaccaagccctgcctccccggtgcttaacattctagtgggggagacagaaagaaagcaaacatggtggacaacttaattatctatttttgaaagttgacaggaactgtggacaaaagaaaacaagagctggagacagcagtgccagggcagggtgagggtcaagttagagtaagcctcattgagagatcttttgagcaacacctgaaggaggaggtgagaaagttagccatgtggagggagcagcattccaggcaagtggcccaccaagtgcagagtcctgacagcaagagcagttctggaatattctagaaacaggaagaagaccaatgtgactagagcagagtgaggcaggagtgagagaaaatgtgatcaggaaagtaaggtcctgtggccactaagattttggcttttattctgaaggaaatgaggactcattgcaggactttgagagcatgatctgacttgtcacaagtgttctctttgtctactgggttgagaagacatccaaagggggccaaagattgaggcagggagagcagctaggacaggctctagcaatctaggtgataaatgaggaccgatggtggctctgacaagggtggtaatggagacatggtgaggagtgaccacatttcaaatatatcttgaggtagagctgacaggattttcccgatgggctgggcgtagtatgtgagagaaagaattcagttatggatgattattttgtcctgaacaatgataaaagttgagtcaacaactgatatggggaagtctacaggtggaacaagtttttgaggaggaaatcagttcagtgttggctatgttgaatttgagatgtttttagaccatctgagtggagaaatctggagtttaggagagaggctggacttgatatgatgttatgggtcctcagcatagagatgatgaatgagattagcaaagtagtgagtgtaaaaaggaaagggaaggagaccaaagattgagccttgggacagtcagaaagaagagagggaacccgcaaaggagattgaaatggaatccatctcactgtggcatcgtgaaagacaaatgaagatggtataagatgaaaaagtgatcagctgtatcaaatgctgctattgggtcaagtagggtgagaattgataattttccatcttgtcaagagcagccgtgatagagggagggggtggagatatacttggaatgagttcatgaaaaaatgggagggaagggattagaagcagcaagtataagcagctctttcaaaggagggagatggggaatggctactgggatgccatcacatagataggaaggtggaaccctgtgcactggaggagggagtgtcctcacagaggaggacaggcaggaaggtagagtgggctgctttgggcacatgtggttctgtggatgttctcttttgacagcttcagttcttcagggaattgggagcaagttcatcagctgagagtgaacatggggcagacagtgtgagaggtcaaagcggcaagagtagttgtgccacagtcttttaggagagagggaaagtaaatggaatggggaaggaaagtaaatagcatggctgctgagctgcgttacaagcccacccggtgttgggttgtgaggtgtagttgtgggctcttcttcagtcggattgtcagcatgggcggctggcagagagttgaatctgacagggcagcagttctggaaaatgagtatgatgagtcaagaaagggaccaggaagtggaaactgtgtgtgaggcagtgatgctgatgaatgactgtggaaaacaatggaggtgaggagggagtggatgttgagtggctaggggacagtgaaaagggagtaggatccactagcttgctgcttgtctcttataattaggatcaagagcttctgccgtcttctaggcattctgctgcttcaagggagtctctgagattgggttctgcatggatgtattgaaacatgcacctaggtgtgtttggagtcctgccagagacctgctttctctttattcttatcctgaggccctttaggaggctcagatggaataatttttatggtttcttaaaacccaagtgggttacctaagccatcatagttctgccccctgttccctgagaggaccacgggagcaccctgaaatgggttttccactctgccatcccccacttgcctgcttgggtgttgacctcagccatctacacatatcccggatgtagtgttgggcccctggttgatgtcattccttttcaaatgggatcttttactacagcaatccagcaacaaactaaatagcgatagagttttctttcccttacaaaccacaaccacaaccaagggaaaaaccaaaccaaaccaaccaaacaaacaaaacaaaagtatgtggcttcttaccacagccccctatctcgcccaagccttgtggctctttgatctctggtgttctgaaattgcgtaatcatgtgcttgctctttttcattcattgtgctgggcacacacttaatggaccctttcaagttggttttcttttatggggtaagggtaggcaggactattttttaagatttcttccactttgtcttccaattgttctaatgagttttttaaaattgtgcctgtcctgtttttaaattccaagagatattctttgtcctctaaatgtttcttataaatatatataaaatgaataatataagcatatagttttgcatagatttgagttcgctgttacagtgtccttttatttctctgaggatattcattataggttttttaaaaaacactttttctggtccccaaattatctcttctctctagacttcctccattcatgccttccttcccccctccctcccttcctttgctcttgctcttgattttggaggcttgtcataaatatttgaccatccattcattttttaaccataacgaactaaaaatgttaattggagccctgtgtgttccttgagcagaatgtttggattaatgagcttccgtgcaatgttttctctggaatggattaatttctccagatctataatttttcaatctctttccagggggtaaaagcctggttgtctgtttcatgaaagtaaaaatgtgggtaagagtgatcccagcattcagaatgcagacttagtagctgcttgttttcagtcctgggacttcacccaccctcaccacagttggtatcccaaagtgtgaaactccttagattatctttctcaagaaaatgaaactcagatattcgtgtcctttggccatttttgattagcttatttgttttcttccttttgaattgtttgaattccttatgtattttgaatattaaccccttattagatttatggtttgcaaatattttcccccactctgtgggttatcttttcactttgtcaattgtttactttgctgtgcggaaagctttttagtttcatgctatcaaactaattttgcttttgttgcctgtgcattcaaggttgtatccaaagaactcattgcccagatcaatgtcatggagcatttctcctatgttttcttctggtatttatatagtttcagtgcttttctttaaattttaatccattttgaatggatttttaatagggcataagtgtcacttccatttttttatatgtggatatccagttttcccaacaccatttattaaagaggctgtcctttccctattgtgtattcttggcacttttgttgtaaataagttgatcttacttgtgcgggtttatttctgggccttctaatctgttccattaattcatgtgtctgtttttatgccagtatcacactgctttgattacaatagctttataatatatcttgaaatcagagagtttgatgcctctagctttgttctttttgctcaagattgttttggttaattggggtcttttgtggttccatacagatttaaagattattttttctatttctgtgaaaaatggcattggaaatttgataggaagtgcattgaatctgcagatcactttggatagcatagattttttttaacaataataatttttccactccatgaagaggtatacttttttcatttatttttgttttcttctatttcttttatctgtgttctgtagtttttagtattcaggtgtttcacctccttggttgaatttaccccaagtattttgctgttgttgctattgtaaatggaattgttttcttaatttcctttttggataattctttattattatatagaaaagctatggatttttgcatgtttattttgtatgcttcaactttactgcatttgtttatcaggttttaacagttttttgataaaagttttggtgttttctgtatatatgatgatgtcatcagcaaacagagacaatttcatttccctattttctttctttttttttttttgagatggagtctcactctgtcacccaggttggagtgcagtggtgcgatctccactcactgcaagctctgcctcctgggttcacaccattctcctacctcagcctcccgtgtagctggggctacaggtgcccgccaccacgcccagctaatttttttgtatttttagtacagacggagtttcactgtgttagccaggatggtctcgatctcctgacctcgtgatccacccgcctcagccttccaaagtgctgggattacaggcatgagccaccgcgcccggcccctattttcttaatcacgcgatatatacaggcttgttgaaaaacatgaaaatgataaagaagtttatgtattaagaggcaaaagctatgatgttcaactcctctaaaaccacttcttagtaggtgaacattgttaaacagttttgtgaatctgcttccagattttttctaggcatgttcatacacatatacacacataatttatttttacccagttgcgatcatgtatcatctgatccaaaactcgctatttttcagttaatatgcagtgactgtctttccaaaccatagtatatatatatatctctaagaatttttcaaatctgctatagtttttaaacatatttattgttacatacatatgtgtataagttacttatttgcttatttctttgaatatctttgtctagctttggaatcacataaataatgagtacaaatggtaaagaaatttcatgtggaaggatatatagaaaaagtacaagtctctcttctcatccactctatctcattacctaaaaggttatccttagagctttatataatacatccctgaagtttagatcattttattgcctcccaattgttgagagtaaggaatttagtacatatacctttcctttcactttcctaccctctacctacttaatgagttcgattatagtttttcagttcacccactgttaaataatatacctatatttataatatacctatataatatacctataataaacctatatttttgacttatcaactttggacatatctattggtgacttgtgatgagagatgaaataatttgtacatttacccttcttttccattcttttcccctacccattctcccctttttggctaaatgattgcttttaggttgataaggtttataatagctactgttctgtggttataaaatttgtttcatattttatgtgaaatttgattatacaactagcattcaaaacattattatgtaaatattagttactgtaatcacacagtgacgctcaaggaggtatttactaagcatacagatcattccttctggatccaactcagcagttgctttgctgtgccttacctcatctttcgtggattccttttcttttgattgcaatatatccttgagtaatttttcagaatcgatatgtactgtctgaactctcttatacccaaaaaatttgctttcacatttgctaatagtttgacagagtatcaaattctgctttcaaattctttccccttcatggctttgaagatactgccccactatatattctaaaatccattgctgctaatgagaaattctggtgtcactctgactcttatttctttcatatcacttggcattttcttccgagaaaatattacttatcttcagaatgatgaaccttctctatcatgtctctaggtgttagggcttctttcatttaatcctgtaggtcctcaataggctttttaattaaagtctcattttattcgggctctgtgaaattttttgttatgttttggcttctttttctcttttgttgtctctcttttctccttgaatgtctttctgatagatatagcattcccattatctatcatgtctttcagattatcctacatttttctctttgttttctttttctaccatgtttagaattctcttacacgtaagacatcacttactagatcttcagtcatatcctttttattattcagtctgtgcatttttaattttcaattttggcaaccacatttttaatttctaagaatctattttgctaatagtacttttgtcctgaaactttttatatcctgcaatatttagaaagagcacacccttatccacagctgattaggagtacactctgaatgcagggcacgatgggcgaacattttgttactggcctcctcaagcctcaatgcccagaagttattgcctccatcagaaacccttcttttgttctatccctcacttccaaatgaagttccagcttaatttttgctgtcactgtagtgggacaagcaaatccctatttcacgtgatcattgctcaaacctctattgacaatcctgctttgcattcccttatttagagtgggatggaaaataaaggctatgaagggggaagaatctgatcccaccattctcctttttcattgcagttttctccttttttatggatgcaataagctgttgcaatctctcaggatggaaaagaacattttaaaactactctactgccagaatgatctcttttttttaattatactgtaagttctgggatacatgtgcagaacatgcaggtttgttacataggtatatacgtgccatggtggtttgctgcacccaccaacccatcatttacattaggtatttctcctaaatgctatccttcgcctagcccctcaccccttgacaggtcccagtgtgtgatgtttccctccctgtgtccatgtgttctcattattcaactcccccttatgagtgagaacatgtggtgtttggttttctcttcctgagttagtttgctgagaatgatggtttccaacttcatccatgtccctgcaaaggacatgagctcatccttttttatagctgcatagtattccattgtgtatatgtgccacattttctttatccagtctgtcattgatgggcatttgggttggttccaagtctttgctattgtgaatagtgccacaataaacatacgtgttcatgtgtctttatagtagaatgatttataatcctttgggtatatacccagtaatgggattgctgggtcaaatggtatttctggttctagatccttgaagaatcaccacgctgtcttccacaatggttgactaatttacactcccaccaacagtgtaaaggcattcctatttctccacatcctctccagcatctgttgtttcctgactttttaatgattgccattctaactggcataagatggtatgtcgttctggttttgatttgcatttctctaatgatcagggatgatcagctttttttcatatgtttgttggcctcacaaatgtcttcttttgagaagtgtctgttcatatccttcgcccactttttgatggggttgtttttttttcttgtaaatttgtttaagtaccaaaaacagatacatagactgatggaacagaacagaggcctcagaaataacaccacacacctacaaccatctgatctttgacaaaccggacaaaaacaagaaatggggaaaggattccctatttaataaatggtgttgggaaaactgactagccatatgcagaaaactgaaactggaccccttccttacaccttacacaaaaattaactcaagatggattaaagacttaaatgtaagacctaaaaccataaaaaccctagaagaaaacctaggcagtacaattcaggacacaggcatgggcaaatacttcatgactaaaataccaaaaagcaatggcaacaaaagtcaaaattgacaaatgggatctaattaaactaaagagcttttgcacagcaaaagaaaccatcatcagggtgaacaggcaacctacagaatgggagaaaatttttgcaatctatccgtctgacaaatggctaatatccagaatgatctctattttattttttatgacatattaatcatgtttgttctcttgtgtcctctctttctttctctcgattttccagtggtccatggtggtctatttgtagggttcatatttacaaatgggagtcaaggtgactccactacagttatgtgaaaaagtttccctgccatgcctctccctacactgggcgagctgatctggttccgggtcagtggatggagcatttcctctcgcaggcacaccttcaggctggtgggagcaacttgggccatggactggaaccatgtcaatggagaagacttcctctgtgccaggtcctggtcagagctgccgtcttgatttatttgtatccctctttccgtctgtggtaaagatctggaggttcttaagctctctctggcctcaaaacccacagcaggaaatttcctcactcagatcacccacatttttagcaagcagagcttcagttttgagtggagggcaggagtattgggcagtagggaaggacacagttctctacgccgttctgaatgcagtgcattaataaactctcttcacagttgctccagggtgctttgcattggtgaacttctggcttccaggaagaacctggttacctctgatgtgttgggttgttgttccatctactctaaattctgtgccaatccatcccatctgtttcctaccattggtttatttttaaaaaatattttatatttatgtagatttatgaacttgattattataccatcattagagtttgggtccagagtcaaacttctataaacctgtaatcaaaaattggcctttattttcatgtagaaggaagtagcagaccaaaatggagttctatattccatttttctaaatgagccattgagatgtagagcaagcaagtgcccttttgagggaatgtgtgtgtgtgtgtgcacacatgcaagggcattttcccatgtctcccatcctttaattattccagtagacagtgggccagcagcaggtggtggcataacttctccatttgcagtgctgtggctgtggtgggatctgaacaggaggcaaccttggcaacagtaggaatagaatgtggagtcagcaggaagcgcttttccctcccacttacctgtcttcttgtagcagacagcagtgcgggcagcttcggctgacttgcttagcctgtttccattgtgagcataaacaccttagacgttttttcatttcaggacactggagcttgatgaaattaaactacactcattgtctcaggcaaatctcctaatcctattctgtgcttttgttgttgttgttgttgttgttagtggtgtgtttctctctccacttcgctttccttttaaaacacaacaaatttttttttttaattttaaatgaacttattcattgcctccctatgtgtcccctcctttctagtgatattgccgctgttcattcccagctgttcttgattcttgtacaagactctttgctgggcttctgccttctagacgcttcaccttcccgttatttcttccctctgcccccggaaaggcccttaccatggctctgatgatgatgacagctgacccttttccaaggtggaatccacgtttgattctctgatcttgtactggcttagcacagtgctcggcattcagtaaataaggttaaggaaggccagtgatatagagtagtagaaaacagcagttaatgaaggcttgctttctgtcacaggttcctctcctccaggactgcagcatctctgtctttctgtcgtagcatacaagacagcatctctgtctttctattgcaacttccaggtgagaagccctcccacaagcatatacaaattttatggaaacagacaaaaatttgtagggaagcaaatcccttcaaggttgagtctttctggtcttctagaaggtaagcttggtgatggggcagtcacagccctagtgcttatggaacttggccctttggggacagatctcagttaactaaagaaatgctatggcacagagtaccttgaatctcctctaatttatgctgtacagggaattattcacactttattgttaataacacattacatgggggaacaccagacagctgaccaggactcctgtgcttgaaagcttctgctcttcagcagggcagccagcctcttctcggtttagcacagagcttttattctcctcgctctctctaaactcctgttcaagacagtttccaattctgttgaattcactcatttacctcatctgtgcctttccccacctcattctctccccttcagagtgcccatttctgtgtttcaaatcccacaaggccaagcttagatgctattatgtctatgacattctccacctctatcccaataaaaacctttgatttcatcttgctgtttgtatctttactctgttatatttcacccataccagagttgtttgtggacatgcctgatttccttcaggctgtaggcatatttgattcatttttgtactccatgagtgcctaacatagcatcttatacaccatagataattaatagatgcctcttggctgcatttgtattaaatttttaccatgtacttgtcctagctagcagagacttggggggaaataatgatgactgatttttacttatttatttattttttattcccacaggtttttgaggaacaggtgatgtttggttacatgaataagttctttagtggtgatttctgagattttggtgcatccatcacacgagcggtgtacactgtatctagtttgtaatttttttatccctcactcctttccctccctttctcccgagtccccaaagtccattgtatcattcttatgcctttacatacccatagcttagctcccacttatgagtgagaatatatgatgtatggtttttcattcccgagttacttcactttgaatagtggtctccaattccatccagaaccctcaaaaccatgcaaaaccgtggaaacaaaatagcctgctcctgaatgatcattaagtcaacaatgaaatcaagagagaaatttaaaaattctttgagctgaatgataatagcgatacaacttaccaaaacctctgggatacagcaaaagcagtgtcaagaggaaagttcatagcattaaatacctacatcaaaaagtctgaaagagcacaaataggcaatctaaggtcacacctcagagaactagggaaacaagaacaaatcaaacccaaacccagcagaaggaaagaaataacgaagatcagagcagaactaaatgaaattgaaacaaacaacaacaataaaaaagataaatgaaacaaaaggctgtttttttgaaaagataaataaaatggatataacactagtgagattaaccaggaagagagaggatccaaataagctcaattagaaacgaaacaggagctattataatcaataccacagaaatacaaaagatattggaagctactatgaacatctttacacacataaactagaaaacttaaaggagatggataaattcctggaaatatacaaccctcctaggttaagccagaaagaattagaaactctaaacagaccaatagcaagcagcgagattgaaatgataataaaaaaaattgccaacaaaaaaagtccaggaccacacagattcacagctaaattgtatcagacattcaaagaaaaattgataccaatcctactgaaactattccacaagacagagaaagagggaatcctccctaaatcattttatgaagccagtatcaccctaataccaaaaccaggaaaggacataacaaaaaagaaaactacagcccaatatccctgataaatatagatgcaaaaatccttaacaaaatactagctaagtgaatccaacagcatatcagaaagataatcaactatgatcaggtgggtttcataccagggatgcagggatggtttaacattcacaagtcaataaatgtgatacaccacatgaatagaattaaaaacaaaaatcacatgagcatctcaatagatgcagaaaaagcatttgacaaaacctagcatccaattatgacaatttttaaatatggggaatggtcttcatggaaaagtagatgttaatggcacctgtattagggttctctagagggacagaactaataggatagatgtatatataaaggggagtttattaagaagtattgactcacacgatcacaaggttgggttccgcaataggccgtctgcaagctgaagagcaaggaagccagtccaagtcccaaaacctcaaaagcagggaagccaaaagtgcagccttcagtctgtggttgaaggtataagagtcccaaagctgaagaacttcacgtcagaaattcgagggcaggaagcatccagcatgggagaaagatgtaggccagaagactaaaccagtctagtctttccatgttcttctgcctgcttttattctggccatgctggcagctgattagatggtgcccacccagattgagggcgggtctgcctttcccagctcactgactcaaatgttaatctcctttggcaacatcctcacagatacacccaggagcaatactttgcatccttcaatccaatcaagttgacattacatattaatcatcacagcaaccaaaagattatctcatttaatccttacaatagctctgtgtagtgggtatatattttccttttgctgaagaggaagtaggcttagaggggttgagtaatttgcccagaatacctaggtagtagaagatagtagagccattatattctgtctgcattcaagagtgtgctgctttatttgttcctgaattgcacacaagctaaagaatacaactggatgttcagtctactcctattttgataacttggctaactttactgcagagtctgcagaggtgaccaattttactctgggagataccagggaatccgccatgtaattcctcaggctgagtgttttggaaacacaaagctgtcactgctattaagtgatgttttttcctgagagtctactatgctcccagtaccagcctccgcaggccctctgtctaccccttttctgtcctgatgtgttctagcaggcactgagaaagtcattgtagaagttaccatgactttccaaatgcttccagaagcagaacacaatttcacaggagggccaataagtatgaatgccaccttgatagaaagtgaagttttgcgtcctgttgaacactcagtaaatgcttcctgaatagatgcaggattggcaaaacatagctccccagctttcataattcagactcagaggcccttcgtgctcctgttattcttgttacttcatgtcaggtacctaaaagggttgtttttcagttttcgtcattgatttaaagcagaggttagtaaactttttctgtaaaggccaggtagttagtattttagcctttgtgagtatttggtctcacaaaagcagccatagatgatatgtaaatgaatgtgcatggctgtgttctgataaaactttatttaaaaatgaggggtcatctgggctgtggtttttcaacccctgatttaaaacaaaaacaaaatgtgctatgcctgttagatgctactacatttgattctgtgttttccatatttttctaaaatgtactgaacaggaaatgaacaaactgatgacacaatgatctaatttaatcattgagataagagtggcgccaactcttattgagtatttgttatgtgtcaggcacttggctaagcactttacatgttttctatgatttataaagcaaatattgttattatcttcattttttgctgagggaaggaataaagtcacagccagcttacagaggctgccggaggtcacacatcaccagtacactgaaacacgtggtctgattacaggatccatgatctcctgtacagatcatagtgatattgacctgagaggaaagagcctaggacttacaatcagaaatctgggttcacatttcaactccgttccatgccaaattacattaaaactgggcctcagctttcccacctgtgaaagaggaataatactaggacttgccctcccaaccttagagattgctgtgaggataaaagcctatatgaatgtgctttataaactataaacaccatacaaatgtttgttataagtctgccatttgaatacatcttagtctttttttcctatgtgaaataaaacattttaagacaagcaatgaaattcttgaaactataacaggtttttaagggtgttgatccccaaagccgtcttcactattttgctccctctctgactcgctctgtctctgcctagcagcgctagtcttttctacgtgtttgatctgttgttcctgtgtttaggcccatccctactacacagcggaagtcagctattttttctctttcctttgctctgctgagcaagattaaactcttttcacctggacttttcctagattactcaggctgggtggaaatggggtagctgtgaggctgggatgttactgtacaattcaaatttatgatctgaacttaactagatcttgctgaagattgacctggctagcacagttttgaggcacctatctttcagtcccttctgtcctcttggcctggccactggccacatgttagtagcttacttctaaggatggaatgccatgcatctcctacaaggttgtctctatgcttcacacaaagtaaaagaatggaggcaactttgaatgctgctcattttcactcaggcaatccctttacaatattgtgcttagtaaactccccccactctttttttcccttagcttgttttttttttctaataaaagtctatatcaatttgatgtattagttagggttctctggagaaacagaaccagtaggatcaattgattggtcaatcaatcaatcaagacaaaaagagattcatctggaaggagttgattcatgccattgcggtcattggctagtctgaaatctgtaaggcaggctggctgactggaagctcaggcgggatttctctgctgcagtctcaaggcagaattccgtcctcttggggaaacctcagtctttgctcttaaagctttcaattgattggatgaggcctacacacattatggagaataatctgttttacttaaagtctactgattgtaaacattaattatatttaaaaagtactttcacagcaacatttagactagtgtttgaccaacaactgggcaccacggtcaagccaagttggcatatagaattagccagcaaacttggtattcacaatctgtcattatagtcttatctataaacctaaggtttagagaaacgctggtcattctgaacaattccctgtgaatgcagagatcaaggagcctccccttaactgggtaggcagtgtgaaatacctgcagtgtacttgaccttactgttcacccactggcagctgttcctacagcttggcttcagatatataatattacattggctaacttcaaagagcattgttttccaaggatagagatggtgatggtgtatattacttttaccagccccagacctgtaagaggttctcatctcttttgtttaagattttgttgtttttttttaatgctcaataaaagaagctttattctttcattaaaaaacaaatctcagaagaacagggaagaagagggtagcctatgaaagtgtgattgttatttgataccatcgtgacttagcttgttttcacctaagactctgagattctattctgtttatgtgagatttgggctgagttcaactactatccatattaactgaatcataaaacaattaatccatcatctggttacattttggtggggagggagcatttaacacaacactaagccacatatttcactattttttttttttgcagcaaattgacttaactgcttgctttcacaccatgcctataaaacctttttggttttagaggttctatgtgtctggaaagtacagtgaagtatctcatcagaatagtattaatatttcttatgacatttcatatgtcctgatatgggttaatggagaaatatcataagagtagtaattctcttgctgttattatttgtcctatttagacaaacagaacatagaattaataagaattcaaaaactttaatcactgatagagattaaatgatgtttatattagtcatcatcacctaatatcttaaatatttaaccttttatgcagtgtttgcctctctacttgggtatgcccttaacagtaaaaagtgttgataatgctctcccttttggcactcacagaattgctatacatatatatgtataaaatatatgtaaatataaaaatacatagttaaaaaaataaatctaccactaaatatagtaagggagttttaaactgaggtttttgaagtctttaagaatttatttagagacttcttttgttggaagtatggtggctagatgccatgaaaaacccactgaaaacaagtgtaagtgctaggtaatatgttgaaacatatcttttgaaatgtattactgagctggcaagaaagtatgccattgtagagagtgaaaataagtgaaggcagaatcctgggaggtaagccagcctgaagatattgatgacactggatggccttaagtttccattttgactggcatgtaatccagccaaagattcccacagaaatccgaggttccaaatggtaaatccgtggtgacattggggtgaccgagaaatgaactctgtgcagaaaggaatggtaacaacacttgtctcgtacaactttggctctgggtaggggaaaggaaaacagcttcctagagaaatgttaaccacaagctagccctcatgagagatttcagctaggatggatgctatctgtgtagtgcaaaaaaaaaaaaaaaaaatccatagccagattttgtgctttaatgtggacctaggtcaatagtgactgcaaagccagaagcagtggctcacccctgtaatcccagcactttgggaggccgaaggaggtggatcgcttgaggtcaggagttcgagaccagcctggccaacatggtgaaaccctatatctactaaaaatacaaaaatgagcctagagtggtggtgggtgcctgtattcccagctacttgggaggctgaggcacaagaattgcttgaacccaggaggcggaggttgcagtgagccaaaatcgcaccactgcattctagcctgggcaacagagtgagacaccatctcaaaaataataataataaaaaaaagtgactgcaggggactgggaagaggaaacacaaatctttactggggaatggaatttcaagtgtatgcaccaacccttagaaatcacaaaacatctgacccttctgaaaataaccaccatgagtgagacagcaggaaaaaaaaaaagaaaaaaaaaaaaaaaacaaggaaagagagggacaatagaatcagactcatacctacaaaacttaaaaattaaataaaatgaatcagactcagaggcttcagagtttgatttaaatacattatacaaaagttctgtgtgaaatatgtttaagatgtagaagggtgcttgaaatgcacaaagtcaacagctgaaaaattgaccaagcagatatgaaaataaaatccaatagagggcatctggaaataaaaaagtataataattatagtgaaaaaagttattagatgggttaattagtagaatggatatagcagaagaaagatttagtcaactgaaaaatatatccaaagaataggtccagaattaagcttagggagataaagagatggtcaatacgaacattaggagacatggagaacagtgtacgaaggtgtaataaattctaactggagttaaagaggagatagtaaagaggaagaaaaaacacaaaactcaaaaaatgtagtggctgagaatcttccagaagtattgaaagacaccaatccacagattcagaaacctacaatttgcaagaaaaagtaaaaagaatttcacaccaagatccatcttcatggactggcagagcataagagatgaagagcttatcttgaaaatgcagccagagagaaaaggtctatcgcagttaaaggaagaggcaagcagatgactgagttctcaatgccaactgaaaatgagaagccagtggcacaccttcaatatgttgggagaatataattttcaacttaaaatagtgtacattgtaaaattacatttcaaaaaaagagggtagtataatgacattatcaaataaaaaccatcccttataacaaatatcactaaagaaactgttggaggatgtagtttaggtttctagaaaggatgtctgatatgcaagaaagaatggtaagtcaaatattgagaaatatgtgaggaaatagaaacaagaataactaatgaatcaatgatactgtctaatttgaaggttaaatgattaggtagaactaaaatatgaaacaataatagtatgtaagtcgggaggaggaggatgaagcttgaagtgctctatgcatcttgcatctctggtgtctttcttgtgtccaaactttttcttctttcaaggacaccagttagactagattagggtccacctaatgacctcattttaacttatttgcctctttaaaggttctatctccaaatacggtcccattttgaggcactaggggttagggtttcaacgtataaattttggggggacacattccagccgatagcaattataaatacaacttttatagtaaaagcccatcttctagaacaggtagagaacaaggttacttattttttttaagaacaaaattggtttaaattatcctaaaatgattttaggagaaaatggacattaaatatacaacatttcctcctttattattttattgatgacttgatatgttttttaaaactcagtaaaataaatgattagtctcataatcataagagagttatgcccttattttaatgccataaaactgtgacttctgaagaaatacaatcatataaaatcatattttaatttacttttgagaatgtacagtaactcaggaaggcagagtgtggaacctgctttaatgaatagataagaatgactagcaattaaaaattaattatctataattcttctgaagttcttgaaaataatctcttctaacctgggtaaatattcctccttttcagaaatgtttgcaatgttgcttttttttaaattaatctctttttcttagataatggaacataaatcttaggcacatttgctttgtaaataccaaattgcacacagattaaaatttaatgagcttttactgctgtaatctcaacaagcagagtctttgctgttggtttttcaataagaaatactttattttgttatacagtggtcattaagaaccttaaagataatcaggacagattttccaaattgcataatgctattgcctagctatttgcatgtattttttttaaatgacaagacatttcgttaaatatttacttgcctgacgttgaaagatttagacaaacaatgtacttctagttgtcactttttcaaaaagattcttagggaaaagttagccgttttgttggttggtaagtgatgggttttcttggaacgtgttgcttgctaattttaccagagaagaaaataaattcaaatggtaagctacattccaatttgtattcttcttctaaagtcctccctgtttgcattctcggattttgacactcctacacaccagttaaagcacttgttagagtgtccaaaaaattgttgcaattaatttcccagtctcttctctctttgatgtgtcactataatgctttgagtaattttcagtgtctggcatctgttcaaggacaatttctggattttaggagggggagaagcaataaaggaaacaacatatgttttttcctaaataggaggcattttttgtttgtttgtttgaacaaaaatcaaaaactttcttttctatataggtgacaaaaagatacacgactcattggttgttaactaccattgcattcttttctctttggagtagcccttaaggaccagattagaccagccatctgcatcatgtagcatgtctgggttacctttcccaaaagaagttcagatagatgaactttgcaaaccagagccatctgaagtttgttttttctttttgagacagagtctcattctgttgcccaggctggagtgctgtggtgcaatctcagctcaatgcaacctccgcctcccgggttcaagcgattctcctgcctcaacctcccaagcagctgggactacaggcacgtgccaccacgtccagctaatttttgtatttttagtagagacagggtttcagcatattggccaggctggtctcaaactcctgaccttgtggtccacccgttttggcctctcaaagtgctgggattataggcataagccaccacgcccagtccatctgaagttttaaaatggctgcaggtatcttagtaggagactaattttattttccaatgattagaaaaaaatgaccagaccaagaactctagggttatgtttcatctcatatcctgtgcaggatgttctgagaagtttctatttgtatctgtggagtggttctagtcttgttcatcttgcattttaaggtttggaggtattttatcttgccttgcttctttaccaccttgctttaatttccccctatattgccatttctaaagtaatgactcattttcaagggtgggtctgaaaggaaagaaataataaaaccagagatctggagaagtttctcgttcatggtcttattcactttttaataagagcatctagaacagtgagtggtgccccagcagatatctggaaatttttgtggaattgaattgaatttgttcttagagtaaatgacaataaagaaaatagtattatggaaactttcgacccaagggaaatatcaaggctaaagttgctatattatttttcttctgatggatgctgagtttttctccttaaaaaacaaatccacatttaaacataaggcattgtttgatggcctatcacattcagtagaatggatttgagaaatacgtgtaggatgcctattaaaaactctgttttgaaattaaacctaagactataagattgtctgtttaaaaaaattattgctgctgtaatttgagcaaatctgaactatattgaactttagaaattcaaatgtatgcaatcttgtaatataacttactccatcggtagacatagttctttgtcccacctggcttccagcagtttgtctgtctgtcattaggctaaactcttcatgttcctaaacatgttttcctcaaaaggggacatatttcttgggtcagatgtaaacatcaagctaaggagttctgctgtgcgtctagacaaataaggttcattttcatcctctacatagtgttaaacttgaatttaagatcacacagattcctttacacgttaccaatgtaatgatatagacaatctcactttattcattcactctgtttaattcattcaataaaaacgtatacattggctgcctactgtgtgccagttggtgaagatataaagatgattaaggcaagggtctgtgctgacatgcctaatgggcaggctgacacacctaaacgccagggaaaaagagggatgagacctgggcctctgaagccctggccacctggctcgaagctcactttaatgtgcttctgggtgtattccatgactttttaaaggcgcttatgtttcctttctggtaaagcatgtttaacatgcaaaatgcttatttcattgagtagcttttaaaaagtgttcatagaatgtctagaacagtgcttgtctaatagaagtataattcaggtcacgtaggtaatattaaattttctagtagccacattaaaaagtaaaaagcaacaggcaaagttaatatttttttttttcctgagatggagtcttgctttgtcacccaggctggaatgcagtggtgtgatctcggctcactgcaagctccgcctcccgggttcaagccagtctcctgcctcagcctcctgagtagctgggactataggcgcccgccaccacacctggctaattttttgtatttttagtagagacggggtttcaccgtgttatccaggatggtcgttaattttaataatatattcattaattttaataatatattcatttagtcctatataaaaaaattagcatttcaacatgtaatcaatagaatatattattagtcaactattttgcattctttgttttgtaccatctttgaatttcaatttgtattttatacttacagtgcatctcaattttaatgctaaatgtcatcggagatattcgatctctgtttagctttaatatatttttgggttgaaaaagtaaattcacataaccaagttcttccaaatatacttgaaagtgtttctgataactgagttatcaacttaaaaatgtaagttaatgacaataaatgaaagaaaaattctgttccttagctgcactgaccacattttagtgttcaatagtcgcaggtggccagtggctatcatattggatagtacagctttagaatgacagttcagtgcaacaagtgctataatagactcatgaactggaagctccgggaagttaagaatgggatcaatgaagtgggtcttgaaaaaccaataaaaattcaccacgtagagaggaggagggcgactactccaattcaatcttttgaaagcatgtgaaggagcaacagtagacttctttaattatttaatagtaatttattgaacatgaattatgggaggtgcatggtgtgggtgctggtgagacatagttcctgagctcaagtagcttggtgtctaaatattcatgggcccatttttcagaaaggatggatatatgtgtgatcctgggtgtgccaaatgctgtggcttcctgaagcttagatttccagcttgtcaccttcaaggttaccttgtgaataggacttttttgagctgtaagtaaatttactttgcctatttatttccaatggaaaaaaagcttttttaaaaaataaatctcatcttattgcctatgattggccaagacaacatggcccatacagaaggtttttgatggcttctgaggtctgttatcatttgcttattggcatttcagctgtcaaccagggttctgtcaaattccattcctgcctttagctcttttacttgaatacctggggcaatggcagaagtggttgctatttgtcacctttccaggatgttagtcgtgtccttgagacaaatagaaaatttaaagtcagatgacttgattcctctgccagttaagacccttagagagtcctcagaatgttgcttatttttaaatttcaagtccctggtaaggatcaagtaaactccccaatttgcagatttctatccagttgactatggattttgcctgttgctttgtttccaccaactctccctgaagatgaggcgcacagacagacaactcacaggcaagaacagcctggtccatcttgaaagattctcaagactattctccacaagataattgtctacttttaaaaatattcagtaaagggaatttttgctgttatccttggttgtgtttttagtatctcatcatccttctagttgtaggaggcttttcctaacatctaacccatatgtctgttgtctcatcaggtgtttctattaaggctacttccccatcaatcttaattttttttttaatcttctgagatgtataggttaagttgaaatcagagactttcataaaatggtaagatggccatttaaacgcaactatgaggaaataatgtaagcaggattccattggagaaccaaacactagcaacaactaacttggtaatcaatgttgggacttgaagttaggctaaaatcaatagtaatggcactcgtatgtacaaatgcagaactttttacacacaatgatttttccctctgttattatacactagctgtgtctgagtagacagtccagctccactacctgcagtccaccctgggctgtgtaatctgagcactgatgggctgttatttgtacgtattacttctatgacactgttttttcatctgtgttagaaatgtctttctttcttgaataagctgcttcaatttcttatagacagattctgcttttatgacccttgtttctacaaagtaatctctactcatgctgaaatctcagacaattttaacaaatatttagagtacttaatttttctttgaattctaaatattatccttctttagttcaccatagttggatattttgagataactgtggaggaaacagcactgatcctggggccatgaaacctgatttcaagatctagtcccttctttaattttgcacaactaatttaatcacattcatccttaatttcatcatcattaaaatagcagagaataattcccgtttcatggagttgatatgcaatgaaatagcatatcaatgtatgtatgaatgtcccccaacatagagtactacacaaatgaaacgtgtcactcagcataacgttatgtgctccttcctgcaactggattgcactccagtgggatttcatgctggtgagatggctgtgctgctggacttcatgggacaccaatctttgaaaataagcctgatctggctgggcgtggtggcttatgcctgtaatcccagcactgtgggaggctgagacgggcggatcacctgaagtcaggagtttgagaccagcctggccaacatggtgaaatcctatctctactaaaaatacaaaaaaattagctgggcatggtggcatgtgcctgtaatcccagctacttgggaggctgaggcaggagaatcacttgaacccaggagatgaagactgtagtgagccgagattgcgccactgcactctagctggggcaacagagtgagactctgtctcaaaaaaaaaaaaaaaaaaaaaaaaaacacaaacaaaaaaaaaaaagaaaaagaaaataaacctgatctatagatgaggccagtggatcttgtgaagagttgaaaggtcaggtatcagtcttataccatgtcggatggggcaatcgtcataactttttaaaaaattatttatttattttgagacagtgtctcacgctgtcccccaggctggagtgcagtggcatgttttcggctcactgcaacctccgcctcctgcgttcaagcgattctcatgcctcggcctccctagtaactggattacaggtgtgtgccaccatccctggctaattttttgtatttttagtatagacagggtttcaccacgttggcccaggctggtctcgaactcctgacctcaggtgatccacctgcctcagcctcccaaagtgctgggattacaggtgtgagccaccgtgcctgccccaattgttacagctttttaagtggattatatgcctgcttcaggcattagacataataagttaatctgttgataagtttcttcatttcttaattttcagttgtgttttgatgtgtgtggtctgggtgagcggctcagtgctgctgctgtggagaaggcgtgatatggaagggatgtgactgtccttcttcatcttcataacggggccaggactggggtgaggtgtgtgagatgaatgaagcactggttttgatacaaaatttaagaaaaatcaaattcaagaggtaatattttaatacgatatttgtaaaaaatcaaaattagtgcaaaaatttgtgatgagcaaaatgttagataaaggcattgttgcttttctttttctgtgtattgtaacacaccatcacttagtggagaaacagctctcactttcctcctccccagatacaaccatttatgttgaattaaacttctagttctcctatacctgtgagcatcccccaggccccttggtatggagaaagcagtttatttgtcttagtaagattataaaagtggcaataaaatgtgaatgtaatgaacaaaatgcacattttgtggaccaacttgttgttttagatctatttttgaaaactcattaggtatgtgcatgaggcaaaataattcaagtgcagttggatattaaatgaaaaagtgtcaggtccccttttctgccatattctcttctgtgtcttcattagtggaaaccattttgaccagttcttataattctaatgatttgctgatggctctaattcttggtttatcaacttcaagcagaatgtcttgacatcttggtatgaaagttaaagaatatgaatcatttgttctctcccttctcctttcctctttctctgcctctcagtttttgttgtatgctcacggagtatgtgtgtgagcatgtgtgtgtgtgtgtgtgcacgcgagcacgtgtgtgtgtgtgcgcgcccatgggtccatttttgcatggcaggctttgttttagaaagattggttacaacagctgccccaccaatctcctctacagggaaggattcctactctgagaccttggtcttttccaggcagatcacttacatttcctcacagattatttctcatcctgcagcctgggtccaaatgggctttgctgtgaacagtgactctcaggcttctggtctctgctgtgcttgagtgtcgttgagatgctccatctcctcctactgcacccacccagcaatcatctctctttcaggaattcaccaaagtcttttttaaaattattcttttgttttgagacagagtcttgctctgttgcccaggctggagtacagtggcgcaatctccgctcgctgcaacctctgcctcctgggttcaagtgattctcctgcctcagcctcctgactggcagggactacaggcatgtgtcaccacacccagctaatttttgtatttttagtagagatggtgtttcaccatattggccaggctggtctcaaactcctgacctcaggtgatctgccggggtccattttacgtggcagactttattttagaaagataggttacgacagttgctccacccatcccccctgcagggaaggagtcctactctgagaccttggtcttttccaggcagatcacttacctttcctcacagattatttctcatcctgcagcctgggtccaaagtgctgggattacaagcgtaagccaccacatccggctcaccaaagtctttgggtggttgatgtcatatgcctccagttgatagcacttttaagaatttttcctttttgtatgctgttattatttttagaaggcttttggattattattgttaaagagtatgccatgtctatcttttaacttttaagcatctattgctttgttacttgtactttatatatatgtatatccttcccccaataagacaaagagtgcaaataatcacctcccttgcctgttgtttgggtttaattcaggagtcagtggaattaaaagcctaaactcagtatagttttaaagcagcagtccccaacccttttggcaccagggactggctttgtggaagacagtttttccatggaccagtgtgggggctggaaggtgattccaggatgattcaggtacattacattaattgtgcactttatttctattattattacattgcaatacataaggaagtaattatacaacttaccataacatagaatcaatgggagccttgagcttcttttcctgcaactagacggtcccatctgggggtgatgggagacagtgacagattatcaggcattagattatcataaggagtgcacaacctagatcccttgtgtgcacagttcacagtaggattcgtgctcctatgagaatctaatgctgccactgatctgacaggaggtggagctcaggcagtaatgcgagcaatgggagtggctgtaaatacagatgaagcttcacttgcacgttcactgctcacctcctgttgggcggcccagttcctaaccagggttggggacccctgctttaaagaatatgtttgtggattcatagagggaaacaacacacactggggcctttcggagggtggagggtgggaggaggcagatgatcagaaaaaatattaataactaatgtgtactaggcttaatatctgggtgttgaaataatctatacaacaaacccccatgacacaagtttacctatgtgagaaacctgcacgtgtactccagagcttaaaataaatgttaaaaaattccctccaaaaaggatatatttgcatcggagttatatttgtatatgagtatatatttgtatatataaatatacttgtatatgaaaaaaatatcttttttctttcattttattttccaaacattaaagtcgggcacattggttaggaatttcaccaatactttttacaaaactgaggacttggatgataaaggcactttttaaaagattacacactggcatggggaataatacctttataaagatgatctatgtgttcctgaatatcccgatgcatctcctagctggatcttccgctccacaaaaattcataagatgagattcttgaattagaatgcatgccttaatgtattaagtctatgtagagagagttatttagtccatgtaaattaagtgggaatatttttatttgattactgttttatctggatcttgcccacttaaggccttcaaaaatgaaatttaaggcctgttaagcagacccaacatcaacagcatattctctctctcttgtaagtattgtctagttgataaaaaatttcaaaaacatgtcttaatcaaaaacaagatgatccagcacaggtttaataaatgttttgtgaatatggcacattcgtgtctcattactacagttttcctatgctgtctttctcaataattccccccaaaattgtagtgtttacattatggcatttatagttacctctgaacctaaaaaattaacttcaaaagtatttaaaaaaatcattatatttaaaaccatttcatgtttaaatggtttgtacagggcaatgaaaggaaatgtagtaataaacacagaatcagatttggtcactaatatttttctgcagttgaaatatatgtagactggcttagggtctaaatagcattgaatcctgttaccttccatctataatcaattaatgtattatgacattgttgtcctcagatcactgggatctcatggtaagtaagtaaagggattattctgtgcattttcccaatatctatattagttttaatatacctttatgttaatgtatgacactgacacttagtaattggattaacttcctatcagaatttgtttttcactcatactttgtatacatgtcttaagggtagggtagatgtacatttttttctgtgttagcctatctgtttctgtgacactacatgctttctgtcctccaatttgtgtttctttccgtgtacaaatatgcatcatctaccatctacatctacaaaacatgtaggcttccaatgttttcatgtaaatacatttcatgagtcctcagtagagtgttagatgagtggttaattagtaatgttaataaatgtaaattacaataaaaacatttataatgttaataaatataagtttattgaacttaaataatttaaacatcttctgaaatgtagtagaaattatgattagccataactagtacagtattttttgcttgtttaatttttttggtgatattccatttgtggaatgagtgtgtgtgtgtgtgtgcagtacagacagaaaggagagaaacatatctgcatgttatgttagaaagagtagtgttagctaccctaccaaatttacatactggctgaacacagtatgtaaaaaattatttttttagtccattgctggtgttccttgttgttgggtgactctattccacatggtgatgcagggaaccaatctccttccttctgtggctgtgtaatcccttgcaaccttgaagtcctctgcatctaactttaggatgaggaaagtgaaggtggaggatatagccctcttgactgccttgacctggacctggaacatctcttttgctcccattccatggggaagaactagtgacatggtggcccatagctgcagaggggaggctgagaaatgcagcctctggataagaagcctactcccagtggttactgtacattgtgggagggaagcttgaattctgatggacagtgagaaccattctccacacaataacgaaatgacgtcttctcaaccttggcaatgtagcatcctgtgacttaagtatgtaaataattatcagtacaggtcagtgaaaaattaggtcacctttcccttccacttttaattctatagtttaatttgcctatctgctacatattatatatatgggaatagataagattatctataaacatgtataaatttgtttcctacactaaaaagaaaaatgacaaagaagaattaagttagttgcccaaatccacacaataccaccaggagaaagtctaggaaccataccttctaaatccaggtctacacttctttagtgcactaaattttttcctaatatagctctgaggagactggtgtttaagaggagaatgttaagccaaaagcccatttcacttggctctgtacagacagtaagttaatttccaggatgtataactcctgattttctgtgatgacagagaaaatactgacctgatttgggtaactctgaggtttggagatcttgaatagcctcatgttcctgaacttctttaccatacatgaattacttcttaggaagaaacatttattctgtagaatttggtttcgcattttatttttattttcttagacactggtagttggaaattcaggaagaatttgactacaaaaaacatttattaaaaagagtttctaatctcacctgctaagtgctacaaggaaaaaaaaaaatacattttgagccctcaaggggctccaaatacggttgaaggaaaattagacccagaatagtatatgattaggaacaaaacgatggcagagaaatgagagtttagagaaaggagagataatcctgagttaccttaggaagagaaaatttcacagagaaaacggcccccacactgatttggggaagatgattcagacttgtctcaatggcatgaggagcaggggccagatgggaaaggacatcgtggtggaaatgacacgatgagcagaagcttagaagtacttctgcttcacgtctgtgattctgcctctccccttgtttctgcagtgctaagttgagtgtagttccccacacaaaccctgagctttcttcccctccaggctgctccatcagtcagacaggagtgccttctcaggggatcctcttcctcatcttatcgggccactcatctcgtcgcagacattcccatactcctggttgacttgctcttccctctttttaactgacatgagcaggcatcacctcttccaggaaacttccctgacaccaggctgagtctctctggtgtcggggaaggcttctgtattactgcatctgccattttgatttaaggttttctgctcattccaactcaacagtgagctctttgagggcagaaattgtgtcttattcatttttcttgttatgccctaaaaatgtattgtgataatatataagtaacgtacaatttaccattttcacctcttgaagtgtatagctcagtggcgttaagtgcattcacactgttgtgcaaccattatcaccattcatctccagaactttctcatcatcccaggcaaactctgtatccattacacaatagctctccatttcctcctgccctcagcctcaggaaacctcccatctactttctctttctacgcgtttaactactcatatagatggaatcatccaacatttttccttttgtgcctggcttatttcacttgacataatgttttcaaggttcttttatgttttcttatgcgtttttatatctctctatctttgatagcacccaatacatagaagacaatgaatgtttttgtgagtgaaaacataagaccagaaagaaataggatgtcatattctagggacactcaagacactttcttgaggacagaggcactgtagcttggaatttggaagatgaggttggcaaggtgggtggggaaaggatggaaaagtgatacgtttcttgaagcatgtggatttgcttccataagcagtggtggaccagtgggcacccttatctattaaaagaatgattttttttgtgactcgtgtagagcactgtcttagttacctaccccagtggtagataagagaagcggattaaaaagagatctgaacctgaggaaatggagactaccaagttttttgtaaatatgtctgttataacatatattatctagtacttgcgatgcctgtgccaaagcatgctttttggtttagttaagcctacttagctcgctaatttcagtaattttggcttgaattgcaaaaagttgatgggggagatgggggagtctctgacatccttcccccactcacaggtttgaaaaataaaattatgaagagcaaaaggatctttttctgtggtaaattgtacttcatgacaataaacgagttgtggttttagtggttaatttataaattaggccatctggttcttctgtaatctaaagatttttatatatatgtaaaatacaaagttgtcctgggcaactgccaatctataaaggagaaaacatcttgaactctgtggagataataaaaccatattcagctgccaaagtgctgctgacatactgtccaatgagacacccaacgcctttgcattacagccagcaaggtgtggagctagatgtattgatctatttaataatattagcttctcttctctgggtcggacttggcccagagcaagtgaacaggacctatctatctccttctcaaaagtcacagctttcttaccaaattgtacaactcaagccacaaagaaaacaagtcaaggaaaggaccagaggagcacgagggcacatgccttgttcccagaccctgggaccagctccagctctggctccttgcagatcccgctcttctcaagttctctggctttgatcctagttttctgccctactattcctgacatgtacagcacttagcaattcataacttgctttattaaccaatatctcaacagaacttttaaacaacctgggaggaagcagagtgggtgttactgtcctcattgcacagataatgaaactgaggttcagaaaggttgagtgtcttgcccaaggccacacggcttcttagtggagaagccaggatctgcaccaatgtcttccattggacacactgccacttaatatggtacttagtttttctttctagatgaagcagtatgaggaattctaccatggatatctctctctatttttttaaactgcaaaataatgataatgataataatgaatacttctagaatacagtctctatgccaggcactatatgctttatatgtactaacttgcttaattctcctaacaaccctagaaggtagttactaatattatcactatttttaaatggggaaactgagttacagagatggtaaataagttgcccaaggtcacagaggcagccagattagtgacaaaagtttgagagtactcagtttgaattttacatgttccgtggatatggtttatgccaaataccttctcctttctagacctcagtttcctcatgtatcaaacaagtggactgcactatacaactctgaggtcccttctagcctgaagattagagtcttttatgcccacatgatatggaaaacattaatgctggctctttaagactggaaccttgtcatttaaaaaaataagctctactaaatttgcagtaaactgtccaaatacgatctctggtctctgatttgtatctctcacagagcatgatacaatgctagacacatatatactcattaaaaacttgctgaattaaattgtaaaacattcctccagatagaccgtaagggtgagctgatgccctaatatgctcctcagctgctgacttaggacccgtgggtgacaaaccctgtccttgttgttccatctgtgacagtgggcagtgtccaaaatgagtctcttcatcaaaagtgagtccaggaaactggatcagagtaagtaaggagtcttccttgcttctttttctctaaaatacaatacagtgcattctagcaaactaccagcatgcctataaatctcattttaaaaatatcaggaaatagatgctcattgataaagagggtaagaatgagcaagggagagagtcaagcctgtacatttgtgcttagggtattttcatttgagaaattatcattggaaagatcaatttccaaggcaggcgttttgtcttgacttaataaactaatctttatcaataataattaaataatgtcattttcccagatacaaaggggaaaccataatgcctttcatatgccttctcatatcttcagtgtttctcaaacccagctgtggggtctttttagggaagatacaaggagggtgagaccatgtggagcacacactcagcagccactgtgaagtcatgggtcccttgctacctttggaagctgacaatctgcatgaaaagcagcccctaggaacatgggtagtggcccgggatccaaaactcctgaatccataaaagggcttttgacttcttgttccaggacaagtgacatctgacatgcttgcctgcttgtttgcctttcttccttctcctatccgtctttccatccatctgtccatcagtctatctgtccatccagtcatccatccatccttccatccattcgtctattcatccatccgtccttccatccatccatccaagatttattgagcacttacatgacaggaagtatgagacacaaaagaaaattctacacaattctcctagggacatgaactaatggttagcaaaaatatatgggaagtcctgcttcaagtaaaattatgacttaagatatacatcagatatttgaaaaagatatttttaagttcaacattgaaattctaactacattgtgtccttaatttctattttctagttagacttttttgaagatacaaatcatttgaattatcattattattgttacttgattttatttattccacatgaatggtaagaattttaaaggaaggtgggtgccctaaaaatacatttatgccaactggattgaatcaccttgaatcacaatgagtacaacaactgctaatgagctaacacttaatgagtaatgaccaggcaccagacactgttctagcactttatacttactgatttctttactcttcatgataaccctatgaggaaagtgcttttttgttaagctccattttcagctgaagaagctgaggcctggagaagttacatagctttctcatggtgtctccactatgaagtagctgagctgagatctcacccaaggccctgctgggttcaggccacactcttaagtactcacagctgcatcacactgaatatcatctccctgcactgccatttcatttgagcagggctttgcctgtcaagaacattcatatcttttgataaacagtgcattttttccctgatagtctgtatgggacagcctccttgtttgcatctgaaggacagggacttcaggacctcctgctgtggtcaccaaggaatcacattcaaacttctcagcaaggtgttatggtccttctcagtttgcctacgatccattgaggcaaaggtttccttctctcaatacaccctctgctttagccagggggacctcccactgtcctctctatgtgttctatttgttcctgactgttagtacccgcttgtgtggtttccatgatccttcttctgcctggaatgaggctcctcttgagtcctgagagcttcatttctgtctgtcttttgggctgtgccaaagcccctctgccttcgtggactccccactgattcattaccaattttcctctcctctgggctcttcttagattgcaaatggtgcctctggattgggtaccaagacttgcagtgccttattttgataccactaatatgagaccatgttatatgcctcttgagatatcattccctttctagcaatagacagtgataagcatgcgtatagagggtaaacgtaggactttgaggttcatccatctcaatagacaaaagtaaaagtatgctaatttcaatccttcacacagtaaattgaatgtaataggtcttcagtaactatttgaggaatgaaattgttattgatatattgatttaactgagcaaatccataagtgccacgcttggagtaaagtacagggaatctcattttttgggtaatttcaaacaagtaggagaccatccactatctattaaggacaaaggagatttgagtgacaaacatgttccagaccatccaatggtgttattctactacttcatcccagctagtaaaatggggcaataagaaccaaaaagcaggtactgtccctatgtaagtagacttcctagtcctggccaaaacaaaaacaaaaaaaaaacaaagcaacacaaaacaaaaacaatgtgtgaagagcatcttaccgttcattgctttggatgatttgtgcaaatctagttaatgggggtggatctgatcagtctttgtaggaagtcagtattggcatatgtctggcttctgaattttctaaaaatataattatttatttttaaatccattcaatcaacactgaatttactaatcaactactaaataagtaaaagatcctatagtagatccttcaagaaatggaaattgagacattaggtcactataaaccccaacccttgtaatctttttgtggcaaccttaggaaacttggaatgctttttacactctgataaaggtttaattgtaatcatagccccagtgttgcaaaatgagtcagaagatacaaagtatctcataggataatattatagctgtaggtacttcaaatggacaagtataacacattatgactgctaatatggatgcattgggaggaaaataagccctaagaagcaatatgcagaaaagctatgattgctggagacagatagatccaagaacctaggtaatttttcagcaaactgtggttccactttcgcctctttcttgacattgactgtgtttttaacagggaaaaagttatctgaaatttttgatagagttcaaactttaaatcgtgttcactttgctaaaactccactggatggagtggcagaagagaaaaaacacagaaataaaagaaaagcagtaatggagaatggaaaatctttaaagatgctaccatcctgaaaagattcgaaagcaagcccaggaaagccacggggagggaaagagcgcttagaggtgtccccaaagctttcagaagtgatgagggaaaccccagctcttcttgttacttcttggcattttgttcctctatacgttagcttttggttaatctttcatgttacttattatctctgttttaaaatttcacattaactcattggtttcatatcccacttaacaaattagatattttccttgggcttattaagaaaattatttgctctcatatgttatggctttagattttctgtgtagctaggactgttcttaaatttttatctttacctttgttatttctctgaagcatccccattggggtggcagtggggggtattaaatggttatgtaaaatttacatgtaattgtgcaatttacacatagcctcaaatataatgaggcctagtctagctgcccataccaagaggatattatagttgccaataaaatcagtattatttcttttttttttctgttcttttttagcttcttgcaaacattcactcagaatcctttttgaatatcagttttgtgaaaagcaccgtgctgggttctttgggaaaagccaagatgagggcaaatgcatcctccttcctagtgagtctagcacacagatgactcaggaagtcatgcactggaggaggagtatcttctagaactggggaaaggttaaggaagggatcagaaacctttttcactcaaccaattacattttcctgaaagcatgttattaatcgtacatgatcttgcagaccccagatagagactatatcactatatcaattgttttcttgaacaactggagttaattctcatatgtttggttacccttcaagtatttatgtttaggatctgttttcttcctcttaacttacattccaaagtttaggtatccttcccctccatttgctgtccaaaacagcatcctttcatgtagctacatgccattggaatgatttggtttttgccatggattcctagtcctaaatttggacttttattggtatctaagatgtcatggacagaacccacagatgttgtacaaaaagggctgagtggacagtccaacagagttacatcatctgttccaaacacccttgtaatggttgtatcagcgtcaatgtctgagttgctgtcctggttctcctggccagtcctcagctggccatgcctgttcaggcaccagagaaagcttcatacctcaggcaaatctttacaagggatttgaaaggcaagaaacatgtattttggaggttttacctgtttatttcatgtatagcttcatattaacagattttgctatcacttaaaagtaaataaaatgattttgatttctcaaaatcatcttataatttattaatctattttaaggcttgcatttacatttaatcttcaaatcttgatgcattttcacagagtttctttagttagttaaggatattaatgacttcctttaatagttgatgaagtgagtcatcatcgacagtgagtcactaaggccaactcttgtacctgctcttaaatagcagttgttttactagatttgtactgaaacctttttaaaaatctgtttgtcttatatataacaagcatttccagtagttaataatactttcttagctcttcaatcattttatgagagcattacaagaaaagcaggagatggggaaagagatatcttgtttgccatgtaggatgcatgaaattcttacttagtctgttgtgttttggattcgagagaaaatatgtaatgaatcaaaatgtttcctacagtcctctgaaaagatgtaatgagacagtcttccagcagcctttgatcatctgggaagtcattgactttgatccttatcctatcaggggctcttaccctggggtccataaatacccaggcatttttaagaagtggatttcagtataacttgtttcattttgtgatttttaaaaatattttgttttatgcacttaaaaccttaatctgagaagtcatctgtagactataccagatttccaaatggaataaaaatatttaagaactctcttatgtgtgtgtttcaacctataaattttatatgtgtagctcatggttaggtggtaagtagagaatttgctatctgtgtaatatttggtactttttataatgaaaaaggaagtaatacaatgataggtaccatttatttgttgaccacccatattttccagggaatgtgatagatactttttatatattctttctagttttcaccataacatgctgcagggatagtgttaccattctcattttgcagatgaagaaattgaaacccagaacaattcgttcattcattcaaaaaatatccatagagcatacactaagagaaggcactctgctaggcaccagaaattgaataattgaccccaaatcacctaactcataagtggcaaagctggacctaacaaagcccattatcccttctatcacacattccatcctcataatatcatattctacatagaaaaacttaacagtcctgttgagacacttggaactctaagaaggtagtcaacagatacttttctctttatataaatatgatatctaattagcttttcctggaaaggagtgattctgcctttttttaattctagcattccctgagcaaattagagcccaggtaatgatttcctgagataagtcaattctcttctaggacaatctctagtcttgtcatcatgagatggaataacaacggtctatgtcatttcagtgacggcacctgcatgtccttgtatctaagaaaagacacctccttctctgccttgctaaatatttgtaaactttgctttaattggtatatgtgccactgttttgtatgtgggaggggtttatggttttgttttgttttttggtcttttttagtaaccccaatccaaactattctcatttgtaacctaaaatacttagaacaagaggctttgcaatcttgaagaccgaatacatttttactactaaatgtaaggcagatttgagccacccattttgtagtgcttgattatggcaacccgaggaaactaatacggttactctttatctttattaggaaatactgctgtagttcctgttgtaatccttagggagccaacattgttgatgagacctagtaccaagccagaggccatgttgaactagcaagatatgggatagtttttactttcaaagtaattagcatctagagtctagagagtttctcttacagggtggcctggtgtcttagtctattttctgttcctataatagaatacctgagactgggtaatgtacaaattataaagatttgtttgactcacaatcctagaggctgggaggttcaagatcagacagccacatctggccatcctttaatgagggcctcatgctgtgtcataacacagcagagaattggaaggagaaatgggcacatgcaaagagaaagaaaggggacgaaaggggctaactcactttgtaactatgagactaatccattccctggagaactaatttattctcatgagaaagacatgaatacatcttaacatcctaatcacttcttaaaggcctcaactctgtacactgctacattgtaacaggcaattaaatttcagcatgagttttggtggggacaaactacatcccaactgtagtacctagctacccactttatttttagagtggctatttaatgacctggcaagatctactgtgcttgtaaaagaatccaccatgggttaaagaaaaatagtttctggcttccagtctccttttggcctctctctagaatggcatatacaagttcagtggttactgacttcaaaggtggggtggaagacactgaaatgaatttttctcctttctttggttggttgctctctctctttgttgctgaaatttgtgtaggataatggaatgaatatgggagatagggaactatagaaagactggagggaagggagaagtcttttctgaattaaccccccatgtgcttgtgagacccttggaccccaaagggctcctgactggctgggcccactccttctgtatatggagccatagggcttttctctggcttcccagttgaagcattgtcatatgctttgatgctcagcatttctggcaattttaccttgtaaaactcccgtttcgacattctgaacttaagtagaaaatgggaatataagcctcttgttttttgctcttaatccattccagaactataagtccctgggttcttggcaacaacaggtgttcctctagattttaaatcaagtgtgtgtgtgtgtgtgtgtgtgtgtgtgtgtgtgtggaatatctcactaaaacgacagtgttgtcatcaattttggcttcatggagggtcttgagctgggtggagatgggaggaagctatccttgtccatgcggtttggagacttgctctaaaaaagagaccgtctacttccctcgtagtttttgttttgaagacatttgtagtgtttaccaggagcatacagttatctggaaaatgcagactgatgacaatagtatttgaaatgctcgtagatctgcttctaggttgatggaaagaatgtatgttccaaggtacaagtgcttgttgacttttcggatgcagccagtctgtgctctttgtcaggtaactcggaatcactccacagtagctgtccttcctgtccatttgacaagcacttaaaagggcagtcttaagtactttacttcatagtttattaattttttcccttctttagtttgcaatctactctcagaaactgaaaaataatttcttttacctttttcccctttctcatttaagctgaaattgatttctttctgagcgtgtaaggaaaaaaataaaaagaagctgtggttaatacaattgcctttgctgaacaaaaataaaagactagtttaccttcaagctgtgctgtatcagagtaaggatctgttctgtcactcccaggagattttgataagagagagtacaaaatttcataatatctacatagcataattgtagcaaatataagaagtattataattgtttatttggggatgagggtggggatgggtttttttgtgtgtgtttggaaaattgggaagctagaagatactcttaaatccatcagcttcttcagaactcttctcaaatgcttattgtcatgacaaccatctcttcataaaccaaggctctgagtgtaatacagatggggctggtaacaaggtaggattgccatctgctttgttttctctaagggacattatttttttgtgatccccaagtctcatcctcaaatctgaaagtcttgacttatttttctttctggagtcagatagagctgtgagattaattcttttctcctgacaaactacttcctcacctgtcatcaaacaacttacttgttaaatggagggaaaaaagggtaattatgtgtgtgtgtgtgtgtgtgtgtgtgtgtgtgaaaacaaatatacatattttaatgatttatttatctgtctactttgcaaagtctcctatgaggtacctagtaattcaataatacagtcaagtgtgagatccagaaacaagtaggagtgaggcaatcattttcccatgaaacaagtaaaattattactgcttttgaacattttaacacctgtgcttcctgatggtggggctgcatgaagtttgtaagtagtgtcatcattctcttattaggtaacaaataggagcataattatttaggagaggaaaaccttttcttgttaccaaatttggtgagaaatttgccaaagaaatgaatgcttacaggagggatacagcttaatatcttcatactcccctttgtcaaagatacaagtgacattttctcatatcaacttcctacaaaaagtgaggccatacatttttaaaaagaatatacccagtattttaaaagtttgtatatatcgtgatcagaattaagatatatccagcttttgaaaaaatatacatatttagccattaaaaggtatgtggtaaactaaactgatgaataaaggttatgggaaatatttcataaaatttatatttaaagtaaagaacaatttctctctttgtattatagttattttacataagctacaatctataattctaaaccttaatttcttgaagggctttataagcctcatttttctttctaaatagagaagttcatacactgcttttatgtcctatatgttgatgtgtaaaaataatcaaatactagtgggtgagtagaatgtaactacaatatggtacacacacagacacacaggatgactaaactgtgcacatgagctgatgtccagagcagggaaaagctgctaaagaatgtttgaagtagagtcagaatgcagttttgtggttaagaccaataatttttcaaaggagcattataaggagtgtggttacttgggttggagttgaaaaccaagcaacagttgggcagacttgaaaccagttttgtctttaggtttcttttcttaatgattggtctacaatgagttagccactcatcgtatttaaggtcttggtaaaggagagactttctttgccatgtagtttatacctcatgtatgcattacagtagagagctccaggaaatactgcaggccttctactggtttttatcctctatttagataaaaatgaggaagaagtagaattatcataaacaatcctgttggcttttagttgagatatactacagaaacatcacctttgaatctgtatatgtaaaaaaaaaaaatctcagagtaagatataagttctgttgcattgttctgaaggaatgggtaatgtcagaaatgtcttcattacattacataaagtaatacacagtgctgttatcagattgcatagtcaaagttggcaagtttgcatatttacatagatatcatgaccttcatcattcatacttctttcaagaaatggtcatcttaatatggggtatttatttgaggcatacaccatttattttaagaagcagtacctttgtttattgtaaaacttctggactaaattcttcaattttttctcaaatgaattcagttttttgttttttttcttaccactggtttttactgcatagcgtttgcctgaagaacaccactttgtttcccaaggcaagtagtcactacaaggcgagttttgttctgtctatcccaaggcaaatagacagcagcaaacatagtgtggagggctgctgggttcagtagaaaaccatcaactatttctaattgggggtgtatgaagacagctgcattctggacatgctaaacatcttgaaatgcttggagtgtaataaaaccccaaacgtgctttcttttctcatttctttgcacatgtattttaggcaaaatataatccacatgctgttgttccctctccttttaaatcatgaaaaatgttgtttttatagggctatttgaggtccaggatgcctttttatcctttttattaggttatttttatatataaatgaaaagaaaaacataaacagaaaatacaacatgacatcatgaatgagggcaagcacaaactgcccaatttaagtttgaagttataaacctaaaatattttaaaacaaaacatttctcttggtgttttgcaaaagtaatgctttcttctattgggcagaaattgcagcctgttgggatgaaggagagaatagaactaatatttattgagtagctaccatggctttctgggacatctgctaaccccttaatttttacagtaaccctaagtggtaggccagtccatctgcattttacagacaggaaatgctttcagagatattaattagatggctgtagaccacagaagaattgaaagtcaggtcttcttgacttttcagctcatgacttcattacttctgccctcctcattctgttgggagatgggtgggagtgtgccctccagataatcagaaagtcccatgttgggatgtgatttggaaatagctagtcctcaggcctgtggacgaaggctattgtagcctcaagaaagaaagagtcagcttgatattggcaaggtggttatttagtgtggcagctgcataagagcattggataggtggtatgatatgggatgggggtcagggtgagagctgctcacacctccttattatggcagggcaaaaccagaatagtcacagtgatggtgatgtagggtaggttcaagagaaagctcatgttcttctagcattgagactcacaatatttcaaaacaagtgattatttattccattactatttattttggtgatggatgttgcatttattttattttctaacagtagtacatatttggtaagagttgtttgtgacattctttatttaaatggattaaacccattttcttaatttttttaagtgtttgtcctgttatcgaagatatcttaaagtgttacagaatgggaatcatagctttaatgagtctgcatataagagagtccaaacattttttttttggagagaaggaaggtcatttcaactgtactataggaacgatagggcccatgatccatggtatggcaataagttactattttttggagaataaatcgcaaaatatgggacgtgaagactgcttggtatttacacaggagtctagttcttctgatactatatattctataagctttctcccagaaatccaaagttttatttagcttgtagccatcattgtgccacaatcttccttccatgatttatttttttcccatactgtactcttgcactgagtctttggcattgaaagggaaagagatgaattattcaactcttcttctattgagtgaaaagccaatacagaaaaaaaaatgcaacaggcaatttcatgactgacattttggagaacattggggtcatcatatgactgagaaaatgattatctcttttgaaggtcaggaaaccaatatttttttttccagtgaatctactgagggaaccaaccacctagctttttgtaaatagcactcctcagggaaatgttgcttttttcttttgcagtgtttctgctttgaatcttcatagactgtatcccatggaagcaggaatataattactgtagtgcttactttttttcatgtctctactgaagagccaccctgatttatcttttactccaaggtagtgtggaactttacaaggatttagattatattagtcattttgcttggagatctctgcacacttttcaacatcatttctaagagccttgccacactcagtaaaagagggtgaggcttcaagaatctctgtgtaccaacgcaaattaggcaatttgtaagaagtccctagtagagcagagtggagagagggctcaggatctcgtgaggcctggggcagggaggtggacatgctatgagctcctttcacagtcaacacaaagttaacacatcttggaggaaaaaccgttactgtataatggaaggcagaaggcagggatgtctgtgcttggtgatgaagctataagtagtgagctgatttatgatggaggggtgaattgtgccatgaaagagactcccctcaattttattagccagattactgcccatatgcggggtgaggagtgagcattttaaggcatttctctctgttttcaatatatcatctctggattcactattactgggacttgtgaatatagactagggattaaaacctgagtttgcttttaaaaaactttattttattaaatgagatttctgagcaactgatttcacttagtcttatcaaactattcttactactttttcgatatgcattctgtccctcctgtgtgaaggccacaggcccatggcccccatgtcattgagatggaggtcctcaagtgatggcgggatgaatcacctctcacttgccacctgcgagaatgtctatcactgatacctctccttatgtcccgtagcagctgctaagctcccacgttattattggtgacactttctagtgttcaggagagaacaggatttactttttgaatgcctctaaattattatagcaggttcatttggaattgcatatcagaacattcttcctgtttatcaggaaaataaaccaaggtcttgaaacttgatgtctatccatagttggcccaatataattttgcatgtggtttattacattatttttctccattggctatgaactgaaggcatctcatggatatttattccacgctgaaaaggtagttagatgctgtgtggtaaagtcgagaccagtatattggaagaaaagagacactccatctaataatctttcatagtcttcacattcattgagaaggttacttgataacctttcctgcacactctctcccaaccctgacccaggaacttgcagagcacactgtgcaacagatctaataacccttgtctgcaggcaatatgcacagctgggaaagataattaaatagactctttttgagaggtctacaacatttcaacggaaggatcgagcaatccggctggcctccgactgaaaactattaccaacagacatacttcagacagattccatgatcaccatccttatgtggcacaagtgcttatggggagcttctttggcttccaaaaggccactaaaactgtcagacctaaataatactggaactgtaaagtgggaattaaaaattataattccatttaacatgtaacgttctcatcagaaaggggcctttggttttccatattgatcggttacatggtcagctgcaattgtaactcatgagacacacccagatatcatcctgcgtgattctttttgaggtttatttagggtgttagataatccgaggtaggtttcatcatgggtggcaatattacatatagcaaatgtcatgagaagagagacaaagcctcccttttgaatgttaacatttatgcaataagtttaatgtaccgtgtaagtttacattactattatgagacttaacctaaaaaattggggtgaaatcttaaagaattatgaaattaagaaatgaaaccagagggctttcgttttaagtactgatcacttaaaccaaaaccagtttggcttatcctatgagatcgtgggtattgagaaagaggaacatttgctgctgcatccggagatgtttccttgagagcaagactagttccttttgacccagtacatcctacaggtaaatcactgcatgctgtagagatacctgttccctcccttcccccaccccctggggatctgaaaccaaatcattgctttttcatcttttacttatccttataaacaaagccacccactttctcatttttcctgatgccaagtccttctttacatgagtggaatccactcttttcaatggaaagacacctgctctgagacaggctacactgtcatgagccttggcatggctgagtgatgtagtggaaggtgcaataaatttaaactttaaaaatgcaaaatttgatggaatcatgcatcttgtgcctacagtgagtatatggtctagcaggatttacagatacatgcatgattaatttgaatacagtatagcaaaatgatctgttaaaaaacacatgaaaagatgtgcaaccttattagtcattaggaaaatgcacataaaaccaccgttcctgtgtgatacctctgtacgtctattagaatgtataaaatttaaaaagactgaacatagcaagcactggtgaggttgtagaccaactggtgctttcatgttttgctggtgagaatgtaaacattacaactactttgaaaacagtttgacagtttcttaaaaagctaaaacatccacctggcatgctatatacagatatcctactcttacgtatttaaccaagagaaataaaagcatatatccattcaaaaacttgtaaataaattgctcctagcagctttatttgtaatagccaaaaactagaaacaacccaaatgtccaatgaaaggatacatcgtatttatttataggacatatccatgcaatggaataccacttaggaatagaaagaatcaactgttcatcatacatacaaccacatggctaagtcttaaaaataattatgcttagttaagaagtcagacaaaaaggtaagagactgttaggagctgaattagcgggttaacagtggcaatgaaaaaggagaaaattatagctacctcaagatagaattgatgagctttgattatgaaatgatggtaagagagagggccatagactctgaggtctgtctctagctttggtttccctatgtggatcattatctatttggatataagaattatctgaaagatgatacttaagcatgtaagaaatgataagctacctgtttaatgatgagcttttgttacctccaagaaccccaagaagaaacatcctgtaagcagaccattcatacttgattgttaaaggaaaacaaaattccattttgtctttttcatcaacacaagtatagctggctaataaaagtgtaatattcatgagagaaaaagaaaagaacacgcacacacatacactcaacaggattcctagagtcattcccatggataagagggaaggaaaggttgagggcaaagagagaagggaaggaaacagactatgatgggatatcttagggcaaaagaatagggggctgatttggaaggcagcaaacttcatggatacttgatttatttaatgtccctgtcactctggcgtatcttaatgtgtgtggtgtgtgatttatttagtcacttgatccaaattctctaattaagtggagctcagaagatatagtgtccattgtggtcaagggcacaggttttggcttcaacagacaaataagctctctgagcatctgtcttctcatctgtacaatgggaatatcagttcctacctcttcaggttgttgtattcataaataaattgtgtacaagaaacattaggattgcttcttacccgtagtaagggctcaacaaaccttctcctccttctcctcctccttctccttcttcttcttcctcctcctcctcttcttcttccttttgcttttctccttccttcttccttcctttcttcctacctccttctcattattgttattaggtaaccacaatattatcagtaatgattggagaaagctttaatctcctagttcaccattagaaaacaagaacacattttggtggttattacccgaagtaatcataatgtcacctttttttccatctgactcattatcccaagtgatttatttatatatggagttttctgagtctttcttttacatattacaaaaaaagagtgtgatttagggacgaagcaaagaaataaaaatttagtgactttcattctgcctgtgccccaattcctattgggcataaggcaagtaatttaaatttcttagcaccttagcatcttctactcaaacagaaatgaggaacagtcacaggttactattatagctgtctaagtagaaggcacacaagttttcacactgagtataacactttatagaaagctaagtgtgttgctcaagttggtacatttctgtagatgtgacactatggcactaagaaacttaatgccacattgaaattcattgagatagctagactttaaaaataattacttgacttcactataaagtatgttcgtattgcatttactccatctagtagaaaatagaccttgtcagttcaaatccctgttgcattaatttcaccagtaatgagtctttttcatttgagtcagcagggtttttcttgcttgttttcaggctttgtggatttgaccctccatgatcaggtccaccttctagaatgtgcctggctagagatcctgatgattggtctcgtctggcgctccatggagcacccagggaagctactgtttgctcctaacttgctcttggacaggtaagtgacctggctgtagcttaggagtagcatgttctttacgatcatagttcattcatgaaactattttattcatctctcggtgaagcttcagagaactttattaggtatgtttacttaacaaaagagtgcattgggggtgatgaagcctagtcaaattcacagaaagctaaggataactttctgctagacattacctcagaagaattctattatttctaatacacacacacacacacacacacacacacactcacactctctctctctctctctctgtcattatgaatggtaattttctaactccatcttcaacttgtatcatataaaaattataataacctctctttaattaaaatctgttgttgcttcttgtacatccataccacaatagcctattcattttcttctccaattttcccatccgtaaaatgaagaaatttgaccagagttctgaaggtcacattcaggtcgacaaattcattttcatgttcaaatatgttaccttctttaacataccattctggggttgccttggaatgtgggtcccattgttttttttttttcagtcattgcttagagtcatagaatttagatattactcaatagcagctgccactgatagagtctccaccctgcaccagctgtgatgctaaacactttacatatattatctcatttaatcatcaccggactcctaggaggcaggaatgtcatcatccatgttttaccagaaaggaaactaaatctcagagacatcctgctacttgcaaaaagaggaaagctcactaaatggtggagccagagttcaaattcaagatctttctggctccggtatgctctgttacctcctgtgctgggcacatggtcttcccactctcatgttcagtgatgcctcctttggtctgctgccatagcattctgttttccaggtaaatcttgtctttgtgggctacataacattttggatgagaaagaaccattttgttgtttcttgcaatcctattttgcctccgtgccaagcagtctaaggctgccaggctgcccacagtgcatctctgcatggtactttacttcagagcatttcactatctttctacacctgccaagtgcctggagcagagttgcagcaaaatttatttaagtactggagaattgtacaaggtgttggttattgttttgtcattttgtgttaacacagcttttgaaaaacagtggtgatacagtttaagaagcatattttgctgtctgtggaatatattttgatatcacagtttcacaaaattatcaagaatggccactagtcttgttccttagaactgtactcacaatgtattctgtcagccttatagaggatgtctttaccgtgttctttcctttccattccttgtttcctttccattttttcctatctcatttctcctctcttttcctttgctttcctctttctttctttctcctgtcctcttaatttttttgtcttatagcagtgtggttttgtaaccaagtgatatcaagtttgcaaatgaaaatcttagaccacacgtaacatttccctgcctactgcctggagtgtctaccatgtttaggtttttggacattcataactcatttgctccttgatttccatcctcatctgtatctatcttcttttttaaaatttaattcaatttttataatgttgacacaattatgcagattcatagggtacacagtgatgttttgatacatataatgtgtggtgatcttatctatcttcttgagtacacacttgcttgaggacagtcatcaaataattgcattttgaatatgtgaaggtttttgacattactgcacccaaaaaactcatattgccagtgaggtgatatggcctaggattttatcagctacagccttctctttcctttctgtacactccagtggtggctaattttctttcctctctcacagaagtatgaatgactaaaagttctcatctctattcattcctactttctaaaacttcagatcggaaatttgaattacctctagaccaggatttgtcagtctctttactattgacattttgggtcagatcattctttcattctttcttggttgaggggttgatattgtttggtgtgtcctcatccaaatctcaaattatagctcccatagttcccatgtgtcatgggagggacccggtgggaggtaactgaaacataagcaaaggtctttcccttgctcctctcatgacagtgaatttctcatgatatctaatggttttataaaggggagttcccctgcacacgctctctctcttccccgttgccatgaaagatgtgactttgctccttcttccccatgattgtgaggcttccccagtcacaaggaactgtgagtccattaaacctttttctttgtaaattacccagtctcaggtaggtctttattagcagcttgagaacagactaatacaaggggctgtcttgtgcattttaggatgtttaacagcatccctggactccaccagctagctgccagtagcaacctccacttcctccagttacgataactaacaatgtctccggacatttctacctatcttctgttgtgtcagggggtgggggaggtaaaattgcctctggttgagaatcaccactctatgctttcccaactcaatgttctataagctcctcagacacactgtactctaaactgcacactcactttatcttctgcaacaagtctattccttttcttttctgtcttggtgacatcaacactcacctagacactaaagctagaagctttaagttacccatggattctaccttctccctcaccaaattatccagttaactatcaagtcatctatgaactgcttctgaatccagacctcccctctatccccattcctctgcatggcacaggtcctggttgtctctgctgcagattccttgcttctgcaccactgactcactttcttggtcctgctactctttctttcagtccatctcccatactgctgctggagaaggctttctaaggcacagctgtgatcatgatgcttcctgactcacctttcagtggctctctcaattcttaacatggagaaaccccatctctactaaaaatacaaagttagccgggcatggtggctcatgcctgtaatcccagctacccgagaggctgaggcaggagaatcgcttgaacatgggaggcagacgttgcagtgagccaaaattgtgccattgcactccagcctggatgaaattccgtctcaaaaaaagaaaagaaaatactgtgtagacttcttatcttaataatcatgaatcactattacaagtgtctcaaacgcaaatttctgaagagtcacaggtgacccagtgagcccttgtccaggctaaaaacacctggtggctgaattctgaacttcacacattcgaatttctcttccattgcttctgagagaccctccaccattacggttccttatcagagtcatatctacctataaggctcatttcaggtgccgtctttttataaaatcttccttcaaactttctcctcttcagcctttatatatacaaaaggcttttctttcttttccttttctaagtttccattgtagttggtttgcttttctctttattattctcattccaccatattagttatgattggatgtcttcttaccttccctactagctcataaacttcttgtggtcaaaaaccagatcttgttcgtcttgtgtgatctccagtttacgaagtcttccatgatacccaacaaatatttgttaattgcactggccaaggtcacccaggtggcttgtggccaaatcagaagaatctacatcttctgatagtcatggcagctgttattcccatccaactcacttcctgtgcattgctactcatcaattccccacttattcttttaaaaacattgcataaatacatatctatgtgttttggaaagattttcttaatctataagcgcatttggcgtgtgcttatatgtctgcttatatgccaaatttgaaattccaaatttcgccatttggaatttcaaatggggaaaagcaaagactcttatctttcccataatcaaaccccttatgaagtaaaatccttaaggtctctctacaggttaaaaataattaggtgatatgatttggctgtgttcccacccaaatttcacctttaattgtaataatccccaggtgtcaagggtggggccaggtggagataattgaatcatgtgggttgttttccccatactgttagtgtggtagtgaataagtttcatgagatctgatgattttataaatgggagtccccctgcacaagctctcttgcctgctgccatgtaagatgtgactttgctcctccttgccttccgccatgattatgaggcctcctcagccatgtggaactctgagtcaattaaacctctttcttttatatattacccagtctcaagtatgtctttattagcagcatgagaacaaactaatacattaggtatatgttaatgatgaggaatgtgtataaatacatatacatttatatttaaatattaatatttacaaataacatgatattaaaaatatggtctataattttttaaattatctacctttctaatcattaacatgcactaaatattattaaatttcaatattatttaattaccatcttggtgtttgaggataactgcttttgatggcattgatagatgcattaacagtgaaacattgtgaccaacagcccatctgagattttatacttgtagaagatggcttctgagtgacagctgagaagactgtttatgtctttgccctacaggttcctaacccctttaataaaatagagctctctgatgcagatgacacatgggccttctttttgctcttgtcccatcacattgtacatagtaaacatttttagcaacaaatagtagatacttataactttaaaagctaagtggttgacagctgagaggcagatgatggtaatttcatcatttttctcatatctcaggcattgtgacactacctctgcaaggtcaactgtctccataggctgttttcatttgcgtagaaataggggggaaagatagcttgaagtcatcaggagccctgcaacccatggattaccaatgttgctaactggagcctggatttcatcttcaattgattgtaatgatgtcttgttctctcaaatctttgcaaatctaggcatttataagactatcctgtaggtcccttacaagaccatgaggatgctagaacttaccctagtcttttcttgtaattgcttaaatgttagtattggcaaatggggtttggtgattataagagtaaaaaaacctgctgccatcccacatttgtgagcagaggatacatttcctatcttgtgtccatttaaaaagaatgattgcttgattggcttcctgatgacaacccatgatatactgattctgttagtttataactttcctagtagtcatatgcttataggccaattttatccttgccatgcttagcctagtcacaatttccagttcttctctgtatcctgcagcagtgagttccaaacacttaatgctgtcatctcttcctgtgaaaaccaagaaataaaggttattataaggtataaataaagaacccagtgatttctcttggggtgtgtgtgtccatgtgtgtgtatattttacaagaggaaagttaaagatactaagaatgcctgtgaaagtaatcaggaaatggagaaaacttgttttccattctagcacctaatcctttggtgtgttttggcactagaaaacacaaaatatgtcctctgtgtctactaggaatgcctctcttcatttagtcctgcttgagtgctcatgatggaaaaatatagactgaaaacaggagcaaaagtgttcatcctactcattccttgtggggtctctttgctttcaaagagatgttagagatgttagtaaatggtgttagaagaaacaatgtaaattgcctgtttagtaagatgatccagtttctaaggaactgttttactggcgccttccatgctaacaaattctgagaaatatttgcggatttctcagtgaagccaaagcactctcttttgactcctatttactctcagagaaaaaaactattcatccatttgaaaagcagggaccaattcaacaagcagaatattccctctactaagcctttggccagagagttgttgctctagttctttccatcactcctgcatcaggaggctctgcctgcaggaaatagtattggacaacagaaagttcttttacttgtaggcataaaataggtataaattctcctccttaagagaaaaacaggttgctgcaccagaaagaacatttgcctcttctactaaatagcagactgttttccaatgataaactcattttaaatagaaaaaaaaaagtcattctctacaaacaagaacattttcattttaggttgtttattgtaaatatttcagaaaaaaaatatgcaaaaaaaaaaatgcccaaaaatcaatgcttccagtaacatatttattagctatctttttccccatgtaaaacttcaggtaaattctttgcagattttttacttggaagaatgataaaaaaaaaaaaaaaagttctgaaatgagttgaattcatccacgtgtgtttttgattcacatgaagagtaggacctccctttatattccctcttcaaattctcccctctgaaaaatgggtggtacactcaaaggaggaccgcacacattgtagtagctggggtgttgggggtggaaggagcaggttttgggggtgggaggagcggtgagtgatcctttcagcaaagtcagtcctgggcaggagacggcttcaggaatactgtcagctttactggattccaccatcgctttccaggactgtttaggccctgggcccttgaagggtttgcgtgcctcttgtctccattcatacctcaagaactttgttcatgttaattttttttcactctatcatatggaattgagtaaaaaaagaaaaaaaaaaggaagccaacacttacttaactgctttaatgtataggactctgttctgggttgtcttctaaagtacatttcattcaatgtgtgagaatacagataggaaagagttttgctagtttctattttgactgtggatccattgattctttctggttctcagcccttaattgctcagctgcagataccacttgactgactcttaaaagtctttggtttattgcccaattctgggaatatgaaactgtaagctgtttaggagaaaaactgagaccaaaagaaaggagaagtgagccaaactgccattatgattgccacttcttattgaagataaatcaaaatatccatttgactagaaatcaattgaattatgcactttaaatgggccaattcaatgatacctgaactatatctcaaaaaaggtgttaaacacaggcacacacgtacacacacatattggaattccaggaaaagtcactttgatcaacaagattatcagtcgtcaaagtgcttggaagggttctattggaataaagctaaaaaaaatcaaagtaaaatttctccttaaaaacaaaagcaattaagcagcactgtattataaaatatgctaagctgcaagtcaaaattcttaagagacttaagcctgtaagcagtaaggatccactcaatgtaaagttactccagagggaaaggcgtgagcccaaccaaagtattaatgctgtgtaggaggttaatttgactcttcttaacatttttacacaccacattatgttttattcaccatttattattaactgaatttattaaagtataatcaaaataatatttttgagagtttaaaaatattctcataatatttaagttacatatactatgcagggaccgtcaagtaattccactctgacatctgtatttattaccgccacctgtccatgatggtattagaaagatcctcatttgttttaatggatgcctctaaaatccagttttaagagggggttggccactttcaagtttgtgttagttaggattcagtttaacccagctcaacaggtatttactaagtaccagcatatccatagggcgctgtatgatactggaggacacacagaaaagagatgtgtaagaggcactcctgccctcaaggagtttactattgagtggtagtgtaatatgaataaacaaatgaatctgctcaaaagcagggcattctaagcaggccctcaccagcctctcatcattcgcatctagtgtatcttcctccatcactttctaaacgctatggattctgagtgaaaaccaatcgctggtttatgcatgtatgcatatatgaattcattcttgacattgccatgcagagtatttagtataactagacttattatccatttatcctgcctagaagcatactgtaatatatataactctaaaagcaagatcattccttatgttggttcttttgagctggcagggggaaagcagagtatgttggcaggggtctatcaaggtagatgagcccagtttgtacatctttgaaatattaccaatgccaatgtgttagtactgcttggatctcttctatgacaacagttcttattttttccttttttttgtttgtttgttttttgagacaggatcttgctctgtcacctagacaggagcgcagtggtgtgatctcggctcacttcaatttccgcctcctgggttcaagcaattcttgtgcctcagcctacagagtagttgggattacacgcatgcgccatcatgcctggctaatttttgcatttttagtagagatggggttttgccacgttggccaggctggtctggaactcctggcctcaagtgatctacccgccttggcctcccaaattgctgggattacaggtgtgagccaccacacctggcccatcagttcttaatttgatgaatggatagaggtttggcttcaaataaatggagttagtctgtcaatatctgtttcttttaaaatttgcaattgtttttatttttagtgtcatgctatgtgcccttaatgatctagaattaagttctaatctctaccctggtataattgatttctccctgtggactcctaatataagaagaaagatgaagtttttcttttaatgcttttagagatcttcattaagtcatttaatattcttatttgctatttcccagtgtgatggttaagactgagtgtcaacttgattggattgaaggatacaaagtattaatcctgggtgtgtctgtgagggtgttaccaaaggagattaatatttgagtcagtgggctgtggaaggcacacccacccttaatctggtgggcacgatctagtcagctgccagcgaatataaggcaggcagaaaaacgtgaaaggggaaactggcctagcctcccagcctacatctttctaccatgctgaatgcttcctgcccttgagcattggactccaaaatattcagttttgggactcggactggctctccttgctgctcagcttgcagacagtctattgtgggaccttccgatcatgtaagttaatgcttaataaactcccctttatatatatcctattagttctgtccctctagagaaccctgactaatacacccagtgtgttcttttatcaaatagaaaggagatatagaaaacacactgtccatgtctttgattgttacaccacagcagagaatcaatttcttaacctgcttacttatttaccattctccaatggtgccaattctgagatccatcatgactttatcattagaaaaggggatgtaacaaacatgatgagatgttacgggaatactgcttactgcatgatatggtttggctgtgtcctcacccaaatctcatcctgaattttagcctcccatacttcccacgtgttgtgggagggacccggtgggaggtaattgactcatgggggtggtttctcccatactcttctcctggtagtgaataagtctcacaagatctgatggttttataaggggttttccctttcacttggctctcattctctcttgcctgctgccatgcaagacatccctttgctcctccttcatcttctgccatgattgtgaggcctccccagccatgtggaactgtaagtcctttaaacctcttttctttataaattgcccagtctcatgtatgtctttatcagcagcatgaaaacggactaatacactgcatgctcagtatactcaggcactctggaaactaggtttctacttcggacccctgagagaaaagggttatgtatctccaagtgtggtcatgacaagcatcactactgtgtgcagttgggcctgtggattgagccaccttagcctctgaggaaagcagaacctgagagcatgcttaattcagagtgtgtgtgacttggagtgtggaaaggaagatttccagatttgcggtattggcgactgaaaggatggcaatgctattgatggagattaggaagacaggagagaggtagatgttgagcaactccgaggagtttttcctcatacatgttgggtttaaagtgcagggaagatatcctgaaggttattccaggcagaaatttggagctcagaagagacatcagagctgaagataaaaaatttgagagccatctccgtagctaaaagtgtggaacgaatgtgatgactagacaagataatagagaaaaggtatccaaaggcctgaggtcaagacctcttaaaaggctgacttttcagggttttaggtagaaaaagagtcccagcctggggttaaggcagttttttgagaagtagaggtacaaagttccttgttccaaaggaagggtgtctttcaaaagaaaaaggatgggccgggtgcagtggcttacgcatgtaatctcagcactttgggaggccgaggctggcagatcacctgaggttgggagttcgagaccaacctgaccaacatggagaaaccctgtctctactaaaaataaaaattaaaaattagccgggcttggtggtgcatgcctgtaatcccagctactcaggaggctgaggcaggagaatcacttgaacctgggaggcagaggttgcagtgagccaagttctcaccattgcactccagcctgggcaacaagagtgaaactctgtctcaaaaaaaaaaaaaagagagaaaaagaaaaaggatggtgaattgggccaaataccagagagatggacaggagtaagaagaaaaagactaaagatttgttcatcaggagctcattgtttctaaagggagcatttttagtaaagaggaaggaggaataaaatgcagtataatatgttaaatctaagtataatttataaaagagaaaatgggggtggaatattacaaaaaaggaactataaaccagctctttgaggtatttgtcagtgaggaaaacagtggggctctagttcttgatagcaacagcatcaaagggaactttttaaactaaaatattatgaatttttcaaactgaaataatgagagaataatacaaagaaatctcatctgcccataatccaaattcagtagttattaaaattttgccccattgcttaatccattaatctcatttcattttgtcctttttctttgtttatttttggctaaaacattttaaagacaaatcctaaatatcatacatcagtaggcatttacaaaaaaatttcttgataatcacaatgccattctcataccaaataaacttataataattctgtgatatcatctaaaaaacagttcttttctacatcaaaaatgtctgtttatagttgatttattcaatttagagtccaaacaagttccatatattagacattaggtcattaatgtctgtctatttgaatttataacaatttccacttaatttattttctccagcttctgtggagactaggtaagttgttttgtagctgtctggatatatctgattgcttccttgcagtgtcatttaacttgttcctctatcctcagtgtttctgcacatggaagttagcctcatagcaggggttggcatactttagcctgcttaccaaatacgactcccttacatttttgtaaataaaatgttactggaacactgtcacatatgttggggtcatagaaagagtttccgtgtccccaagttataattgcattcacttatattttcttctagtaatttttacccttacatgttaggggtcaatttggaatttctcttcatatacagtatgcaataaagaatggcttttatatttttccaaatgtatattcagttgtctcaacaccatttattaaaaagtcagtatttctcaagtgatttgagatctacccttaattacacagtaaatttctctgtagtcttgtctttttctaatatgttaattctgtaccaagatttgttcatctgttaatggatcaatatcacatagctttgtttatagaaggtgcacattgttttaattctggccatgctatcccaccaaatattgccctttgatttttcagagttttactgtggattcttccttgtttctttttctatgtgacctttagaattaacttgtttaattctataagtaaatttattgataattttattgaaattatgtaaaatataaattggcttaggaagtactgatatctccatgacattaagtcttcatatctaagaccaaggggtgccttttcatttgttaaatattctttgtgtctttcagaagtgttttcaagtatccttatgtgtattttgcacaaatttttatatttgtgcctattggatgccacgtgcagggttaaaaaatattatacctattttatatagatatatatgtatataaaaatatatattatatatagttataatacataaatatattttaatatattatataatatatacatgtattgtatttatatatgtatttatatgtgtatctataaatatacatatgtatgtatctataaatatacatatatgtgtacatatacacatatatacacattatatgtatgtttatacacatataaatacatatataaatatactagaaagtccatggggtttcctagtatacaatcatattgtctgcaaatagagattgttataccttttcctttctattccaaagtgtctaaaagattttttcttagctagtggcattggatgacacctataatgtcttctaaaaatagtagcagtcataggcaccatttccttattcttgaatattcattcatgttacaaagtttataggaatttctgaattattaagtacttttaataggaatgaaggttattgtcattattgcatcaaaattcataagaaagtttggtgtcaaatttgtgctttgtgtgtagtcttcatcacgcttttttttttttttttaaccagtgttaaacatccattacaaaaatagtttggaagtttttctttttttttttcctatgtcctggaaggtgtaagtagaattggaattatttgatctttaagatgtaaaatattggtagaattctacctttgaaagcacctggacatggtgacttcttaataggtgagctctctggaaactttatttcttctgtagtaattggtctccttagactttctattccttctggagtcagatattgtatatcaaatcttctgttaaagttatccatttcttcttggtattccaatttttcacattgagttggacaaatgatttctgatgatgtttaaaaaatttctctggtttgatggttactttgaccgtataatttattttgtgtatttatgcttcttttagaaacttaggtcagctagtggttcctctattttgttgatttttttcctcaaagaactagcttaagtttattttattagttctactagttttctgctttctaactcattaagttatgcctttagctttattaaatccttcattctgctatcagttaatgttttagttcattttctagctttttgagttgatacttaatttattttcatttcatgatataggtaactgatgctcagaattttctcaaagcatcagttttcgctgggccccatagattctaatatatcttactttcattattattatttcctaaaaattcagcaatttcatgttttattttgtctctcattcaagagttgtttaatagacagtttaatttccaggttggatgggcattttgttttgttttttgttttactgtttataaatacttttggccttgggatcagagaatactgcttgtattacaattattactgaatatttttgtggtctaatataatttcagctttcaaaaatgttccatgtatacttgaaatgaaggtttatttacccttataaagatagaaggtaaaatattagctatgcccatgtctatttatcttcttataatttttgcttaatgaaaactaatgatccattatctgctgcataagtatttatgtttgctttctctttattatgccttatggcttttgtgttaaaaagctattgatttatttaatattttggaaggattgaattttaccctatctaatatcaagatcatgactcttgattcctttttgttttcacttgtttaatatatctttcttctatctttattttaaacacaagaagagctttgctttcagtttctattttacatagtctacaatcggattttacttattagtcaatctgagaatacttttaatagatgagttacacaaatacatatttattgataccaacacagtttaattcaagatctgttctattattttatatttattatatattaaattgtcttctttatttactatttattgatttattgaatttattttgctttcaggtattttgtatttttgttctggttgttagatttatgcatacttagtcaactcttcctttataaagcattcattttctactatgagcagtagtaaaattagctagtaacttaattcctgagcactctccagtcctagtcactagtaataacgcagtgttaaactttgtaatattaattatacttaagcctctattacttggtttgtcaaaatcaaatgatatcaatttacttccagcacatacctatgaggtaattgtaagctaataataacttccatggctattcttttctctttttttttttttgaggtggagtttcgctcttgttgcccaggttggagtgcaatggcacgatctcggctcactgcaacttctgcctcccgggttccagcgattctcctgcctcagcctcccaagtacctgggattacaggcatcagccaccccacctggctaattttgtatttttagtagagacagggtttccccatgttggccaggctggtcacgaattcctgacctcaagtgatccaccccatcagtctcccacagtgctgggattacaggtgtaagccaccgcacccagcctctcatcttatttttattacttatatttttctacattattagaagttataatacttatatgcacatttctttagccccaaccccattttttgatattagctctattattaagatatttaatgtccaccttcagattatatgctgatgattctctaatcgtttttggttgtctggagcttttttactgtttattttcaggaagagctcatgataactcttttttctttggtttaaaaatgtttataattatttttctctggactttatgctgagaaatttggctgcatacaaaatctctggcttacattttttctcaagtatttttaagtgattgcttcattattttgtagtataaaatgttgctcacaagaagctggatgccagtctgattttctttccctcattagtgatttggactttttgtctgaatgttgaatttttaaatataaacataaattgcaatacttttattaagatatgtctctgcattgaacattttaggtccgttttcctaggtacatagaatgtcttttgaatatgtagactcaaatcagacttcttgattctcttgatttatagttttaaatatttgtttgggggcgggtgcggtggctcatgcctgtaatcccagcactttgggaggccgaggcgggtagatcataaggttagcagattgagaccatcctggataacatggtgaaaccccgtctctactaaaaatacaaaaaatatagccaggtgtggtggcaggcacctgtagtcccagctactcgggaggctgaggcaggagaatggcctgaatccgggaggcagagcttgcagtgagccaagatcacgccattgcactccagccttggcgacagagtgagactttgtctcaaaaaaaaataaatagggggcggttccaagatggcagaataggaacagctccagtctgcagctcccagcatgagtgatgcagaagacaaatgatttttgcatttccaaatgaggtaccaggttcatctcactggggactattggacagtgggtgcaggacagtgggtgcagcgcaccaagcatgagccgaagcagagcgaggcatcgcctcacctgggaagtgcaaggggtcagggaattccctttcctagccaaggaaaggggtgacagacggcacctggaaaatcgggtcactcccaccctaatactgggcttttccgatggtcttagcaaacggcacaccaggagattatatcctgtgcctggctcagagggtcctacacccacagagcctcgctcattgctagcacagcagtctgagatcaaactgcaaggtgcaagcgaggctaggggacgggcgcctgccattgctgaggcttgagtaggtaaacaaagtggctgggaagctggaactgggtggagcccaccgcagctcaaggaggcctgcctgtctctgtagactccacctctgggggcagggcatagccaaacagaaggcagcagaaacctctgcagactgaaatgtccctgtctgacagctttgaagacagtagtggttctcccagcatgcagcttgagatctgagaacgggcagactgcctcctcaagtgggtccctgacccccgagtagcctaactgggcacaccccagtaggggcagactgacacctcacatggccgggtactcctctgagacaaaacctccagaggaacgatcaggcagcaacatttgctgttcaccaatatccgctgttctgcagcctccgctgctgatacccaggcaaacagggtctggagtggacctccagcaaactctgacagacctgcagctgagggtcctgactgttagaaggaaaactaacaaacagaaaggacatccacaccaaaatcccatctgtacgtcaccatcatcaaagaccaaaggtagataaatccacaaagatggggaaaaaacagagtagaaaaacagaaagttctaaaaatcagagcacctctcctcctccaaaggaacgcagctcctcaccagcaacggaacaaagctggatggagaatgactttgactaattgagaaaagaaggcttcagacgatgaaaattttctgaactaaaggaggaagttcgaacccacggcaaagaagttaaaaaccttgaaaaaagattagacgaatggctacctagaataaccaatgcacagaagtccttaaaggacctgatggagctgacaaccaaggcacaagaactatgtgacgaatgcacaagcttcagtagctgattcaatcaactggaagaaaggttatcagtgatggaagatcaaatgaatgaaatgaagtgagaagagaagtttagagaaagaagaataaaaagaaatgaacaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacattcacattcaggaaatacagagaacaccacaaagatactccttgagaagagcaactccaagacacataattgacagattcaccaaagttgaaatgaaggaaaaaatgttaagggcagccagagagaaagattgggttacccacaaagggaagcccatcagactaacagcggatctcttggcagaaactctacaagccagaagagagtgggggccgatattacacattcttaaagaaaagaattttcaacccagaatctcatatccagccaaactaagcttcataagtgaaggagaaataaaatactttacagacaagcaaatgctgagagattttgtcaccaccaggcctgccctacaagagctcctgaaggaagcactaaacacggaaaggaacaactagtaccagccactgcaaaaacatgcaaattggaaagaccatcgaggctaggaagaaactgcaactaacaagcaaaataagcagctaacatcataatgacaggatcaaattcacacataacaatattaaccttaaatgtaaatgggctaaatgcttcaattaaaagacacagactggcaaattggataaagagtcaagacccatcagcgtgctgtattcaggaaacccatctcacgtgcagagacacacataggctcaaaataaagggatggaggaaaatctaccaagcaaatggaaaacaaaaaaaggcaggggttgcaatcctagtctctgttaaaacagactttaaaccaacaaagatcaaaagagacaaagaaggccattacataatagtaaagggatcaattcaacaagaagagctaactatcctaaatatatatgcacccaatacaggagcacccagattcataaagcaagtccttagtgacctacaaagagacttagactcccacacaataataatgggagactttaacatcccactgtcaacattagacagatcaacgagacagaaaattaacaaggatatccaggaactgaactcagctctgcaccaagcagacctaatagacatctacagaactctccaccccaaatcaacagattatacattcttctcagcaccacgccggacttaatccaaaattgaccacatagttggaagtaaaacactcctcagcaaatgtaaaagaacagaaattataacaaactatctctcagaccacagtgcaatcaaactagaactcaggattaagaaactcactcaaaaccgctcaactacatggaaactgaacaacctgctcctgaatgactactgggtacataacgaaatgaaggcagaaataaagatgttctttgaaaccaatgagaacaaagacacaacataccagaatctctgggacacattcaaagcagtgtgtagagggaactttatagcactaaatgcccgcaagagaaagcaggaaagatctaaaattgacaccctaacatcacaattaaaagaactagagaagcaagagcaaacacgttcaaaagctagcagaagacaagaaataactaagatcagagcagaactgaaggagatagagacacaaaaaacccttcaaaaaatcaatgaatctaggagctggttttttgaaaagatcaataaaactgatagactgctagcatgactaataaagaagaaaagagagaagaatcaaatagatgcaataaaaaatgataaaggggatatcaccactgatcccacagaaatacaaactaccatcagagaatactataaacacctctacacaaataaactagaacatctagaagaaatggataaattcctcgacacatacaccctcccaagactaaaccaggaagaagctgaatctctgaatagaccaataataggctctgaagttgaggcaataattaatagcttaccaatcaaaaaaaagtccaggaccagacggattcacagctgaattctaccagaggtacaaggaggagctggtaccattccttcggaaactattccaatcaatagaaaaagagggaatcctccctaactcattttatgaggccagcatcatcctgataccaaagcctggcagagacacaacaaaaaaagagaattttagaccaatatccctgatgaacatcgatgcaaaaatcctgagtaaaatactggcaaaccgaatccagcagcacatcaaaaagcttatccaccatggtcaagtgggcttcatccctgggatgcaaggctggttcaacatatgcaagtcaataaacataatccagcatataaacagaaccaatgacaaaaaccacatgattatctcaatagatgcagaaaaggcctttgacaaaattcaacaacccttcatgctaaaaactctcaataaattaggtattgatgggacctatctcaaaataataagagctatctatgacaaacccacagccaatatcatactgaatggacaaaacctgggagcattccctttgaaaactggcacaagacagggatgccctctctcaccactcctattcaacatagtgttggaagttctggttagggcaatcaggcaggagaaggaaataaagggtattcaattaggaaaagaggaagtcaaattgtccctgtttgcagatgacatgattgcatatctagaaaactccatcgtctcagcgcaaaatctccttaagctgataagcagcttcagcaaagtctcaggatacaaaatcaatgtgcaaaaatcacaggcattcttatacaccaataacagacaaacagagagccaaatcatgagtgaacttccattcacaattgcttcaaaggaataaaatacctaagaatccaacttacaagggatgtgaaggacctcttcaaggagaactacaaaccactgctcaacaaaataaaagaagatacaaacaaatgcaagaacattccatgcttatgggtaggaagaatcaatatcatgaaaatggccatactgcccaaggtaatttatagattcaatgctatccccatcaagctaccaatgactttcttcacagaattggaaaaaactactttaaagttcatatggaaccaaaaaagagcccgcattgccaagtcaatcataagccaaaagaacaaagctggaggcatcatgctacctgacttcaaactatactacaaggccacagtaacgaaaacagcatggtactggtaccaaaacagagatatagaccaatggaacagaacagagccctcagaaataatgccatgtatctacaactgtctgatctttgacaaacctgagaaaaacaagaaatggggaaaggattccctatttaataaatggtgctgggaaaactggctagccatatgtagaaagctgaaactggatcccttccttacaccttatacaaaaattaattcaagatggattaaagacttaaatgttagatcaaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagagaaactaccatcagagtgaacaggcaacctacagaatgggagaaaatctttgcaatctactcatttgacaaagggctaatatccagaatctacaaagaactcaaacaaatttacaagaaaaaaacaaacaacaccatcaacaaatgggcgaaggatatgaacagacacttctcaaaagaagacatttatgcagccaacagacacatgaaaaaatgctcatcatcactggccatcagagaaatgcaaatcaaaaccacaatgagataccatctcacaccagttagaatggtgattattaagaagtcagggaaaaacaggtgctggagaggatgtggagaaataggaagacttttacactgttggtgggactgtaaactagttcaaccattgtggaattcagtgtggcgattcctcagggatctagaactagaaataccatttgacccagccatcccattactgggtatatacccaaaggattataaatcatgctgctataaagacacatgcacacgtatgtttattgcagcactattcacaatagcaaagacttggaaccaacccaaatgtccaacaatgatctggattaagaaaatgtggcacatatataccatggaatactatgcagccataaaaaaggatgagttcatgtcctttgtaaggacatggatgaaactggaaaccatcattgtgagcgaactatcacaaggacaaaaaaccaaacaccacatgttctcactcataggtgggagttgaacaatgagaacacgtggacacaggaaggggaacatcacacaccggggccttttgtgtggttggggaggggggagggatgcattaggagatacacctaatgtaaatgacgagttaatgggtgcagcacaccaacatggcacatgtatgcatatgtaacaaacctgcccattgtgcacatgtaccctaaaacttaaagtacaataaaaataaataaataaataaataaataaatactagtttggctgcattgctttgattttcttctttaggggcctgttcatacatacaaaggataccatttacctgtcttctatatgactttctcttaaatcctttcattcttttgttttaatttttatcttcacatcctttatttctgtcactgtgctgtccatagagtttgtctgctgtgtgtccttataattaagtctatgttctgaatgtttttccttttttagaaattcagttctaaagtgtttaatttctcgtatttttttttctgttgcctcaccatatcatttctgagttttctgtttctgaaatgtgcaactaactctttccaagcattgaccagattcttcagtctttttaattcattctgaaataactgggctacagtttcatctgctttgtggacagaagtgccacaaagagccgaattgtcagtgcagacccacatgaatcatagatcttaacgaggtttttactaacgactagcaaaggatacaagctaaaaatgggtacaagcaaacacagcatcattcatcactgtaaagactctgaactatcacatggaacttcaaaaggattcttcttctttgctgcaatgtgttttgatttttggagtgatagatgtttgctaactacgcacgtgacaaaaatttgcttagaggaagccatgttagttttgatgctactcaactttgtattttgttagtcatgagatagaaagcctgtgagattacatgcccttcttttagcagctgcatcccataaaattaaaaattccagttttttttaaaccatgaacaatttagtcagacttaatatatcctatttaaaacattcttagataagaacttcctttgttattttgctaatatacaatcccaccaaatgtctacaagaagggctagttaatcaatataccaaagatcaaatctatttatatgaaccacaaatacaaaacataattatacatatataattttatataatttaatttataattatatacattttatagcagcaatcaaaactatcatgtattttgggatgaatttaataaagaaatagcaggagctctgtagaaacaagtatgaacttctattggaagacagtaatatcataaaacattaaaaagaaagctataccatgtttatggttaggaagattcactattgaaaatacatcaattcttgacaaatcggtctataaattcagtgcgtgtccaatcaatatatttagctcatttaaaatgtatatggaaaaggctaagtaccaaagataatcaaatgctcttggaagatgaaaattaaagttgagagatggggtaaaaaactataattcagttctaaagtcataaagctataataattaatacagtatggcattggcatagaaataagcacattgactaaataaatagaaaatacagttcagaaaccaaactctacatttatgaaaaactgacctatatcagaacgagcattgagactacaggagaacagaggaactagtaagttaatggtcctgacacaattgatatctacatagaaaaaaaaacttaatccttctttactctatgtaaaaacaataattccagatgaatgtaggacttaatggagagccaaaactaaaacttttataggaaaacatagaaaaatacctatctcagggtcgggaattaggtcttcaacatggcaccaaaagtactaaccataaaagaaacattaataaagtcaacctttttaaaatcaacaactttaattaaaaaaccagggccaggcacggtggctcacgcctgtaatcccaggaggccaaggcaggcagatcacgaggtcaggagatcgagaccagcctggccaacatggcaaaacctcgtctctactaaaaatataaaaattagctgggcgtggtggcgggtgcctgtagtcccagctacttgggaggctgaggcaggagaatggtgtgaacctgggaggcggagcttgcagtgagctgaaatcgtgccactgcactccagcctgggcaacagtgcgagactccatctcaaaaaacaaaaacaaaaacaaaatcaaaacaaaaaacaaaacacaggttgctggaaaaatggttacttatttttattatgctttataaaatatacagttatattatcaaacttcttttgtaagaatcaaatattatgctgagaatatggcaagaaaaaagaaaacaacctccaccactcataatggcattccctttacccaccatcaactaagtcaggaacctgcgtcactttcaagttttctgaaatgtggactgaaaatacttgtggagggccctcacagatgcatttagaaatggtatgttctggaaaatggaactgaaatgttttagcgagagtcatgggcccaaaccttgaaatagaggttggtggagttttctatagtatgtaattacaacacaataagactcaaaagcatttcaataaagtgtggatggaagacaagatactgcttcaagggcttcattagctttctgcagactggagctctccaaggcatggggaggaaccctgtttacctttggttcagaatcagttttaaccatcattgagggctaggtcagagtgcagcattaagtccttgggaatacactgggtggggaaagaaaagagagcaatgtttttctaaaagcccagaaatgggcttactgtgtttaccagttgtttccaggataatgtattgcagtgccaattgctgatgagatggtaggattatacttcagtccctgctttacatttatttcttaaagaagcttctggtaaattagagcaatagcatcggcttagtttagtgttgttctgttggactaaggatatcagttctatccgtatggtcgggcctaaagcctgggaaatatttaatgaagggagagagggggagagagtgagcatgcaaaagagagagagaaaaacaaataacaaaacaaaaaccaagacatttccctttatagtaagaatgatgaggaaaacatgtttagccatacaagatatcaagataatctcttatttctttcttgaaaatgcaagtacaaatgcctgcaaagataaaatatcctctggatggagtggaaaggttcaccaggcctctgaaatcacgtgaatgatgttgcgctttgctgttaatgaagctcggtgcatttttcatttcagtttctactaagcatttatgagctattacccttcccttccctaaactgcgttgttttttaaaaagccttagaggcattccttctagaaaataaaggtaagtgttaagtggtgataatttggtaataggtgtcatgcttgtggttcataatgtgttaccctacacattttctcaattatccctagaacagctttttgaggatatgaagttagaccttacaaagcacatctttctgctggaaaaatgaggtttatagtggttaagtttagttgcttatgatcacaaggctagagagtggccggaatcaagactcttcaccctgatttcagtgctttttcactccaccattaatatttattgttgataaataatatcaacactttcctaggtgtattagggtcatctagagggacaagactaataggatagatgtatatatgaaaaggagtttattaaggagtattgactcacaccatcacaaggtgacgtcccacaataggccatctgcaagctgaggggcaaggaagccagtctgagtcccaaaacctcaaaaatagggaagctgacagtgcagccttcagtctgtggccaaaggcccaagagcccctggcaaaccactagtgtaggtccaagagtccaaaagctaaaggattggagtccaatgtttgagggcaggaagcatccgtcatgggagaaagatggaagccagaagacagccagtctagtccttccacgttcctctgcctgcttttatcctagccacgctggcatgatgatgacatggtgcccgcccagattgaggatgggtctccatcttccagttcactgacacaaatgttaatcttctttggtaataccctcacagacacacccaaggacagcactttgcatccttcaatacaatcaagttggcactcaataataaccatcacaagtccacaccttgtcaacttgatcccacatacatctccttaaatcatacatgatctccaaatacagacaataatgtcataattacactgaacataatacaactatcgttcatacaaccagaaatgcaccaattcccaaaccaaatgttattacataaagttaacaacacttaaatgctgatatgaagtcaataaatactttttttttttaaaagatggagtcttgctttgttgcccaggctggaatgcagtggtgcgatattggctcactgcaacctccgcctcctgggttcaagcaattctctgcctcagcctcccgagtagctgggattacaggcacccaccgccacacctggctaatttttgtatttttagtaaagacggggttttgccatcctggccaggctggtcttgaactcctgacctcgtgatccacccacctcggcctcccaaagtggtggatcccaaagtgatccacccaccttgacctcccaggttgtaagccactaaatcttatgtcacatgatacaggaaaaagaaaggaagtaaaatgaagatattgtcttagtacaagtgtatacaggcagaaagatgttcttaacaaaataaggaggaaatactcatgacaattacagtaacctggttgctgcaactcatcacatggtcgtagctgttattgatgactaccttcttctacaacccattctgttttccctttgcctctagcaagtacctcagcaggtcatggttctttacctggtggagtgtcccaaaccttcattcctgaagggtctgggccatttgtagtcctgcctggatcgagttgttgtcattttttattgaccttaatcacagggcttggtaatactaagagacaccctaaggaatttcctgtattccacacatgttcttccttaccttcattatggagtagtagactgagttcatcttgataggctaagtcagtcaccccagccaacactaactcctttcttagcctgttgacttagaggtaggaggagcccgagattgcaatcttaatttccagtttaatgaaatcattattgtgtctcctggtggcaacattcatcgccctggaactgagacttctaggccagcagaacgtaatgctgtggaacaagaagcacaaattttactagcgggtctctaggggtgatggtgagtggtgccacttccatttccaccccttgattcctggacccatgaatcctggctatgggagaaacagtaccaaatactggacactgatccggagcatacacagccttctggaaaactttgccccagccctgcaaagtattgtcgcctagttggcattgtaattgtgacttcaaaaggccattccaccgttctatcaatccggctgcttcaggatgatggggaacagggtaagaccagtgaattccatgagcatgagcccactgctgcacttctttagccataaagtgagtgccttgttcagaggcaatgctgtgtgtaatgccatgacagtgggtaaagcattccataagtccatggatggtagtcttggcagaagcattgcctgcaggataggcaaacccatatctagagtaagtgcccattccagtgaagacaaaccactgttctttctgtgatggaagaggttcagtataatcaacctgccaccaagtagctggctgatcaccccgaggaatggtgccatatcgcggcctcagtgtttgtctctgctgctggcaaattgggcactcagttgtggctgtagccaggtcagccttggtacgtggaagtccatgttgctgagcccgtgcgtaacctccatccctgccaccacagccactttgttcatgggcctattgggcgatgacaatggtggctggggaaagaggctgagtggtatccacagaacgagtcatccaatccacttgattattaaaatcctcctctgctgaggtcatcttttggtgagcactcacatgagatacaaatatcttcacagtttttgaccactcagagaggtccatccatccacatacctcttccccaaatttcattgtcatcagttttccaatcatgcttctttcaagtccctgaccatccagccaaaccattggctacctcccatgaatcagtatataatcacacatcttgccatttctccttctaagcaaagtgcacagccaggggcactgctcaaagttctgtgcattgggaagatttcccttcactgctgcccttcagggatgtcctagaaaggggctgtagtgctgcagctgtccacttttgggtggtgactgcatcatgcagagccatctgtaaaccaggcccttgtcttctcttcctctgtcagcttatcatagggaactccccatgaggccatcagtgcaggctgggggagagaaggcagggtggcaggagtggggaccatgggcatttgagctacttcctcatgtaaagtacttgttccctcaggacttgcttgagcctgatcatgtatataccacttccatttgatgatggaatgctgctgtgcacaacccactttatggctagatgggtcaaaaagcatctagttcatgataggcaatttaggtagcttggtgatttgatgacctgtagtcaaacatacagtttctaccaaagcacagtaacaggccaagagttgtctctcacaaggagagtagttatctgcaggagatgcagggccttgctccaaattcctagaggcctcccctgtgattgacctataggggcctgccaagggctccaaacaacatccctatctgccattgacacttcaagcaccattggatctgccaggtcatatggcccaagtggcagagcagcttgccaagcattctggacctgttgcagagccttctcttctggatcccactcaaaactggaagcctttcaggtcacttgataaatgggctggagtaacacacccaaatgaggaatgtgttgcctccaaaatccaaataggcctgctaggcattgtgcctctttcttagttgtaggaggggccaaaggcagcaacttatccttcatcttagaaggaatatcttgacagaccccacaccactggacccctagaagttttactgaggtagaagttccctaaattttagtcaattttatttcccaacctctggcacacaagtgtctcaccaataaatccagtatgtttgctacttcttgctcattggatccaatcagcataatgtcatgaatataatggaccagtgtgatatcttgtggaagagaaaaactatcaagatctctccaacaagattatgacacaaagctggagaatcgatatacccctgaggtaggacagtaaaggtatattgctggccttgccagctgaaggcaaattgcttctgctgggccttatggacaggaatggagaaaaagccatttgccaaatcaatggttgcataccaggtaccaggagatgtgttaatttgctcaagtaatgaacccatatctggtccagcagctgcaattggagtcaccgcttagttaagcttacaataatccactgtcattttacaagatccatctgtcttctgcacaggccaaacaggaaagttgaacggggatgtggtgggaatcgccacccctgcatctttgaagtccttgatggtggcactaacttcctccagggatgcaatgttgtgtttgatttactatttttctaggtagaggcagctgtaatggcttccatttggcctttcccaccataatagccctcaccctaccagtcagggagccaatgtgggggttctgccagctgctaaatatgtctatgccaattatgcattctggcactagggaaatgaccacaggatgagtctgggacccaccagccccactgtaagttggacctgagctaaaattccattaattaactgatctccaaaagcccctactttaactggaggaccacgtgatgttttgggtcccctggaatcaacgtcagctcagagccagtgtccagttgtccctgaaatgtctgattatttccctttccccagtgcacagttaccctggtaaaaggccagaggtctcctgggggaaggatgggagaaagagtcactgcataaattgtcagcaatgtagtggggtccttcctcaaggggacccagcctccccttcattcaaggggttctgggtctataaactggttcaagtctgcaaattgattgaggggccgtgattctttgtataatttttaatttaaattagtcttttgtctacttgacctggaagttttctgcttatataaattaagcaagaatgcagtaggcctcttgtcaatttcactttttaggaacactgagattaagtagccaatgccagagctctacacaagtcagactattctgattgttgccttgcctccgctgacctttacggtaattgcacccaccttgccttgatgcttgagtgccaccacttggcccatgccacctcaggatccaattattaccattgtatttaaattttgtagttgaatgactgtggttcccactataatatctagcatgcagagaagagcaatcacagagctcttcaaggatgcaggtgctgccctcacaaatctatttcacaatgtgctggtcaaaggtatatcttctgtactctcccagctgggatgagtaggactaaagtgacgaattcactccaccatcccagtctccataagcctttggatcccttcctctacattaaaccaagggagatcaggcatttccagctcactcacagtgggccaccttttgatctatatttcagctaaccaagcaaataaactattagaaccttttttaactctccaagctgcaacattaaatgcagaattcctgcttagtgggcccaaatcaatcaattcagcctgatccaactttatgttccttctaccattagcccacacccttaatatccattcccatgcctgttctccagatttctgcttatataaattagaaaactcaagcagttcttttggagtgtagcgcacctccttgtgggtcacattctgaacctcatctctaaggggcctgccgggactttagtctagttctataactataagcaaacaggggtattgagggtgggtccttaggagaatcaacatcgtctttcctggcaactgcctcaagggaggtcatcgctgatgccttaggcagtgcagggttaaactcctcagacaaaggtgaaaagcctgatggcagcgcaggtggaggaggggatgttgcctcccctctgttgcctgtttcctctggtaaaaaagattcatcagaatttagaagctcagtgcccccagccttatcagggtcctcccgcatggccccattccaagttgcagggtaccattctttttcaatcaatgctgtcactttaacagtaaacacctggcaaggctgtgcacgtacctttcgttgcaggtcagccactcacatgataagagcttgtgtctgattttccgcaatttcagctctttctctacaggagataagactcgaacccagggcaatcttagaagatttgaggctcagaatgtggttctggagctgggagatagaatccctgagttcatcatttttttgttttcatcactttgattagtgaacttaggagcaaccaactagcttcattatattccttggttctccacatatggttaaaggtattaggtataaagtcactaaactccttgcctctcatgagcagtgaatcaggagtatcagatgcatttattttgcataactctctacacagttcacagcaaggactatcagtgttctccacactattagaagtagagtccctagcattttggcgtctaatcatatttagcagccaactccagaaaccccaaaaccatctaaagaaatccatccgtaaaattctgttcctctagaaccactcctggtaccaaaatctgtattagtcaggattcgctagagggacaggactcacaggtgagatgtatatataaaaggcagtttattaaggagaattgactcacacaatcacaaggtgaagtcccacaatagtctgcaagctgaggagcaaggaagccagtccaagtcccaaaacctcaaaactagggaagccgacagtgcggccttcagtctctggctgacagcctgagggcccctggcaaaccactggtgtaggtctaagagttcaaaagctgaagaacttgtagtccaatgttcgaggccaggaagcatccagcacaggagaaagatggaagccggaagacttagccagtctagtccttccatgttcctctgcctgtttttgtcctagccatgctggcagctgattagatggtgcccacccagattgaggatgggtctctatcttccagtccactgactcaaatgttaatctcctttgacaacaccctcacagactcactcaggaacaatactttgcatccttcaattcaatcacattgacactcagtattaaccatcaccctaggctttagggatatagggaaaaacatgactcattgctgttatctgagagtacataatctattggaagaaaggaaaacagttacatgtaaggcttatatcagtataaattagataactgccaagtgagagaggtagaggtagcaagtgctgtctgtgggtgcatgttaactcagtcttaatcttggaagaagtggcagtgtggaatggtacatggagaagcagaagggacaattactgtgagcagatgaatggctcactacaggggcatgggaagaagatgcaagagcagtggaatctttaattgacgaacctggtaccaagctgccaagtcttagtctcaggactggcaccgtgcacttggccattgaaaagactttggaacctgtggagtgaagagttgtaggaattttcaaagcctcagtgtaggaacaatgtgagaatcaaccagggcatggtactccacactgtgttcagatccactggtgttaggggagtcccagagaggcctcttagagggttgaggaggatgggatcaggcatagcagagactagggacacgaggctctgcggccagactgcaggtctgctaccaactacagtgtgattttgcctagtcacataatctctgtgggcctcagttttttgttttttgtttttttctattacaacagtacctttctcgtggagttgtagtgattagatatctagtaccaagactatgcttgttagcactgagtaagaactcaatgaaggttagctttcattggtactatattactattgttagtgttggtggtggagctgaatcgcctaacctatgaggttggtgctgaaatgaagaaaagaataacagtgttttaagaagtttggtcactagaagtggagcttagtaattaaagaaaaagagtgaacacttttaccttcttgtggaagttagtaagtctacaaaatgttaattctgcatttgaatgatcatttgggagactcttattgtcctatttgcactgaaaaagtcactgaatcattattttagaactggaataacacctgagatctaggccagcactttgcaagttgtgctctatgggacttttcatggaagtggctgaggagttgccttgaaggaaggcagagggagtgggtcttgggacacccttccagttataaaacaggacgttgattctgttttgtagttgcagcatcacatataatttcatttattaagaggatcccacttctaaaaataagttgaaaaccagtgatttaatccagcctctctgtttgcatatgaggaaatggaattccggaaaggttaggtgatttgtccaaggttgcagactagactatttattaatagagtagggtcaggaacaaaagcctgctccttgctggtccagcgcctgttactagttacataatgaatgctacctattgctgcacagtgccaaatcattgcacttttcagattttactctaatcaaaagaaaaaaattaaagtgcacttccaaatcagtacttatatgcaagagcttcaagaaacaaactagtatttaacttggtggttacatattgactgtattttcattgagtgaggttagaagagattgagaagcgtgaaatgaagttacaaagtagaaactatatggtgaactcaaggcaaagattgtccatagtaaaagaagacaaaataagaatgaaagagacaaaagaattgccaatgagttgtaatcttaaaagaaagatatatttaataaaataggattgattgttttgaatgtgggctgagaagtcctgccatcttccattgactctgctcacaggccttgtttgtgaactggcttccatggatagcattactctcctgacagctgcagctccaaattcagcatgaaaaggctggcaattctaagaggaagggagggtttaggccacttttaattctactttgtcattgcaagtttcttgcattgtttggcatttgttggtcttccttactggatttcaaaactagaacactttttcctagccttggaaccaaccacgaaaataaccacctcttaccctcatgaagaacactttaagtttttctcttttaaaaatgaagtctggaatatctccaaacatcttgtcactcacgccttcatttaaatgtcaccctctcaaccacaaggaaactaaaattgccccctacttgctactccctgttttattttctagtagaacatactacagttggagatcatctcatccatgtcttttattcttgtctcttatttgcctctgcttgactgtaagctcatggaaagtaagggaccttcaccaactagcaaagtgcttaggacctagtaagaacctggtcaattctaactgagtgaatgactgaattcctgtgagaagtcaacatgaaaattcctaggtcattagtttagttattggaactccaacactgtattggaaaagtgtcatggaaaggatagttagtggattaaggttttttataagaggaagagggaaagaaaggcattgtctttacttcaggcatttcaatggccatgatggagcctaaatattgtatgttgcattttgttttggttttgtgtgcacaagagctttgccagtggaatgaacgggttaagaaatgtgagttttcttttcgtcctgctatagagacttaaggaattgccctgtgtgagttccttgagggcagagaaaaatacaaatccatgaatacctgaaagccctgatttggcccctaagcaatctatgcatgtaacaacattgcatttgtaccctgtacatttataaacattttaagaaaagtataagagaaacacaaattttggttactcctctctgaaaactgctctgatgtcgcttggccgggggaattaagacctcttcctgtggcctgtggccactatgtgctcccggctctccaggctcatccagggccactgtgcctggggtcacagggttccaggatgtcaaccttctttcagcttctctgactcctcaagcatttttttttttttttttttttttttttggtttccaagacccaaacgcatgtctctcttcttggcacactcttcccaacttttttcctggctaattgctagttatttagtttgagattaaatgtcactccctcggcctggcgcggtggctcacgcctgtaatcccagcactttcggacgccgaggcaggtggaccacgaggtcaagagatcgagaccatcctggccaacatggtgaaaccccgtctctattaaaaatacaaaaaaatttagccaggcgtggtggcatgtgcctgaagtcccagttactcgggaggctgaggcaggggaattgcttgaggaggatattgcagtgagctggatcgcacctctgcactccagcctggagacaaagtgtgacaccatctcaaaaaaaaaaaaaaaaaaaaaagtcactcactcacagagggcttctcagatactcccctgccccctcatttaagttgcaccgcttgttgtattctcttataagccccattctttttcttcttggcattgatcaaattaacagctttattttattttagcattgtgagtgtatatgtgtgtttaatgtctgcttcctgactaaactgtaccctgcaggaaggcaaaactgtgtctgtgttgctcattgttaaaccttcagcactgaactcagtgcctcgaacataggagattccaactcaatatttactgcgtgaaggaatgaatgaatctttatgtccctcgtgcctaacataaagtctgccatatacaatggactaaaaaatagtattcagctaaaactgagttacggagaagatgaagtattaattgtattttttacagagaaacaatggtcagtgtatcaaaaatagagaccctgctctcagatatataacatagaactctcttcattcatttgccttcattttagttaacagaatctgttcatctaagtagagcagagaaaaacttcataattgctgtgtctgtgttattccaaaacatttaaacaaaaggtgaataactgaggtattcttccctgtggtacatacttgatgtgggcattttaaaagattgatcaaatctcctttcagctggatatttgagtaggcacaaccattacagaattttcctctagggacttactttagctcttaaactatgtaaactgaacaagcaaactcaagtggatcattatctatagaagtatagaattccatctccctttggcaaaccattcaaacccagaagtgtgttttacacattctgacagaagcatctgtaataaccaactctaacctcctttcttaccactttagcacccaaaagtataagaaaagaggacatgttaaggcttgttctatttattagaaaatatataaagagttcttggcttaagaactcttctggctatcagctccctgatgtgaaaaaagtaaatagcaaggggtagcatggagtcttactcccgtgtgacagacagcttaagaaagacaattggacatcatgtgactacatgattcaagctaaagtccagacacatcttttccataggccaattgaacattttctctgtaatttccacaataaccatttgcaccagcatgaatggagagggtctgagttcttctgggtgagtaaagggtgtgtcagttatctgtcctctgtcaccaggatttagaggcaggctcatagtgactcttgtaaagttgaggttcgcctgtggaggctgcaaaaaagagggaggaagagagagtgaggttcctcttggctctgtgccagggatgtgattagaggaccctgggagggccttcatcctacgaggggttggaagtggaaatggatgtgtgtggatgacctggtaacgtgtcacagccccttccaccccatagtagtcagggatttaatgcctcaacaaggcaggtctctgaaggagactgacttttctctctctctctgaatgatactgcctgagagaaatactcacttcctgctttgttttcaacaagtatggacttccttacacaaaaagaatcttttttgcttttgtccccccatttcactggaaatctatccactgggcaccactgttggtcggcttcctttcatagattcctttatgtttcaaattttaaaaagacaataatagcaacaaagtgaaatatggatttaagctaggaaaagcagagaactgaaacttttttcctgcaatcatacttcccagcttcttcagcaagatctgcttggctgggaacatgccttctgagaactttacatttctaaactgctgctaaattgctccatgcatttattcctcaaactctcagggaagatagcactggctttcagtctcataccaaccattcttaaggtaatggaccaaaagtcatttccacttgaaatataatccttctaaatgaatcatgcaacatggtttttacctccattttttcagaataactctaagatgatgatcctctggccatattttaaaaatttctcttatttgttttaattttcttccattttttctttaattttgtatccagacactgccttctctaagaggaatgacatttttgcgggttatcatgatatatttttagcccatttgccttgacccatagcttacaacagttaaagaacactaacatataaacatagagttttgcccaaggccattagctttgcatgttaacaagtgggcagaaggaaggctgggcatgagagagacatgctgtccttctggtgagatcatcaatcccattcttgtaaccttcagatcattgcatttgttcagaatcgtctgcagaggaaaacatctcaaagttgggaggttgttgaagagtcagaaacaaatgggtcctgggtaatttttcaaaacaggctttttgtcaattgtcagtcagctgtttaatattgtcaattgtcactcagctgtttaatattgtgctttgttataaggataggcactgtggtctcagcgttcttaagcttttacatttccgttatttggttttacttctgcattagtagagtagatgtagagtagatgccacctctaggaactctaccagcagcagcatcttagactagaagctccctctctaggactataatctctgtagcctccacttctcccaccccttatttcttctgagcctacttggtctttgatacttactataatactttctattctcttatcataaacagttttctgatttcattttcctctggtttcatactaagccccataatcagtcactgcaagattaccttctagaatttctgtgccctcaagttttctccatatctagagagtcagtcatctgccttgagccacatccactgtctactttcttcacttccatccccaggctgcccagcactgatgaaaacaaaacaaaaacaaacaagcaaacaaaaacaaaaacaaaaaactgactaggatctcaatctggtttgcaaatccatgcttctctttcttgacttctttagacatcaacagaattgacgcctcctcttgacctgggacacccctcctccttggtgctttcttctacctccccctgcttctctgtatgtcttttgcaggctcatctttctcttaggctgtcttcccccatctctcctctccctctgtgcactcaggcagtctcccttgtcaacccccaaaactgcttctccagaccccagtgtttctctgagctccaggtccacaattctctaaggtccatgtggatgtccctcaccatttcaaacttctcttccacagggagtccctggttttcactaccatagcatattaaaataccatgcatttcccttcataccactaattacaactttgtttcttttttttaaattttatgttttaaaaattatcttctgcccacatatattgtaagctccttttgagaaagacacattgctgtcctggtcattactatattcttatcaactagcaggggccgtggtcggggcttgtgttagtccattttgtgctgctataaaggaatacctgatgccaggtaatttataaagaaaataggttttatttggctgagggttttgcaaactgtacaagaagcatggcgccagcatctacttctggtgaggcctgaagcagcttttactcatggtggaaggcaaagagagagcaggcgtttcacacagcaaaggagagagcaagagagatgccaggctccttaaacgacctgctctcccataaactgaaagagcaagaactcactcattacggtaggatggcaccaaaacagttgtgagggatccaccccgaacacctcccaccatgccccacctccaacactgggatcaaatttcaatgtgagatttggagggaacacacatctaccctttatcagtgctcaataagctcgctgaatgtagaacagtgatataaggcaggggtgggccaagtataggcgacaggacaaatttggcctgctactgcttttgtaaataaagttttatttatttacaaaataaataaataaatacagtcataatcattggttacattttgttcaaagctgcttttgcattaaaacatcagagttgagtagctgccacagagactgtaatggccccacaaagcctaaaatagttaccccgtggtcttttacagaaaaagtctgatataaaggacagtctcacagcacagaggaaaagcatataacccaaaggaggaaagagtagagcatagtggactgcagagaagtttccctggacccaatctgtgccttgaaagatgagaaggacacctccaaaggcaggatgggggtgaggtggggtgggcggtggtgatccaagcagacagcacgggcaagtgttctggaaaacttgcctttgttcacaagtatcctgcagtataaattgcaaggtgggcagtaagaaatggacttgaagagattgaacaagggccagaaacccaaggacattgctaaggagtttgtgccttagcccatccagggccctagcagccttgactgatgcttctgaggtcctggaggctccaggctcaggctaccttcccatattctctgaaaataatatcacatttgtttagtaaaaaaattgtttactaaaaaattaacctctcagaatttctgcattcacatttatttcttctcatatcctcgagttagaaaaaggtatttctctcctgtgatgatattgattctgcactcatctattttcattactgtctccttccctccctccctcagtccctcccttagtctatctcactctaccatcttttcctttggaccttctgacattcaacatcttggtcgctcctatccagccacacctctgaccattcaaccatttgtcctcttgattggttccaccttgtcctatcacgctggatatgctgttgctcccaaattgcctccctctgccagtttcttgccccttcctccttctgtctctccctctctctttcaatctttctctccctcagtctctctttctctttccctctctctcaatctttctcttcctcagtctctctcccattctctttctctttctctcaatctctctcttcctctctctcttatcctctctttctctcaatccctctctccctctttctctctctcaatctgtttctctgttaatctctctttctctctccttctttctgtctctgtctctgtctgcctctctctctctctctctcttccctagtgagctcacttgctttcccagtttcagtgatttctattcagatatctccaaaatttgtatttccggatattttatgctttcatggaggccgtgtaaattggtataacctttttggaaggcgttttggcaatacttagtaaaaggttaaatgtttacaccccttgattctgctattgtatgtgtaaggattttttcctgcatacttttgtaagtgtagaaaatatatgtataggaataattgcacattgtttgttgtagctgaaaattacaaataatataaatgcctataatcagagcagttaaatacatatgaacacagtgaaataccaggcactcatttaaaagatgaggtatattttaacaagcctatttgaaaagatacccaatcttagcaagtgaaaaaaaaactcatcaaattgatatatttagcgctgtccctctctcaagtttcagacccacattttcaattttctgttgtcatcttgacttagtctcgtgaaattttaaactaatcatttttaagggaagatattttcttcccttaaagatgaaattcagacaaacctctgaatttccctctttctgctaatttcttgctttcttttatcatctttccatccatcctaacatacagttccagaggagtctttaaatccttccttattgcctaacaccgaggatcatttgctgaaatcttgttgatttttccctcagatcaacaaaggattttcagaatagccctgatttctctttatcaccacggtgctgtctcacgtcttctctccccctcctcctacctgccgtctcttccagactcgtctctctcccccaatctcctttgcgcactgatgccaaattagtcacaacaaaagtgtttacgtgatcgtgtcacccactggtaagctcttaatggtcttcccttacacattatctcccatttcatctcaggagccttttattaaccactcttcacagtctgactcagccctctttgccagtttctctctttacaaatagcaaagtctatgagctagattactcaatattccctgaataggtcttctcttctcccacctcttggcctttccagtaccattcaatcttcctggaaattcctgaaatttctttcctcctcactcagtcaatgttttgagacccacatcaaatgctacatactatttgttcctttactgatcatgccagttggaaatgattcgaatctgtaaagcagggtgctatggaatgacatttcttatagccctttggtcatttgggagcaatgtctaacataatatcctccaggtccatccatgttgttgcaagcgacaggatttccttcttgttaaagggtgagtagcattccattgtacatatattccatattttatttttttttgctcatctgttgatggtcacccaggttgattccatatcttggctattgtgaataatgctacagtgaacttgggagtgcagatatctcttcaacatattgatttcatctcctttggatatatacccagtagtgggattattggatcaaatggtaattatatttctaattttgggcagggtcctctgtagtagctccataatggttgtagtaatttacatatccaaccaagcacgccagggttcacttttcctcatgtcctcgccgacaagcctgatattcttatttgcctcttagcgcttcagcctttccctcgtgacttaacggtgactcccttgagactacttgaaataataagtttggatggcaaggaaatacccttctgctgtcaccctttgccataagactgagttactttgtaaacaaagaagatttacttggtcttccatgcccaagacccttttacttttcatcgcttaatatttcatggccaaaaactgttggttcttccaatcttgtaaggccatttatctttgatcttgctccattcccttccatttttgcttgagaatcattcagttcttgcctgatctcacgtctttctcgcaacaccttactaatgactgccagagtgtccactacacactatcggtctcatttgaccacttccccaggcatgtagcctacctgccaagttctttcacagcagatattttgcagtgttgtaagagggctccctagcttgctatgttttcttactacctggcattaggaagtaaacatttttcatggcagtattcacttctagtaccaatttcttttttaatctacatgggctaactgctgtatcaaacagccatcaaatcccaatgttaattgcaacttacagtacgttgtgatgtttctgtctgtatactcattcagacacacagagtttaagtaatttgttcaagatcacaaagttagtaaatggtggcatcaagatttgaacccaggcagctggactcaagagtctaaacaactttcattttaaaattttcatctttcaagatatatcacttacaatttccatcttcatcactttcttccatacttcagagctgcatatgtaaacctcttgatcatataaatatttatggagtctcagcattttgagcacatgctgagagattttgtagcattgaagataaagaagctctttcaatacatctaatcttgccactattgattttgaacagcatcttaatttgttacctttttaaaaccatattgtacttttcttcaggacagctaaattaaatgtcttatgttgatcccctgggttttctcagtttccatttatcagtttccttttatataaagagatgctaatgggtaaccttacattttgtaaggcatatttttgaagatatacaagtgaaggtttgatctgtacaccctcgttagagctctttattttacatgtggaggaagagatgccttagggcttctgaaaaacaggcttttatttttatagaggagaaacttccagaacatgccatgagcaaatgctctgtcaagtctggttctttcccccattacttaagtgcaaatggaccacatttgaagaagataagtagcagaacaaggctccccacaaggggattttgaggtgctctgaaaaccagactgacataatccatggaggagttcatcactgcaggctgtcacgtctcacagtgggagtcataggctggtctgcttgataaactactcctgatctatgactggagctgtgtgcttcctttaaaaataaatcttgtttttccatgccccacgtgcttctcagcctcaggagcacctcatggatttagactaatcttgtcttttacagtcatgttacttccagattcctaggaatcaccccatttctgatgccgttgatccatccatacccactgaaattgagctaaatgctctagtctgatttgccccttgaagttagtatagaatattttggctagactttgaaaatgaagccctgaccacaatgcataatgacctcagtagacactgaagagttcctttgcatcaggcaagtgacaagtatctatctcatcttcaaagtccacatagatatgtgccagattgtaggttgacaaatcactttttcactagctcacgtggcaagccttttcaccttgtaataatgctagtgagagacccataggtaccacataattggccagtcattgagattcaagcaacatttggataatttagcaaaactatcatcagaatcatcaaagtacataatttttatttattatgcaaatagtggattcactaaagtgcttagaccaattaagttgctcccattgaaaaacagggtgattttattcttaagaatatatcaggataaacttcttgtagcctctaaacagtactgcttagaaaagtgcagcttcactgcattgcatatccccccagaagccctcaaagttcagatgtacaccacaaaaacatgaagcacatgtgtttgcatggaaggtaggctctggggtcttcctatcataatatgtctatgattaatagtcaacatatgccccctccacattccctaaaggaacatacacatgcatacacacacacacacacacacacacacacacacacgtgagaactgaattgagagtttggggtatacaccatccctgagggcacagtctacagctcctaatgtgtgctgtagagcaagcattatattgttgacaggtaataattcctggttaggaataacaggataccagtgagaagaggctgagaaaaatacactcttgctggaagagtcaagaacgagctcttcgtgggaaactatgggagacgattgaaaaaggacaagaagaaaggagaattgttaagtctccactttctcagtttctgaactgaacttttgctcacagcaggtgaacacaggctccctcccacactgagacttcctcccctgccggtgtgcagtctgttaagtaaacagagacgttatactgagaaaggaacatttctctattttggctatgagttgttatttttaaagattcatcctccaaacattttcccctatccttgtttattttttcactagaaagaagatgaactgcttaaaaaaaaaattcaactccatgacaagaaaaacccacttctagtatgttctccccactcaatgccaatggagcctttggtgtgagcactctgccagccacacattgggcagcatacctcttgaaattcctgctgtgcttctatagagcttccatgcatccagattttcaaagtcaaagcaaaatgcgcatggcagtttttttctgactccttcaagttaaaaggccaacctctcccttgacatatccatgtatttatcagtatatctataggtaatacttaaaggtgatccttactgtgtgccacactccattctaagcactttacataaaaaacctcatttcactttatttgggaataggatgacaatttcttcaatattgagatgggttgaatctggggagactgatgttagatgcaaaaagctttctttctagaacttttcctgtgtcttgcacctggctttctccctgtcttgttcccattctagatctctttactgacagtgcccatggctttcttcttggtactctagtgttgagcataagaactagtatgtaataggctctcagtaaatcttgttgaatgaattaaagtagagcaagaattaaagacagagaagaagatcttcttgttggagttctttcttttggttgataagcaatgtgatttgacgtaacaatcttgagtcctaatcccctcatttggaaaatggaaataataatgctaatcttagaggtcacttctaagaagtatatgaatatatcagaagtaatcaacatttttaagtcaaagaaaagaacgtctgtgaaaaagaaaactaatgagctagttgaaaaaatattaattggatctttttctcataccttacgccaaaataaatccccaaaaatggttgcacaacattgtgaatatactgaaatccattgaatcacactctttaaatgggcaaatgttatgttatgtgattatctttcaataaaattgttataaaaatgaataaaccccagaagatcaaaaatttaaacataaaagcatggaagtatactagaaggaaatataagataattttatatgttatgttgtatatatttatatgtaaaatttttttatttatttttctttgcttttaaaagcaagacataatgttctagaggaataaatgaaacgttcgataaatttaattctctattaaatgttttgcagaagaaaataccaggaacaacatcagaagaaaaaacaaaaaaccataagaaaaacaattaaaaatacatatgacaaatggcttattactataatatttaaagaactcttaaaaatctatgtgaaaatgacaaataacagaaaaatacgtgcaaaggacaagagcaggcagtttagagaaagcctataccaatatattctcttatcaacagtctattgtacaagctatttgaaagcaatgtttgaactatcaaaatttaaaatacataagcccttttatctagcaattctacttccaagaatttattctatagctatctgtacacatatccaaagacataaacataaggatagtcattgaatgaaatgtttttaacaacaaaatacttgaaagcaaagaaatgtcacccaagaaagaagtgattgaagaaagtttagcattcagttcagtgaagacatattgagctgtcaaaaaaagttgatggagaactccaaggtctattaactaaaaacaaaacaaggtgctaaacaatatgtttagtgttcatattttaattgtttatatatttcacaaatatatatttgtgcatgcagaaaatattttaacttctttctaaccccgtcaaacacatcatgccaaaattcaacttgtgataaagaaaaaaataaatgaattcctttcgtgtgtagtatctcatttaaattcttcaacaacccaataaaaaagatacagacacatgtttttaagtactacatgttatgcacctttggtttgcttatttaatagttgcaactactaatgttaaattcttgatgccaaggttaaaagcctgaacttctaaaaatatcaagatctgacatttttctgttttcacagattaatctgccatctcctgacctccaacacactgctctatgttctttcatgctgctcctcctcccatgtttaggaccctcttccaaggaggcattcacatctctgcttgatgaaaccctacattatcttaaagcgtccactcgaatgccacctacttatataccatctcctgcaataccaatgggctcagcccaaccatagcccatagttattgtagttgttcttgtacttcaaaagcactacaaaacacaaccatcaggacttgttacattatttgaaggctatgagcatcttcagccgaggccctgtttttattcccagaactaccacattgtttagaatatagtagcagatcaatatacgtgtattagataaatcgtttacccagatcttgatcattttcaattacccataggttgaagaactccatatttaacatggcagacttgaggactgaactacctacctcttctaagaagttgaaatgagaatgttttattgatgggaaattatttttttgttttgccttctagaattcaaatgaatgttcatattccatgaagacaatggctgatagttttttgttaaagatttagaaccagtggatttttatgaatgtgaaccctttcatgtcttgtggaagattttctgttttttaatctttttatttatttatttatttttgctatgttttcataggaaccagggaaaatgtgtagagggcatggtggagatcttcgacatgctgctggctacatcatctcggttccgcatgatgaatctgcagggagaggagtttgtgtgcctcaaatctattattttgcttaattctggtgagttgataacacaagataactcaatgctggatgaaatgtttatttgtagttttcaaccagatacgatctacccactccaaaggcataatgtcataaatagaaagaaactactgacacacgttttaaaataacctaccaacattgcagattccttataaaggtagaaccatgctagccaaatagacacatgaaaaattgtaatttggcattgaatcaaatggcctttgagctaaaatttttgtatgctttcacagataggatgtttttattcaaatggtacatgtatatagacatatgttagttgatagttatattatgtctgaaaataagtagaccaagtaattctgttaagaaattgtgaccaattccaggctccagatagtaaagaaagagggttatttgagacagaccatgtttctggtcaaaactgactagctaaaaatatagttggcttagagatagaaaaacctgtttctaaaacagaagaatgtggaatgcaataaattgtccagctgaaagaacattttccatttgctctatgaagtctgattctactgccccttcgtatttatttgtttgagaaagcttagctaagagcaacatctgttttttgtttttgtttttgtttttgttttgtttttgttttcaatgtagtgaggctggctgttgtataaagagttactctatgtcaccaagatggaaactatggttcagcctgaattagtgccctgactcctcctagcctcttggtatttggatctaagctctagctctacagcctctgggacctaaagctcacattgggtatcagcggtacagcagctccccttaagctccacctttccccctggctctaaccccactttgtgcctcatccctcattctcacatagaaatcatagctatttcgaatctctgggcctgacttagtttcttatgccattagacatagtctcaaattcctcaatagctgaattgcagcttgtattgatcacatacatagagaatccgcacttccttctctttccacgtgtttttgtctctttctgatgagtgctgatcccttcccgcttcccctaacaattttttacttttcttccccaccactgctaggaacctgtgttgcttaatggaatcagcccttccttctcttttcttgtgtttttgtctctttctgatgaatgccaatcccttcccacctcccatgacaattttccacttctcttccccaccaccactagtaacctgtgttgcctaatggttatcacagtaatcattctcacttatcaactaataaatggaaatctgtactattacactaggcaaggactgaattacagaatgaagtcccatgataaatgatgtgatccacactaaggaagtgattaccactccattcaggtttctgtttccactcacgtgcattgtgcttttcatttcagtcgtttgtcctgtacattgtagggtccagatcccacaatggctctttattggatgagagttctgggagcagtgccactcagctacatggtgccaggtcctgaacctgtgccttcttcggtggagggctggcacgtgctgacagctttcatgtgggcaatctgggaacttcagagaaggcaggcctattaagtgttaagactccccaccccgaacttttactgagaaaaagtaccccagacaggaagtaaaattagccagagttgtatgatccacacagtggatgctctgatctcagtaataaaaaatatttcctccagatccatatagacttttcctgcattattgttttgtttctgttcctatggcagagtgagtttttaaaactattatgcaagaaatatcaggatttttgccaccaaaaagttggattcatagacccagggtttttacaacccagggggaaaaaactttcagccctcacaagaaagtattttattaaagactggcacccaaacctcaagactatatttctcactgcaggatttggcccctgtctgcctccttctcagactagttaaactttcatactccatccttgttccttcgcttctttcttaggatcttctgtgcacttctttcttaggatcttcttggcacttctttgctcttgaagggcagaaacgctattgtagaaattcaaggcactgtatgctgacatagtttatagttgtctttttcatgagataacacagcggctggcagctcctcttttctatcaaggacagtactgctggctcaggagagcagtaagcaaacagaagctgtctctcaaccctgtacaaagcgaaaccactcttttccctacaaaagtgagctgtgccccagaaaagcggatctgctgctgagcagggctcctcatgtctcctattgttcctgaaaaacagcatcaaagagggcaagactgacacacaatgttgtagcattaggagcctttttcagaataaaaaagcaatcagtcatatgaagcatgtggtcataccacaatcaacaatttttctccacaactggagatatggatttttctaaaagtccaactgattcatggccctgatacggggcagctctacctctcatgagaccaatgaccaagtgactctgactccaggaatctctgacagaagccaagctggaaacggctcaggaaacctgagctagaagatgcctttctgacacctgggaaacaaaacctcagtgtatggaggaacccaaggttttgtgttgagccccagtcgccaaggtctgaggaggctgggtttatattggccccgattttgtggccgaggcacaaggggaattgaaaggttgttgtgaggacctgctcggaatgtctttctggaagtttggagagggtctctcaaatgccaaaatttccatgggaagccattttcacagctgcttgggagtgggagatattcgtcatcatttctgccccatttagaataatttattactttgcttgcaaaaacccggaatcatccataggacacacgttgtttgtttttccactccacaccaaaggacagaggcattcctggttaatccaagatgccaacttcaagacattctgagaactagctggacagagctgaagtgtagggcaaatcagaacagaagtgatgggcccagggcaaaagcccgtgaagcagcagctgcggaggaaggatgggagctggagctgcaaagggggccatggtggagactctgggcctgcccacagtatcccctctgcccaatgggaattcagttttcctgcatatcattcaattatttctcatttttctaggcctagctcaccttattcgggaagttttgcgactaccccagtccataatgaatttcctctctagactatttcaattcttacagtcactaccacacagtctaggatttggttagttggttgatttcattcatttattcaataattcaatgtttattgagttcctactatggactttgtgccaggtatacaaaactgaatgttactgttgtgtggggtttttttctttgcatttttaaagttaacctggatttttctctcactctttatgcatgtatttcctaatctccctataaactatttgtatttttttggattcctcacagtctatttagcctgtggactgtcaacagatgttacatcattcagtcatttaatagatgcttatttgctagacatggccaggaggacctggaaagtcctcatttttcccatctgttcttaccattctgaaatgtatcatgctcttcagtgctccacagatctagatgatatcaaattattaaatggaaaaagcaagacccatctccttgggttattgtggataagggggaaattgtgtaggaagtgtctattgcagttcatggaccattgtaggcccttagtcaacaacagctatcatcatcactgatgagaatctctggcttaaacggagtaggttcatgccttttttcagtgtaatgaagtgttttagtttaaaggcctttagcaaggcttacaataaaaaaaagtggggactccagggtaacaccaacaatagagacgaccatggctgttatcctgagactattaattatgccacgtaattagatttagagaaaacttagagcaacatttatcttgtggataataattgattgtgattgggacttaccgttgagagaccctgatgaaaactctatggtgaattgctgtggagtcacatgggttcatgcatcattcatcagtgggccctggttttagcctcataacccctgagaatccacctctatcagaaaaccaccctttcagtgaaagttcctcaaggctcagaaaaattcatatgtcaaagctttatatgtaaaaacctatactctctaataaatgtttggtttggccttcacattcaatttaataattatttctacctcttttctaaaccgctcttaaccacagttctatatatttaattctgaagagcctcatgcacctccctccctggtaactttatctacttctctccctggagaaccagccagaccatgattccagccctctgtcctctcttcaaccgtaggtcctctttttctctcctgactcctcaaaccttctccagttacccggatgccttctgtgtgctgctggcttctgcatcactgttcacagggccacttgttcccctggaaatgtcttatgctcttgaaatgctatagccttgttcacctgttcatccaaaactgatcctcagacaacatttctctttcaattggtggaataataaagaggaatatgggtcaaaattcatagacatttaaatacccaaggtgcaaagttaagagaaaacaagataggagaaagaattatggcaacatctctaaaatgtgtactttagtgtttagcaaaaaagggactatggaatgtcaaacaggaacatatatgttaaacataaacatgaagcagtgccagctgctgtctgccatatagtcatgctttgttaatgtggcacatcttgccatgatggtgccctcatgaaacgaaggatgctgaagcagatgccattctgtttgctttgatcagaagccactctctggtcaaggaagtatttgtttcatgcttaattataacaagttctcatcacaaagattattttctttctccagatctggattgtttgcactcactttatattattagacaattactcagattgtttatgtttttatgtttagaaataagacagtgattcagagagtccctgtatttagatgaaagaacattttttaaacatattgactgtaaacactgaaaatcattaattctcaacagttgaaggtttctgacaggaacggcccttggaaattgtaaatgggcacattgtcaggtatgcccattgttgtcacattggagaagattggattctgttctctctggagtcctttgtaatgccaagcttcctctccagggagctggcttattgtcattattttgagataaatggcacttcatagtattaagtggttcattgtctcttctctggctgactgtattctgtaggcagccactcaactttggagcctttctctgctaccaacttttggtgttgccttaagcaagcctcatggctcctgttagtttcctgacaacatggtatagcatggactttgtcatcagagaggactgaattcaggagaagcaactctgccacttccttggcggaagggggatgactgatgtcctttgataagctgcttccctgagcctaataaaaaaatagaaataatgatacttaaactcatggaattgttgtgacaattgaaagaatgaccagttagtaaagcatcttgcaccatgactagcacacagtagatgcacatgagtgttactaagctttagttatgccctccaaatacaaagccttagttttgtcactatgaaagaaattactctgttcttcttagcaggtaataaataaatccctgcctggaaattctgcaggagaatttcacccctgcgctttcaggttaaaagattgcattcccatgatgaagatgttctgtgaatagaatcatctcaagtcccaaatggtgtggatttgctcctgcatcttgttgcagagattctcttggagcttctgagaactggggaaaccaacaaaatgcctgtagcctggggaaaatgtagggagttttagcatgaatttgtgggaggtgagaaaaggcagcaggtgtcgaaagacgggaaatccttgcactgttctagatgttaggagccattttccattcacattcagcacctcaggaggagaagctgcctatcactttgtgtcctcaagagaaccaacaaaggagaatgccatctcccagatactcaatttgattaccattttatcctaccttctctagggtccagacattatgtaaattggcattaagtttgaataatgtatggacccagtttaaaaggaaaaaatgctttgggaggctgaggcaggtgcattgcctgaggtcaggagttccagaacagcctggccaacacagtgaaaccccatctctactaaaaatacaaaaagttagctgggcacggtggcgggcacctgtaatcccagctactcaggaggctaatgcaggagaatcacttgaacctgggaggcagaggttgcagtgagccaagatcgtgccattgcactccagcctgggtgatgagagcaaaactccatctcaaaaaatttttaaaacaaaaggaaaaaatgctcccctgattcccgcagtgctgacttaaaatgttcttagtatgccaatgttgcttaaatatgaatgactgtagcttctacttaaattggcaaccgcaccaaatataaactgcaaatgtttatagctcttatggaagtataaaagcaaaacaaattcttaaattaaatacaaactaagagggaaactgataataacaatgttttgtgtaattaagttgctgtttgcaacatgcctggggcagactcctggcctctttgcatctgacatgagaggctaccaaggatgtggccacaactgggctctcccagcacttgcttgcgctcagaactgtgccaaaacctttgctcgcccagtgttctgcaacgtccatcatttggatttggcaggaacacatcatttatgcattttgtttgcttctgtatttagttgagatacttaaaatataactgctagattctaaggcattcataagcatctgtgaaaaatgtgttacttaggaaacagttcagggttccatggattatctagattggtgagtcttaagactgaccacacaattcatctgggggtgtggaggaggggagctttgagaaaaatctctgtatgagcacccacacccagagattcctatgcaattatcccagagtggtgccttaatatcaacatttgtttaaaaccatcccccaagactaaaatttgtgaccgggatttagaaccattgacttaattgatgcagaacactctgatattaatgtcttcatgtcttttggaatgtcattaagacaaaagcataaaattttaaaattcttaaagacaatttaaagacctatgagaatccatctttaattctcaggagcgtgtggaacctagtttgaaaactactggcatcgacaattgaatttccactaaaataaaatagctctctagtatattacaaaactacccattctgcaaactgcaggggagctactgataatgcttggaactgtgccaggcactgcctgcataaaaatgagtaaggtccacttcctccatggactgggttgggtaggaggcaaagataattaaccaattattttaatattatgagttcagggttgtaatgaaagtaagtattgagtgctgcagagacccagcaaaggagtccttagctgagaactgatcctttgctgagtgacgaggacattattgaaccgccaggcttgatggcatgttgcatggtaacagaccagtacaccaaacagcaggagctgtagcagagaaagagtttaataattgtgtggcagccaaataaggagacagaaggaaaccttaaatccacctcttgaaaaagtctgggactaggctttttaagagaattctggcaagaaggaggctgaggagctgggggtaactgattggttaggacataggagaggagacaataaggatatagaaactccattcttgcactgggtcagttcctcggagggggtcctcactctggctggcagcagtgaacccattggaatgcaggatctgaaaaatatctcaaaatggcaaacttgaggggttttttttagcatcaaagatgttatctatagaagttaggacattgtgacaggggctacgtgactttgaagtgttaagtggctgtcagaaagtgagctattgcagcggtccccaacctttttggtaccagggaccagcttcatgaaagaaaatttttccacagatggggtggtgtagggtggggtgggggatagcttcgggatgaaactgatccacctcagatcatcaggcattagttagattctcatgaggggcacacagcccagatccctcacatgggcagttcacagtagggttcacagccctatgaggttctaatgccactgctgatctgacaggtggcagagctcaggcagtaatgcttccttgcccaccactcacctcttgctgtgtggctcagttcctgacagattacggactggtaccagtttgcaacccaggcagctggggacctctgggctgtagggtaggctggttaatgcttagctgtgtttctattcaaagcttatgcttttgtttaaaacctagtaatttggttttgttaattttatgaagatgatttcaaggatgagtaggattagctggagtcagaaggacacaagggaatttctggcaacaacattaaactaccagtgaatgtctcatcaagtcactggacctctaattctaagcagtactgtcaaccttataggttatgatgtataagatagtgttgtgatgtataagatagtgcaaaaacctaagttaatatcaccatttctgtagtactctctatttcaaaggaaaaaatcttcagcagtctaatatcctaccaaaattttgaagtcaagacctccctacactaatcaaagaactagaggtgcaatcaggccatatatttggaaaggccataggtgccctccctctgtccttgttcccagcatactaaactatagtctaaaagactttaaaacttgaactgaagaaaaccttaaggaaacaacaacaaaattccatttatttcctgagcccaaaagtagaataattgttttttaatgaatttttctttccctgtaagacatactatgaattgttcaatgggtattcaaagcatatgtaatagaatatgtatgctttcctgaaaaattgaaatggaacatcaaactgttctgtaaagttttgagtctagaccaaactcacagcacttagccagaatatgtacatctgcatctgccactcatggccccatcgctccctccaactgcttctcttgggctgaaggatggaaaagcaaactccctgcgttgagttccatcttgccctgcatggcctcccccatggggtcattgagctccccaccagcttccacctcttccagcactttccgccagagggcccgtggctgcttttgcagactgaaattgattgtggttgattcagctccatttcctctgagtttttactttagatgtgctttttaggttgcatttttcttctggcatataagaaagacagcaatattccatggaacagagtgatgtctgtggctttgtcaaccgttgtttgttagcttgatcaccatttattgagtgtttactactttccaggcattgtgctaagtggtagaaatacaaagttgcctttacttgattcatctgtaaaatagagagagtagtagttcctacagtgtggtttatgtgaggcatagggactgctccctgaaacctagggacaactccctagcagcgacccagtgctcatatcaatagtggtaacaattaggaaggcagctcctacctcaaagacctcatgatctgatggtaaagacagatataacaagaaaattattctttttaaatataaaattgtgatataaaaatagttttcactaaattggatttttatgaaatttacagaaacaaaataataaattaaggaaatataaaaccacctgacattagccaaccatgttgatgttctgattatgttactgcaaaggagtgtagggttaagaacgagggactttgattccaagatcaaatccctttctgctatttcttagctgtctgactttgggcaagttgcttaaaccctttgtgcttctgtgtgcttgcccatgagatggagattataatagcgtctacctcatagggctatttttaatacaagttagctcttagaacaatacctacttaaactaacaatttgtattaggtactgttttattctccatccgtactgtgtatgcatatattcatatttatatttacatattctaattaggattatatacatgtactttctttaaaaataagattttaaataactatataatcagtcatgatgatacaacatgatttattcaacaaatctgatgctgttaaacacgtaagtgatttctctttcaggattataaataacatttgttttgcatttttttcatacatcttttgctcacttttcattgttactttgtatatgttgctagaaattgatttgctggtgaaaagggtataaacatttttaaggctcttgctacatattgcctgctcttcatacatattgcctactgccccaggaaactatcaattacacttttaccaagagtgtatgaaagcattcacatgaatgtaaccttatcatgcaatgcgggccatgagacagaggagagttatggagggtagacggcttccccgctgctcagccactgccctctcctctaaaagagccacagtcaggaatttctacatagatcctattataaacatctccttttgaaacaaattatcttctctcagagcattttcttcattttagtatctatataggtccttgttatgttcattttaagttttgtgacctgcactgacacaatgctgatgaactgcttattccaggcagtctgagttctcaaagcatttgcattttatgtcttatcctctgttttgggctctttgccactgatttttttttaagtgatattttaagaaagaggagggttgatttgttgtgagtgtatctctctttaaaaacttttctagggaaggacaacctcttccaaagactttgtttgctttgtgtgattggcatgtccttccctggtcagtaatgagcttgaaggaagctactggacacgggactgaacatggggttttgctatcactctagctgtgcctttctctagtgatcaaggagatgttggttcagaaagtgccctgtctaatcccactaaggcccgaaggaccaagtgctgtctactctccagattctctgcaacagaaagcagatgcttaggcttcatggtccaggttggaacaggtagttagctctgaggacagttatgcatgaatgtcaggaggggactggcaggggaacatttatttattctttaaaattggaatcaacagttatggatgaaacccagaatgcaaaattcactttcatcttgacacgcaacacatctgtcctttctccttgaatagcaagtattaatcattgagttagacaatgtaaccttcacattcagtgaaagccaaacactcagcaccttctagaaaaatcttagtgccatgctttcttagcatattgcaagtcctctgaggatgatgtgttgttcagctttgaagctgatcttttgtacttgcttatgtagctcaggctagtgataacatgccagaggcatttccaactaagaaaattattcacagaagctttaattacaaatttgttagccccacttcctgctaaaatggccagccttgaagagtttcggaaatgtgagcagccttaaggatgatagaaatattatgaaatagtaataagtaatacccatacagcaaactcctttttctttggagtatccgttcatcagccagatttccctctcaacagtccaggtgttgacgaagatcatgaaataataggaatgaaagggacttcgattttgtatttttaatagcattttcctccaccaaattacgaaagtaatgcatgaccaaggcagagaacttggaaaatacagaaaagccaccaagcaaaataatctcccaagaaatcataatttcaccacacaaaagtaaccattgtcaacattttggtgaaaatccttaattaaagagactcttaaaagatgccagttcgctgccacttcttcctttctccacaccatcctgcaccctgttttgaaatgcagaattgtttctaaatcattccaggaaaattattagttttctcaaatatctctggaggcgagtctgttggcagtcatttctagtttctcacaaaccttgaagttaggaaattatttgtgtagcttttgagcactgggccagaagtgagggatgtttgggttctagttccagctctaccacttatttaccaactggccgacctcaggcaagtccaggctagcggccccgcctcaagcccctccagatgcagcatctgcaaccccacttccttcacttcctttcgcctcagtttcccaacaatttcctagtaattgtactgaatcattgtttttcattttttacattaaaatttatttattttattttatttttaaagactttattttttagaacagatttagatttgcagcaaaactgagtggcaagtacagaaagttcccatatattccctgcccccgcacatacacagtctccctcactatcagcatccccaaccagagaggtacattggttacagctgatgaatctacatcgacacgtcattatcacccaaagtgcatagtttgcattggcgttgggcattttagggcttttgacacatgtatgcactattgtaatatacagaataatttcactgccctaaaaatcctctgtgctcctcctattcattcctccctccaccccattcctggcaactactgatctttttactgtctccacagttttgccttctccagaatgtcatatacttggaatcataaggtttgtagccttttcagattggcttctttcactcagtgatatgcatttaaggttcttccatgtctttttatggcttgatagctcatttctttttatcattgaatactactactccattgtctggattatacacactttatttatacattcacctactgaaggatgtgttggttgcatccaagttttggcaattatgaatgaagttgctgtaaacacccatgtgcaggtaattgtgttgatatgcatttttaatgcttttggataaacactcaggagcacaattgctggattgtatagtatgtttagttttgaaggaaactgccaaaccatcttcccaagtggctgtaccattttccatttccaccaacaatgagtgagagttcctgttgctccacatcctcatcagcatttggtgttgtcaatgttctggattttggccattctaacaggtgtattgtggtatctcattttgttttaattcgcattttttggataatatcacatggagcatcttttaataagcttatttgccatctgtgtgtcttctgtggtgaggtgtctgttaaactctttggtccatttttttaatcaggttgtttgcgttcttatcgttgagttttaaaagctctttgtatattttggataacagtcatttagcaggtatgtcttttgcaaatattttctcccagtctgtggcttgtcttctcattctctggagatcagtggtttttacactttcttctgctgaagccaagtattgtggaagaagccatggggtcaccagaggataggtgcacagggtagtgagggaaagttggagtgaatgggcttggtgcccccaccccgcaacatttctcttgctttaatcagagaagtttgacttcatccagattgcatatgaggactttacatgaggttcacctttttatttgttttaaaaggggtttttactctcaaaatgttttaaagaccactgaactagatgatcatcttaaggcccttttaagatttatgattctggaattctgtggctctatttttccaatgtaatataaccttcctctcgttaaggaaaaatgagataaacctgttataaacactcatgtgacattttttcaatacagttttcatccacgtagtgctcacttagaatgatagaaacaatacacctaaagaatatgcaccattcacttgcccactcatctctcaaagagaggaactttcaacactagttatctttttaaaaataatcagagagaattctcagccacttcaattctagcccaggaaaaagagggaaaatacatttgaaggtttctggctcatgtgatacatttgcaaaccagaaccaagatgatatgactctcatttattagtgactattgcaaagctttgcaggctattaagcaggctgttcaatttagggtgatatggacatgtgcatattggccaattatatatgctcagatcgtatgtcattttttttctgcattttagtctaagtgtcagataggtgtttcatgatgttttataaacacttctgttcacattaacattgttcattgatttggcaaggaatgaaggggtgtcattttcatgattttatttgtatattatgtattccacagaggatttgaaatgccttaccaaattttatgtaatgtaaaggggtaaaccaatatttgacacatcattataaattgaggataatctgaagaaaataataaatccaggagacagattatcacactgatatggtttggctctgtgtccccacccaaatttcatcttgaattttactcacataatttccatgtgttgtgggagggacccagtgggagatcatttgaatcataggagtggtttcctccatgctgttctcattgtagtgaataagtctcatgagatctgatggttttatcaggggtttccacttttatatcttcctcattttttctcttgccaccaccatgtaagaagtgcctttcgcctcccaccatgattctgaattctgaaccctccccagccatgtggaactgtaaatccaattaaacctctttttcttcccagtcttgggtatgtctttatcagcagcacgaaaatggactaatacagtaaattggtacaaggagtggggtgttgctgaaaagatagccgaaaatgtggaagcaatcttggaactggatatcagggagaggttggagcagtttggagggctcaaaaaagacaggaaaatgtgggaaagtttgaaacttcctagagacttgttgaatggccttgacaagaatactgatagtgatatgaacaataaagtccaggctgaggtggtctcagatggggatgaagaaactgttgggaagtggagcaaaggtgactcttgttatatcttagcaaagagactggtggcattttacccctgctgtagagatttgtggaatttgaacttgagagaaatgatttggggtacctggtaaaagaaatttctaagcagcaaaacattcaaaaggtgacttgggtgttgttaaaaccattctgttttaaaagagaaacagcataaaagttcagaaaatttgcagcctgatgatgcagtaggaaagaaaaacccatttttttgaggagaaattcaagctggctgcagaaatttgcataagtaacaaggagccaaatgttaatccccaagacaatggggaaaatgtctccagagcatgtcataggtcttcatggcagcccctcccatcacagacccggaagcctaggaggaaaaaaacagttttgtgggccagtcccagggtccccatgctgtgtgcagcctaggaacttggtgccctgcatctcagctgctccagctattgctaaaaggggctgaggtaccacggtttcagaggttgcaagccccaaaccttggcagctttcatgtggtgttgagcctgtgtgtacacagaagttaagaattgaggtttgggaacctccacttatatttcagaagatacgtggaaatgcctggatacccaggcaaacatttgctgcagaggtggggccctcatggagggcctctgctagggcaatgaggaagggaaatgtggggttggaacccccacacagagtccccactggggcactgcctagtggagctgtaagaggaggaccactgtcctccagaccgcagaatagtagatccactgacagcttgcaccatgtgcctggaaaagccacagacactcaacgccagcctgtgaaagcagtcagggttggaggtggtggtggctataccctataaagccacaggggcagagctgcccaagactatgggaacctacctcttgcatcagcatgacctggatgtgagacattcagtcaaaggagatattttgaagctttagaatttgactgccctggtggattttagacttgtgtgggccctgtaacccctttgttttggccaatttctcccatttggagctgctgtatttacccaatgcctaaacccgcattgtatctaagaagtaactagcttgattttgattttacaggctcataggcaaaagggacttgccttgtctcagatgagactttggactgtggacttttggttaattctgaaatgagttaagactttgggggactgttgggaaggcatgattgcttttgaaatgtgaggacatgagatttggagaggccaggggtggaatgttatggtttggctctgtgtccccacccaaatctcatcttgaattatactcccataattccaaagtgttgtgagagggacctggtgggaaacaatttgaatcatgaggccagtttcccctatactgttcttgtggtagtgagtaagtctcacgagatctcatggttttatcagggtttccgcttttgcatcttcctcattttctcttgctgctgccatgtaagaagtgcctttcacaagcataaggaagaagtatacttgctggagcagcaggctgtccttcttctgacgatatggactgcaagtgcctatgtttactttgaccaagacggcctttcttttcacagaaagccagggttcaccccttgaatttcataagacctctctttgcagtgggttagatactcttttatatttttatactctgtcaggaaaacatttttttttccatttaaaaatcagtcttttggttgcttccaagatggctgaataggaacagctctggtctgtagctcccagcgagatcgaagcagaaggcaggtgatttctgcatttccaactgaggcacctggttcatctcactgggactggttggacagtgggtgcagcccacggagggtgagccgaactggggcagggtgtcacctcacccacaaagtgcaaggggtcaagggatttccctttcctagccaagggaagctgtgacagactgtagctggagaaacagtacactcctgacaaaatactgcacttttccccacagtcttgacaactggaagaccaggagataccctcccttgcctggctcagtgggtcacacgcccatggagacttgctcactgctagcgcagcagtctgagatcaacctgcaatgctgctgcttgatgcggggaggggcgtctgccattgatgaagcttgagtagctcacagcgtaaacaaagcagcagggaagcttgaactgggcagagcccacctcagctcagcaaggcctactgcctctctagattccacctctgggggcagcacatagcagaacaaaaggcagcagacagcttccgcagacttaaacatccctgtctgacacctctgaagagggcagtggttctctcagcacagtgttcaagctccaagaaccaagagaccgccacctcaagcaggtccctgacccccatgtagcctgactgggagacacctcccagtaggggccgacagacacttcaaacaggcaggtgccctctgggacgaagcttccagaggaaggatcaggcagcaatatttgttgttctgcagcctccgctggtgatacccaggcaaacagggtctggggtggacctccagcaaactccaacaggcctgcagctgaggggcctgacggttagaaggaaaactaacaaacagaaaggaatagcatcaacatcaacaaaaaggacatccacaccaaaaccccatctgtaggtcatcaacatcaaagaccaaaggtagataaaaccacaaagatggggagaaaccagagcagaaaagtggaaaattccaaaaaccagagcgcctcttctgctccaaaggattgcagctcctcaccagcaagggaacaaaacaggatggagaatgagtttgatgagttgacagaagtaggcttcagaaggtcggtaataacaaacttctccaagctaaaggaacatgttctaacccatcgcaaggaggctaaaaaccttgaaaaaaggttagatgaatggctaactagaataaacagtgtagagaagaacttaaatgacctgatggagctgaaaaccacagcatgagaacttcgtgatgtatgcacaagcttcgatagctgatttgatcaagtggaagaaaggatatcagtgattgaagatcaaattaatgaaataaagtgagaagacaagatgagagaaaagaagagtgaaaagaaacgaacaaagcctccaagaaatatgggactatgtgaaacaaacaaatatatgtttcattggtgtactgggaagtgatggggagaatggaaccaagttagaaaacactcttcaggatattatccaggacaacttccccaacctagcaaggcaggccaacattcaaattcaggaaatacagagaacactacaaagatactcctcaagaagagcaaccccaagacacataattttcagatttaaaaagtatgaaatgaaggaaaaaatgttaagggcagccagagagaaaagtcgggttacccacaaagggaagcccatcagactaatgggatctctcagcagaaaccctacaagccagaagagagtgggggccaatattcaacattcttaaaaattcttaaaaaaagaagaattttcaacccagaatctcatatccagccaaactaagcttcataagtgaaggagaaataaaatcctttacagacaagcaaatgctgagagattttgtcaccaccaggcctgccttagaagagctcctgaaggaagcactaaacatggaaaggaacaaacagtaccagccactgcaaaaacattccaaattgtaaagaccatcgacgctatgaagaaactgcatcaattaacgggcaaaataaccagctaacatcagaatgacaggatcaaattcaaacataacaatattaaccttaaatgtaaatgggctaaatgctccaattaaaagacacagactggcaaattggataaagagtcaagactgtgctgtattcaggagacccatctcacgtgcaaaaatgcacataggctcaaaataaagggtcgaaggaaaatctactgagcaaatggaaagaaaaaaaaaagcaggggttgcaatcccagtctctgataaaacagaatttaaaccaacaaagatcaaaagagacaaagacagccacaacaagaagagctaactaccctaaatatatatgcacccagtacaggagcacccagattcataaagcaagtccttagagacctacgaagagacatagactcccacacaataataatgggagactgggagacaccccacagtcaatattaaacagatcaacaagacagaaggttaacaaggatatccaggacttgaactcagctctagaccaagtggacccaatagacatctacagaactctccacccctaatcaacagaatatacattcttctcagcaccacattgcacttattttaaaattgaccacataattggaagtaaaacactcctcagcaaatgtaaaagaacagaagtcacaacaaactgtctctcagaccacagtgcaatcaaattagaactcaggattaagaaactgactcaaatccacacagctacgtggaaactgaacaacctgctcctgaatgactactgggtaaataacaaaatgaaggcagaaataaagatgttctttgaaaccaatgagaacaaggacacaatgtaccagaatttctgggacacatttaaagcagtgtgtagagggaaatttatagcactaaatgcccacgagagaaagcaggaaagatctaaaatcgacaccctaacatcacaattgaaagaactagagaagcaagagcaaacaaattcaaaagcaagcagaaggcaagaaataactgagatcagagcagaactgaaggagacagagacacaaaaagccgttcaaaaaatcaatgaatccaggagctggttttttgaaaagatcaacaaaattgatagaccactagcaagactaataaagaagaaaagagagaagaatcgaatagatgcaataaaaaatgataaagggatatcaccaccgatcccacagaaatacaaactaccatcagagaatactataaactcctctacgcaaataaactggaaaatctagaagaaatggataaattcctggacacatacaccctcccaagactcaaccaggaagaagttgaatctctgaagacaccaataacaggtactgaaccaaggtttggaccaaccaaaaatgtccaggaccagatggattcacagttgaattctaccagaggtacaaagaggagctggtaccattccttcagaaactattccaatcaatagaaaaagagggactcctccctaactcattttatgaggccagcatcatcctggtaccaaaacctggcagagacacaacaaaaaaagagaattttaggctaatatccctgatgaacatcgatgtgaaaatcctcaataaaatactggcaaaccaaatccagcagcacatcaaaaagcctatccaccaaaaccaagtcagcttcattcctgggatgcaagactggttcaacatacgcaaataaataaatgtaatccatcacataaacagaaccaatgacaaaaaccacatgattatctcaatagatgcagaaaaggcctttgacaaaattcaacagcctttcttgctaaaaactctaaataaattaggtattgatggaacgtacctcaaaataataagagctatttatgacaaacccacagccaatatcatactgaatgggcaaaacctggaagcattccttttgaaaaccagcacaagataagaatgccctctctcaccactcctattcaacatagtgttggaagttctggctagggcaatcaggcaagagaaagaaataaagggtattcagttaggaaaagaggaagtcaaattgtctctgtttgcagatgacacgattgtatatttagaaaaccccattgtctcagcccaaaatctccttaagctgataagcaacttcagcaaagtctcaggatacaaaatcaatgtgcaaaaatcacaggcattcctgtacaccaataatagacaaacagagagccaaatcatgagtgaactcccattcagaattactacaaagagaataaaatacctaggaatccaacttacaagggatgtgaaggacctcttcaaggagaactacaaaccactgctcaacgaaataaaagaggacacaaacaaatggaagaacattccatgctcgtggataggaataatcaatatcacgaaaatggtcatactgcccaaggtaatttatagattcagtgctatccccatcaagctaccattgactttcttcacagacttggaaaaaaactactttaaagctcacatggaaccaaaaaagagcctgcatagccaagacaatcctaagcaaaaagaacaaagctggaggcatcacgctacctgacttcaaaccatactacaaggctacagtaactaaaacagcatggtactggtaccaaaatagatatatagactaatggaacagaacagaggcctcagaaatgacaccacacatctgcaaccatctgatctttgacaaacctgacaaaaacaagaaatggggaaaggattccctatttaataaatggtgctaggaaaactggctagccatatgtagaaagctgaaactggatcccttccttacactgtatacaaaaattcgctcaagaaggattaaagacttaaatgtaagacctaacacctagaagaaaacctacacaataccattcaggacataggcatgggcaaagactttatgactaaaacaccaaaagcaatggcatcaaaagccaaaatagacaaattggatctaattaaactaaagagcttctgcacagcaaaggaaactatcatcagagtgaacaggcaacctacagagtgggagaaaatttttgcaatccacccatctgacaaagggctaatatctttgtagaatctgcaaagaacttaaacaaatttacaagaaaaaaacaaacccatcaaaaaagttggcaaaggatatgaacacctttacactgttggtgggagtgtaaattagttcaaccattgtggaagacagtgtggtgattcctcaaggatctagaactagaaataccatttgacccagtgatctcattagtgggtatatacccaaaggattataaatcatgctactataaagacacatgcacacatatgtttattgcagcactattcacaataccaaagacttggaaccaacccaaatgtccatcaacgatagactggataaagaaaatgtggcacatatacaccatggaatactatgcagccataaaaaaggatgagttcctgtcctttgcagggacgtggatgaagctggaaaccatcattctaagcaaactatcatgaggacataaaaccaaacactgcatattctcactcataggtgggagttgaacaatgagaacacatggacacagcacaaggaacatcacacaccggggcctgtcaggggttggggggctgggggagggatagcattaggagaaatacctaatgtaaatgatgagttgatgggtgcagcaaaccaacatggcacatgtatacctatgtaacaaacctgcacgttgtgcacctgtaccctagaacttaaagtataataaaaaaaaaagaaagaaaagaaaagaaaaaaagaagtggcttttacctcccaccacgattctaaggcctctcagccatgtggaactgtaagtccagttaaacctctttttcttcccagtctcgagtatgtctttatcagcagcgtgaaaatgaactcatacacacacacagaagtatatctttacagttcccaggatggactgcaagtttggctctaaatttcctttgcctggccaaaacaaaaagaacacattttattataaggttcacaggcttttaattgaaaaaaaaaaaaaaacagttattcaacatgaaaactctttttcagacaaagttctacaaagtctatttctcacaagtaggactttggcaaggattgtgcaactgacaattcaaagtcatttattccgtggtgagaaaccggagtacagatctttaccagttaggggatgatccatgtgttttgataatcaccttggtggtgatcagactaaaggtctcctatgaaaaccattaacttcacactatagctgataggatgcactgaagcccttaccgctgactgcatggatgagagctaggccagagcattggcaggcagagtttataacatggggcaggaagcattgaaattctattccacctcttggtgtatcaggtcaggagtcaaatctcctatcttcctcttctggatcgctttcctcctgaagtgtctggcatagatgtctaggtatagcttggcatggtggtgtgtgcctatagacccagctacttgagaggctgaggtgggaggattgcttgagcgcaggagtttgaggctgcagtgagccatgaccacaccactgtactccaccctgggtgacagagcaagaccctgtctctctttctaaaaaaacaaaacaaaacaaaacaaaacaaaaagaaaaaaagatgtccaagtgtgttctggttactgctgctgactgctaaatttaacagctagaaaaaaaaagtttggactctatggatcataaatttggataagacacagagggaatggcttgtctcatgttcacaatgtctaaagtcttaaatggggagagtcgtcaaccaggggtaatttgagagttatgggctggaaccaccttgaggcatctttattcataggctagcaattgatgttggctgttggctgggacgtcagctggagctgtcaactgggagacctgtctgatatcccagcataggacactagacctctcacaaagtggcgagggctccagaagcaagtgtcccagctgacaaaaaaaaaaagtttcatagccttctacgacatgcacttagaagtggtaatgtgtcacttccagccctttctgttgattacaagtgagtcatgagtccactcagtttcaagggagagggcccagatcccatatctccatgggaagagtgccaagaacaccttgtagaaaagcttgtggataggagatattggtgtggtcatccttggaaaacacaatcttccacagtgtgcaagagaggcttcctgctctgcattgtggcttaattattgttgaaataccaggcaagaaaaggtaggatccagggaaacaaatgtatccaggatgttttggtctgccttttctaggaaaaaaggaaaccctcaaagcctctgagactaggtcaccccagtgggactagaagttccacgtggaaccttctgcaaactcctctgcaatagatggactgtgcattttccaaatgtgtctttacatcatctcctttctgaccttgggaagatagtaactgactgtggagtaggaaatccagaaccctgattgttttaaaatatattacagatacaagtaatgaaaagaaggctcctaaggaaaatatagatccgtaatggctttgtcccaaaagctattaggctataatattttattacaaaggctatatttattacaaaatgtatttaaataaatacttaatatttatttaaataaataatatttattttattattaataattaatatttaaataaatataatatttcttacaaaaattaaaaactgggactttatatttaaaggtgagacattaaattctttttaaaaagtgcacatgtaagatttttttctcaagtcaactgaaccagttcatcagtttcactatgaatgtgttgatgcaccaagtatttactttctagaacatctagtagacgtcactaaaaaattataccaagttgaaaaatgtcactgaatcagaggcatgtggttggttatgtagtcatctgtgccagctgggaatatagcaataccaaatgaacagcactgccatgttcccttgctgggttccagcaaaaacactcatcttcactgtcgtctctctttgagacctcttagagaggactttgatgagtgtatggtcttatacacactagtctaacaatacacatttgctcaaggattgggttacgagcaggctcttcacctttcaggtgaacaattacacatcaggagaaggatggaagtttcctatctatgaacaaatatttcccaaagcaataatctctttattcaactcacgtaatgagaagtcagttcctctgtgccataaagcaatctctttgaagtcttcagtaatgttgagggttttaatgttgagggctttatcaaactaaacattcaagtgtcttaggctttccccttagttctttgagcaaattggttgctatgaagtatgttagtgttccgaatgaatggatagcatgatgggggatgtctaggtggttccagaatttagattgtggtttccataacaaagtgtggcagtattggcattagggaagagaaatgacttctaaataacttctcaaagtttactaaagccttaagaatgtaggaaatggccacaaaaggaggtatacaaaacattcctctgtctttattcctctttatacaaacgtattcactttcccatcagcaagtcataaaatacttctcatcttgcattacagtaggacacctactataacaataggctacaaaatgtataatggctcaaacacctagcagtttatttcttatttacttaacaatgctgggtccacgaacatgttgatatcataaccctcttttatgtggtcactcagggactcaggctgttgagggctctgtcatcatgaatgggtggcttccaaggtcatcctaagagttatctccattctaaccagtccagccagaaaggcagaacaggcttggaggagcaaagatatccatggatagatcatcctcttaaagtcattgtagcattgtgatagggctcttttcacaaaacaaggatacaatccatgttttcaagattttacattttagtagccacaatacaaagaagctaagatagtcttgtgatttgtcatcatggctgttaatggagagtgttttaaaagcactgatatcagggctccaccctcagcttccaatcatcaggtttggatggaacctgacagctgcatcttgtaaaactccacgggagattctgagagacagccaagtttgagattcacaaaccttaagagaaaaaatctccttgaattgccataacaaactaccagtctaataaaacatacatattcctttgactactcttaaatgaaacaaataggtaataatttacctgtacatataattaaaaatgtaatgtattttataaccatcatataaaggagaaattatattaaactatattaaaataaaatgatatatatttcaatgcagatgcccaagcttgactaaagtaggaaacataataaagtaataaaatgcttatatgtacttataatgaatgtttggctatgagaagatgatcagaggctttttgtccaagaagtacaggcatatgaaaaagtagagcaagagatggacaccagactgagaaaactaaaaactaaccaacctatttgtgtatgataaaaggagagaaaaaaaattgattagtaaaaatatgctaccgtgtggtctgaatgtttgtcccttccaaaactcatgttgaaatttaatcccccatgtggcagtattgagaagtgggacctttaagaggtgattggttcaagaagattctgcgctcatgagtggttgaaaccattcacggaataacgggttaatggatcaatgagttatcccaggagtgggactggtagctttataagagaaggaagagagacctgcgctagcacactcagcctccttgccatgtgagccatctcgggaccccgcagagtccccagcagaaagaaggccctcacccaatgtgtccccttgacctaggatttctcaacctccataactgtaggaaatgaattccttttctttgtaaattatccagtttcaggtattctgttataaacaacagaaaatgggctaaaacacacgccaagaaaattgaaagactgtggaagtgaaagaagaataaaaaatgaagtaattttgcaaatgagtctggctttattataagtgtattgtcaaagtgattccctttgttataagatgaaaaagagccaaaatggatagaaacatttatcctatcttaatatcccactacattcaaggcaaatattcagtcagtctctagaacttaacaaggccttggagatgatatcctttggatgagcaatggagaagacaagatggattggaaaaagaaacaaacaaacaaaaaaacatgtaagaggctatcaggaaaactctggagacgatgtcaatgtaaaacagatacaaacctcaaaataattttaatatgtacattgcacaaaaatggacttcttatcatgttacaaatttattttaaaacatataggaggcaacaacaatatttcattgatgtgtactattttataattgttggctctaattttatttagtagagtcttacatctcctctctacatatttacatccggttgtattgtttttgtagtacctgttcaactgcactgaaatcatttcaattaaatgcatggttgaaaagctgacataatacattcaattgccaaattgcataaagtgaataagctatttaataatttggagaaaatatattccatttaaacttccttctctataaccagttcatacactggaccttttgggcacagccatgtgaaagcttttcaaaacttttcactacttttttttgagacggagtctcactctgtcacccaggctagagtgcagtggtgcgatctcggctcactgcaacctccacctcccaggtccaagtgattctcctgcctcagcctcccgagtagctgggattacaggcacctgacaccacacctgactaatttttgtaattttagtagagacaggatttcaccatgttggccaggatggtcttgaactcctcatctcaagtgttccgcctgccttggcctcccaaagtggtgggttacaggcatgagtcattgcacccagccactatagatttttatttgtagtagatttagttcagtagggcatttgagaggcataggaactggaacaaatccttcattgtttgggactgccttgcacattgtaggacatccagtacagtcccttccacgaagtggcagcagcagcctcgggctgtccaaacaccctgttagggacagtgccactcccggaaccacagaagaaccacaatcataggagaagcatacaacaaacatggtgttcatcggacggtcagcttcagtggcacttttgagcaagcacactatttggttgtagaatgagtccctggcagggcacccgaaaggctgatgtgtgactcatccctagtacctctgagaatgctgaaatctcctccttctccaagctgagtggcagctttctggtccagactacttaaattgtgacttgaggaattttcttcactttttcctttgagtcattctgtttttgatcaagatgcgatagaatgaaggattctttcagggtctgctgtcacatccttcctttgggaacagatagaaaatctggcctggcttgaagagtttgtcctcaaacatctggtaagccataggcatcagcatctcttacttctccagagacatttagatgtgtcccccatctccatggaggcccatggcaaggggacccctagttgtactagagcttccttctgggcacagccacactgcacaggcactgcagtgtacagcacagctcctccagcttccggaagactccattatctagaaaagtgctgagaaatggagaagggggttcctctggggtggagatggaaagaggaaaaggaagggagaatgtccaagcaaaatgagagaaggtgagggacagcagaattgagagtgagggagagggagagagcaagagactgggttgagatgtcttgtacatgggggtgtcctcgtggcttcactcccctttcgtttgtaccactccgtttccccagactcttcctaaatatccccttattggctacaagatccagattgcctagaagctcagatttgctgacagcacctcaagactggttaatgacatatagattttttcttgtttccatctttgggatttggagcaatctccagagttgcaaaagcctaccttgttgcaataatatttttgagggtccacactgtctgctcacttgctctatgctgctgggcacagtggtgtggccatccagggtgggagagaccacctgggatatggaaattaccagcagccctgttttgctcttgcagtggttgccaaagcacacgaagcattctgggaatctgaatttctgttgtttctcccaaatggcccctgaagggcaacaggcagcacacatggaccacattttgccagaaaagtccagaaagaagatggctgctgttgtcaactattggcatttcaacaggacctatttttatttctcagtatatttgcacaactaggaagcatctgctgacaaggatgagatgataagctgtattgatgccaaaacaggactagaaaaacaggcttgttctgcaaatggcctgcatcctgagagtccgtgttaagaacattctctctctgcaggcaatatctgctcttaaaacattaacacttgaaaggaagtaaggcttggaatccttagcatagttatgcacacactaggttctcagtaagtgcatgctggatgaaggaacccacacgcaccttaaggaggatggaacattggcagcccaagaaaaaagtcactccccagaggccgagtgccatgtctttgacctccattggcaaggtcatggtgaaatgctgtctcttggggtcgctgaggtcccagcacggtgtgccttcacaccgtgcaaacaataagaagagaagagaggcacacatgtcacctttccaggcagggacatccaagctgtttgagtctccattctgtgatttccttgaacaagaaagggattattggtgaatgaggccagcatcctgggtgggaacaaaaaaggaaattggtagaaagtacatcatccaagttggtctaactcagccctgtggcttgggcgggttcctaggatatccagccggaggcagaggctctaggggatgtgaggctgcactgggtatgatgacacagaggactgtgagaggcagagaaaaggggagaagagctgaggccctcctagccctaacctcccagctcacaccctctgctatctgccacctccaggccaacaccacggccatgggaggtttgcccatttttctgatagacacattctttctctaccaacagcccacatggaacataagtgaagtaattcagcagtttccttcttaatctgctgtctctctgctgcttactcattctgtgctgtttgctttagatcaaggtgccccagggtaccaaaagctacattatcctattcaactgcatggaaaccaagatcccgaccattctggtttgttgttattgttacgttagttttaaaccttagccattttccattctgggcagttacaactctgtttactatgagttcctctgtgtagatgtttctcccatacccgacctacaaactgctacgtgagcagtaacttgtcaccatgttatccgcataaagtcagggattgataaacttgggagcctttagctcttgaaggtgctgatgaggaaggggagaggggaggagaaggaatttgtttgtgagatggtcagtgggctgaatagtggtatgaccaaaaagtgttactataaatacacataatctggaaaacaaaaatactgtcatctcctccctgcaaggcgctgtgattaggcaggatggagcttattgctgcagtgttagaaaatgcatccttgtagtcccaaaaaagcctgttccatcctgcccatctcttgttctcaatacttcttacttcacggtcactcattttcttcctgtccttgggttgaggtctcaacttcttgtaatagaattttttcagttataagcgacagaaatccaactcacactatcttaagcaaaaaggggattcactgatacgtgtgttaggaaggatatatgaaagctcaaaggtcaagtgaaaaaaatgtaagaacgaagaccttggtggggtgtggtggctcacgcctatcatcccagcattttgggaggccgaggcaggtgggtcacaaggtcaggagttcaagaccagcctgcccaagatggcgaaaccccatctctactaaaaacacaaaaattagccgggtgtggtggcaggctcgtgtattcccagctacttgggaggctgaggcagagaactgtttaaacctgggaggcagaggttgcagtgagttgagatgtgccactgcactccagcctgggcggcagagtgagactctgtctcaaaaaaaaaacaaaaaaaaaaaactaagaccttgtgactactacctactacctggatctctctctctctctctctctctttctctctctctctctcacccccccacactatcacctctccttgttgtcagtagtttcctttctgcagacaggagttccatgtgctgggaagagggccattcagagcctcgtattctcatcctctcagtttagcaatgcgagaagaaaaaacttttgtctcacaacctcatatacaatctcagaaataggctcttattttctggcttgaggctgtccagaggcaccaggcactgtgatggtctcactttctgtcctggatctatctgtggggcccagacagcaggatctatttcagaaaataggcgagagaggaaaaacttatgtggccgtaaaaaacagcggttttcaagtggcctatccccatccacatcataaacttttctgctgaggcttaaaagtgcttagacttcaaacttgatctaaaacagaaatcctacctggaaaaatcaccttccagtcacttagccaatcgctcatcactctctgtctctgaatctcaccacgagtttcacacgtctcccgagagagcgtctcctttatcattaccacatgtggagtcagcagattgggtttcatctaagctctgcctacctactatccgagttccctagcaggttagtgactttctctgcctttttgtttcttgatgtgaaaaggaacaacagtggctgctcacagggttgtcagttacatggtcaattacattacatggacaattcatgatggtgtcagacctgtctgagaaaaggtggcccatgttaccatgacaggccccaaggctaacagcccctttctgggtcatggctcatacaaaggagccctccttggtttgctggtgctctgagacttgcaaatgcattaggaattttacactgtaacccggttttaaatgggtccagagcatccccattgctagactactgtgctgaggaagggcactggctcattgttacatcccatgaacactctgggtctcctagacctcatcctctttgagcttctctctctcactctctctctgcgcattcaggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgaggtgaggcatctgtgggcttcctacaggagagacataaagaaaacatgcccccaaacctatgtgacagctggccgggaaggactggtgcctgcatatggagagtgcacttgtgacagttcctggcatagaataagcataaatgctataggaggacagaagagagaggttttaaatctgcgagggtcacagggcaagtgtcagagaaggcatagaggaagcgatacttacgcttggtttaaagcatgtgctttggggcagtggtttagagattgggtgcagtgtgcaaataggaggagggggccaatcaagagaagtcagtgaatgtacacatcccctgaagacactgggtacatctgttatggtccctgtgtacactcggatattctaaatgagagaccctggggccagatgcctcacggagagtcaatgttgactccttcatacctgttgaaccccttcttgtcacccccattgccattaccctagtctaagccaccatcattttctgttggacttctgtgccagtcactggatgtgtatccctgcctgtaatctagatcctttctagatcattctccatgatgtgtccagagtgatcattctagaaccaaatctgatgtcatcctcctgcttaaaacccttaagttctcattgcttttagataaaatataaaccctttcactttgtttttattactccttatgattcagcccttacttagcttacaaggacttcctcatgtctgagctctagccataatagctgactgttggatgagtcatcggggggaggttcttcttcaggctgcagattggcggtcagccctcctgacctcagctgggctcactcacacatctgggaggcagctgcctgaggccagggtgactctgctctatgcctcatgtctcctatcctccttgtacccacatgttagctgggacatgttctcatcgcaatggcagaggcatgagaaagtgatcctgtttgggcaagtgcattttactcttttctttcactcatgtccactgacatttcattggccaagcaagcatgtggggtgtccagagtcaaagagggacatgttgccggggtcatgactatttctgagcaataatctaacctatcatagctcagatctcactccttgcaggaagcatctcctaatccttaagacctagttggaacttacactctgttcttccctatggttactgcccattttactatttttctgcccatttagactgacaactctgtgagccatcattgcaatatggcttgcttacccaatatcacctagcatgatgtagagcacatagtaaatactcaacaaatgttttctgtaagagctaaggaaggacatcagcagacaaaatagagtctttctatgccaaaaggtgaaagtggtctcatttccattccattgtcctgtaatttggctagccaaaagcttagtggataccattcccataagtagacctcatctgcagggaagagatggggagactgctgggttatttattgcagactccagcaggaccacaacaatgattcaaagtgatgacactagaaggacaggtgccaatgggtgatgaagccacaatgacgatgtcaagtggtatcactaaaaggacaggtactcatgggtgatgaagcctacatgaccttgggcttacaccaggaccctaggaatgaaagagattccttctcttagtggctatgagggaaggcctatgatgtcttaaggaggttggattcgatcatttttaagggaccttcaaatccttagaccgtgattcaaatggtaagaagtttgctccattaaactcccaggcaccaccctttccggagacaacctttaaaaattattagctcctgggaaaatagatgtatctcattttctttgtatccctcacagtgccatatgtgaagacttacatatggtatatgcccccaacattactactgagtgagtgaacaaagaaatgagggaatgaatggatgaacaaatggctcatggcaggcttttccctgccctgtgaattcggcttctacttggtaagaaggtgattgcaatctctgttctcagggttccccaaggattcctgtgtaacagatgaaggaatcacgtctgtcaggtagagtaggtgactgcattcagagtatacatttccagtctcccctgtctttttcttttgatgagtattatagagagggaagccatgagtggattagatgccaaaatccctggctgagagaataaccttaccctggaggaaaacatattagctttgactctgagctgggaatttcggtgatgttgtagattcaatgcattgcagttgggtgtttttatttgttgaaaggaattgctgaattttcaaatccattaactgcttgtcagcattagcaagcctaattagttaatactaagtaaatttgcactaaatatacaaccctggctgattttactggccacgtctggcagagggcagcagcagggagaaagctctgtagagtttctgttggaatcgtgtgaaaagctggagaggttgcttctctttctctctctctctctttctctctctctctctgacacacacacacacatacacacacacacaattgtaataataataatattttggttcctcactaagccaatctaaatcgcagaagtctattttgttaagtaagcttggccccagccatatgttgctactcagagaatttaatatcagatttcatctgactgtaaacgtgaatcatcaggttgcacaaggaacacagtggcagatccagggggcatttaacttttatagcattttaaatgaaaaaaaaaaaaagtaacacttaaacaagtaatttagatcatgctgtaggccctgaatagctttgatgttgtgttttcatggcaagtctccaacttgagctgaattttcccctactaaaaatgcaaatttttctaagaccttctcttggtcctgctactcatgatacatatttcttttaaaagaaatttcaaactagataatagttgttctcctccccacccccgccaccagtagtgtggtggggcagcagagttgtggctagtggaggagagcagaggaggagagtagggaaaggagaatgccatttgcctacatttccctctgcccatttcccgctgcccatttccccccttgttttcctgaacgtgaactgagctctgggcactgttttaggcctagcaggggacaggataaagcctgcttctctaggaattcgcactgagggtgtgagtgtgtgcacgtgtgtgtttggaggcgggagaataaacacaaataaataaaaaggagaatttcaggcagtgataagagtgctgagaaaaacagaacggtgtgaaagaggaaggctgagcctgcagaggcttgaggctgctgccactgggtagcggtaggcctttccgaggaggcggcatttgaagaccggaggaaggttcatcccagcaagtaggaacagcaagtgtaggtcccctaagtcttgggggagcttagttcctttaagggcagcacaaaaatcagtgtggctccggagagcacattaggggagagaggcaggaagagcttggagacatggatggaagctggaccagttgggccttgttgaacatggaaaggcatttagatcgtattctgagttaaatgggaagtgacgtgagagatttaacaatggagcgtcttgaactgctttactcatttaaaatacccactcctgcttggctgaatatctcatgttgtctttttagaagctttggcgatcctatttgaatgcatttaggtcctattggaggggaataggatctcatttgaggccacggaggtccatggaagtcacctgcatagcaaataccctgaaagtggctgcagggagagtgtgagggtgggaccgccctggtaggaggtggaaaatgaaaaacacacggccatgagttccagattagggcttctgaaagccctcagctttcccagctcccatcctaaagtgggtctttaaacaggaagaaagaaagattgctaagtgtctttggagttcctcttccttccccttctagggatttcagcactcctggggctcgggttggctctaaagtagtcctttctgtgtcttcccacctacagtaacaaaggcatggagcatctgtacagcatgaagtgcaagaacgtggtgcccctctatgacctgctgctggagatgctggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacggtctgagagctccctggctcccacacggttcagataatccctgctgcattttaccctcatcatgcaccactttagccaaattctgtctcctgcatacactccggcatgcatccaacaccaatggctttctagatgagtggccattcatttgcttgctcagttcttagtggcacatcttctgtcttctgttgggaacagccaaagggattccaaggctaaatctttgtaacagctctctttcccccttgctatgttactaagcgtgaggattcccgtagctcttcacagctgaactcagtctatgggttggggctcagataactctgtgcatttaagctacttgtagagacccaggcctggagagtagacattttgcctctgataagcactttttaaatggctctaagaataagccacagcaaagaatttaaagtggctcctttaattggtgacttggagaaagctaggtcaagggtttattatagcaccctcttgtattcctatggcaatgcatccttttatgaaagtggtacaccttaaagcttttatatgactgtagcagagtatctggtgattgtcaattcattccccctataggaatacaaggggcacacagggaaggcagatcccctagttggcaagactattttaacttgatacactgcagattcagatgtgctgaaagctctgcctctggctttccggtcatgggttccagttaattcatgcctcccatggacctatggagagcagcaagttgatcttagttaagtctccctatatgagggataagttcctgatttttgtttttatttttgtgttacaaaagaaagccctccctccctgaacttgcagtaaggtcagcttcaggacctgttccagtgggcactgtacttggatcttcccggcgtgtgtgtgccttacacaggggtgaactgttcactgtggtgatgcatgatgagggtaaatggtagttgaaaggagcaggggccctggtgttgcatttagccctggggcatggagctgaacagtacttgtgcaggattgttgtggctactagagaacaagagggaaagtagggcagaaactggatacagttctgaggcacagccagacttgctcagggtggccctgccacaggctgcagctacctaggaacattccttgcagaccccgcattgccctttgggggtgccctgggatccctggggtagtccagctcttcttcatttcccagcgtggccctggttggaagaagcagctgtcacagctgctgtagacagctgtgttcctacaattggcccagcaccctggggcacgggagaagggtggggaccgttgctgtcactactcaggctgactggggcctggtcagattacgtatgcccttggtggtttagagataatccaaaatcagggtttggtttggggaagaaaatcctcccccttcctcccccgccccgttccctaccgcctccactcctgccagctcatttccttcaatttcctttgacctataggctaaaaaagaaaggctcattccagccacagggcagccttccctgggcctttgcttctctagcacaattatgggttacttcctttttcttaacaaaaaagaatgtttgatttcctctgggtgaccttattgtctgtaattgaaaccctattgagaggtgatgtctgtgttagccaatgacccaggtgagctgctcgggcttctcttggtatgtcttgtttggaaaagtggatttcattcatttctgattgtccagttaagtgatcaccaaaggactgagaatctgggagggcaaaaaaaaaaaaaaagtttttatgtgcacttaaatttggggacaattttatgtatctgtgttaaggatatgtttaagaacataattcttttgttgctgtttgtttaagaagcaccttagtttgtttaagaagcaccttatatagtataatatatatttttttgaaattacattgcttgtttatcagacaattgaatgtagtaattctgttctggatttaatttgactgggttaacatgcaaaaaccaaggaaaaatatttagtttttttttttttttttgtatacttttcaagctaccttgtcatgtatacagtcatttatgcctaaagcctggtgattattcatttaaatgaagatcacatttcatatcaacttttgtatccacagtagacaaaatagcactaatccagatgcctattgttggatactgaatgacagacaatcttatgtagcaaagattatgcctgaaaaggaaaattattcagggcagctaattttgcttttaccaaaatatcagtagtaatatttttggacagtagctaatgggtcagtgggttctttttaatgtttatacttagattttcttttaaaaaaattaaaataaaacaaaaaaaaatttctaggactagacgatgtaataccagctaaagccaaacaattatacagtggaaggttttacattattcatccaatgtgtttctattcatgttaagatactactacatttgaagtgggcagagaacatcagatgattgaaatgttcgcccaggggtctccagcaactttggaaatctctttgtatttttacttgaagtgccactaatggacagcagatattttctggctgatgttggtattgggtgtaggaacatgatttaaaaaaaaactcttgcctctgctttcccccactctgaggcaagttaaaatgtaaaagatgtgatttatctggggggctcaggtatggtggggaagtggattcaggaatctggggaatggcaaatatattaagaagagtattgaaagtatttggaggaaaatggttaattctgggtgtgcaccagggttcagtagagtccacttctgccctggagaccacaaatcaactagctccatttacagccatttctaaaatggcagcttcagttctagagaagaaagaacaacatcagcagtaaagtccatggaatagctagtggtctgtgtttcttttcgccattgcctagcttgccgtaatgattctataatgccatcatgcagcaattatgagaggctaggtcatccaaagagaagaccctatcaatgtaggttgcaaaatctaacccctaaggaagtgcagtctttgatttgatttccctagtaaccttgcagatatgtttaaccaagccatagcccatgccttttgagggctgaacaaataagggacttactgataatttacttttgatcacattaaggtgttctcaccttgaaatcttatacactgaaatggccattgatttaggccactggcttagagtactccttcccctgcatgacactgattacaaatactttcctattcatactttccaattatgagatggactgtgggtactgggagtgatcactaacaccatagtaatgtctaatattcacaggcagatctgcttggggaagctagttatgtgaaaggcaaatagagtcatacagtagctcaaaaggcaaccataattctctttggtgcaggtcttgggagcgtgatctagattacactgcaccattcccaagttaatcccctgaaaacttactctcaactggagcaaatgaactttggtcccaaatatccatcttttcagtagcgttaattatgctctgtttccaactgcatttcctttccaattgaattaaagtgtggcctcgtttttagtcatttaaaattgttttctaagtaattgctgcctctattatggcacttcaattttgcactgtcttttgagattcaagaaaaatttctattcttttttttgcatccaattgtgcctgaacttttaaaatatgtaaatgctgccatgttccaaacccatcgtcagtgtgtgtgtttagagctgtgcaccctagaaacaacatattgtcccatgagcaggtgcctgagacacagacccctttgcattcacagagaggtcattggttatagagacttgaattaataagtgacattatgccagtttctgttctctcacaggtgataaacaatgctttttgtgcactacatactcttcagtgtagagctcttgttttatgggaaaaggctcaaatgccaaattgtgtttgatggattaatatgcccttttgccgatgcatactattactgatgtgactcggttttgtcgcagctttgctttgtttaatgaaacacacttgtaaacctcttttgcactttgaaaaagaatccagcgggatgctcgagcacctgtaaacaattttctcaacctatttgatgttcaaataaagaattaaactaaagacaacgagtttgttttttgtaagctccacttcttgctagcagttcaccactgatcctctaaaatcaaagtggttaaacgatctgtcacacacagtgagtctgaatgctaaagcctctcctcacctcactccctctgcccaacacccccaggtgtatcaggaagtgtgtggacactgtggtcaggcagaactggcctcaattcttggcttcaccacttacaaattttatgatcattggcagttgatttttcagagtttcggcttccttatcaacaatatgatgataagtaataacacctaattcacacgatggtggtgaggactaactgaggtgctcattaaacatagttgctgttttttaatgcctggcccaaatccttccctgtgagggagaagaaggatgcttgagagtggttatttatgaatgaatgagtgaatggaagaatgagtgatctgaaatgatataattagcttaaaaacctctccctcattctgaaggtaaagcaggaacaattggtccacccccaccccaggtttccatttcaggactcccttccctttttggagctacctgcgtgcttcctttacccattttctcagatttaactgatgaattgggagggggtgggtataggacttactgagatgcaacataatattcacacaggctctgcagctagattactgtttgaatcttcattctacctttttttttttttttttttttgcatcaccttgggcaagttgagttccctgggcctcagtttcttgacttgtaaagagagatgacagtgcatctgcctggaagggttcttttatgaagaccacatggttcgctcatggagagtatggaaggaccgtggctgacactgcttctccctctccagagtcttccgaaactgcacgttggactcatttctttattaggatgggttgagggtcttctcattgtttgagtcacatggatttcaggaaactaattcattttcttgtccaagcattcccttggcaagttcttcaatccctgttttcaatggtttcctcatttctaaaatagaaacaagaatagcacttaccctatagcagtactgtgaagattacaagactggacatgtgaagtgcccaggatagtaccacacatagtcagcactcaatccacattagctatttttatcacaattattgttgccctgtctgagcatctacatttaatagaatgatggatatgtttagatttacatttttcacgttattatcgttttgtacatgcctcctgtctttgttcctctgttcttactgcctttcgttgttttagtgatattatggtacaataagaaatatatatttggtctctggccccagtttctgagacaatttctaaaactcttgtagacaggggtgctaggaggctcttttgttctaatatttggtctttgaccctggtttctaacacagagctcccaaatcccttggaatttcctgggcaatagaaacttcttttgttctaatgaggcagctcctggtgggctcctggataacctcaggatggggaatcagccatggcattaaagggttggaactttcagctctaccctttgacctctggagaggctcttgagaggctctggagaggggctgatggttgaatagatcatcagtggccactgatgtaattaatcatgtctatgtaatgaagctgccataaaaaacccaggaggacagtgttgagagagcttctaggttggtgaacacttgggggtgtctggaagacagcccacctggagaggacacggaggctcttcgcaccttcccccatacctggctctctccatctcttcatttgtccatctgtatctttttcattatattatccttgataataaactggtaaatataagtgtttccctaagttctatgagccaccatagcaaatgaatcaagcccaaggaggggtttgtggaaactccaatttataaccagttggtcagaggtataggtgacaacttagtactttgcaattggtgtctgagatggggggcagtcttgtgggactgagcccttaacctgtgggatctaacagaaaacctttaaccttttccccccaaattgttaaataaatatttttagggtgtcattttaattcctctgttaatttttttttttttttttgagatggagttttgttctgtcacccaggctggagtgcagtggcacaatcttggctcactgcaacctctgcctcctgggttcaagcgattctcctgcctcagcctcccgagtagctgggattacaggcgagcgccaccacacctggttaatttttatatttttagtagagacagtgtttcaccatgttgggaaggctggtcttgaactcctgacctcaagtgatccgcctgcctcagcctcccaaattgctcagattacaggtgtgagccactgggcccagccaatttaattattttttgaattattttcttagtgattgctcagtatgcatctttttttttttttttttttttttgagacggagtctcgctctgtcgcccaggccggactgcggactgcagtggcgcaatctcggctcgctgcaagctccgcttcccgggttcacgccattctcctgcctcagcctcccgagtagctgggactacaggcgcccgccaccgcgcccggctaattttttgtatttttttttttagtagagacggggtttcaccttgttagccaggatggtctcgatctcctgacctcatgatccacccgcctcggcctcccaaagtgctgggattacaggcgtgagccaccgcgcccggcctcagtatgcatcttaatctatcacagtatatttcaaattaatagtaacttaaatctgatgacataaaatgaaaatatttgctccaatgcagctccattctcttattaccacatatattatatctatatatgctataagctcaaccatgttattttattgccttaaactactttctatctttttaaaaaaattgacaagaaatgagaaaaaaatttatggactttagaaatactaatctgcgtatttgccaattccagtgtgcctcatttcttcctgtggatttgagttactgtctggtgtcgttttcttttagcctgaagcaattcatttagtattttttgtaaagtgggtctactagtaacgaattatcttggtctttgtttatctggtaatatattaattccaccttcatttttgaagcgcggtttgtagtttttttgaatgtggaattcctggttgatgatcattgatgtttttgtttcagcactttttgttttgctttgttttgttttttgagacagggtgttgctctctcacccaggctggagtgcagtggcacaatctcagctcactgtagcctccatgttccaggctcaagtgatccttccaccttagcctcccgagtagctggaagtacaggcatgtaccaccaaacccagctaattttgtttgtttgcttatttatttatttattgtagagatgaggtctcattatgttgcccaggctggtcttgaactcctgggctccagcaatgctcctgccttggcctcccaaggtgctgagattacaagtgtgagccaccatgccctgcccagcactttgtatatatcatcccattgtcttcaggcctccattgcttccaatacaaaatcagagccacccatgttttgatgctcacctgtatctgacaagttactttttctttattgcttttaagattttatctttgaacagtatgactataatgtgttttggtgtagatctttttgtatatattctacttgggaatcactgaacctcttgaatgtgtaaagtgatgtttgtcatcaaacttgggaagttttcagccattgttttttcaaataatgtttttcccccttcatctctcccctcccttgctgagactctctttacatatatgttggtatgcttgatgtcaatcccacaaatttctgagcatttatttattttcttttgccttttttcctctctgttcttcaaattacataatttctattcatttatcttccaggggactgttttgtttttcttctgccttcttgaatctgaggttgagctcttctagtgaatttttatttccattattgtatatttcaactacagaataaaaattgattttttaaaacttatttctgtctcttaagaattcccatttgttgattcattgttgtcatactctaattctttaaacatggtttccttcagatatttaagcatatttataatagctacatcaagtctttgctaaatccagcatctgggaaacacatagtttcttttgacctctgctattcctgattgtgggccacattttcctgtttctttacatatgtcctaatttttattgaaaactgaacattttagataccctattgtagcaactctggattcttattcttccctgcttgttgctactgcttgattttgttgtttttattcattttttaaataactcacctgaattaaatatatgagacttgcctctactagtatttggcttctgatatttctgctaggttcttaaattattattcctgtttttatttttaagcctgactttctcagagttgcccctatctccacagctgagcgtgtatccaatgactaggctcaaacaccctaacccagcaaggcttctgtcctccaccgatggatctgtatgtggctggagaatgcattcaattttcaggctgttttcaactctgactcaattttttgctgggcccctttgcatctcctctgcacatgcacacagccgtcatggtcagacaggagtcaggggctagctagcctgggcacactctgatctcccctaggcatgtttgcagcctaagccaggaatgtgcttgccacggccacaacctcaagctagtgaagacattggccctgcacactcatccaccaaatcaagtgagctcccctgtgactgcagcaacaaagctgtcggtccttctacctgccttgttctgttgctgaccaaactgggggaggtaagggtgggagcagccccaggcaagaatgccacaaatctgcactgtacttatacaaatttcagcaatttttcaatataaacatttctcagattgttatacatctttggtcaacttgcagagtgttgaaatagttgtttttgtcaattttgttcaaccttatagtttctttttggagtgaggatttaccaatactctctctcagccatagctggggatctcacctctccacataccctgtccatcctttatttctcttatcagaacaccaaggagcagacttgtctacatatgccatgtgttatttctggggatcagcaaggttttgagagaatactgagcaatctatggagcttttaaatgtacccattggagtgtgccaatgtaggaatgcctgactggggctggattacatactaggtaaagagcacattctccagtgttagatattcttaagcctttgggaacatttaaactcagaattaccacgtttagatttgcttctccaaaaatacagaatgtacgttgtattagcccattctcacgctgctacaaagaaatacctgagcctgggtaatttataaagaaaagaggtttaattggcttacggttctgcaggctgtacaggaggcatggcagcatctgctcagcttctggggaggcctcaggaaactcaatcatggcagaaggtgaaggggaagcaaggacttcttactttgccaggaggagaaggcagagggaggtggggaggcgctacacacttttcaacaaccagatctcacaataactcacttactcactatcacaaggatagcaccagaggggatggtgctgacccattcaggagaactccgtcccatgatccaatcacctcccaccaggccccacctccaacactagggattacaatttgacatgagatttgacgaggacacagatccaaactacatcatacgccttaaataagtaaattttcatagttttcattatttggactatgtgcattaagaagctagttttaagttcacattcgtggtggcttacagttaaaatatttggggctgggcgcagtggcttacacctgtaatcccagcactttgagaggccaaggcgggcggatcacctgaggtagggagtttgagaccagtctgggcaacatggagaaactccgtctctaccaaaaaaaaaaaaagaaagaaagaaaatacaaaattacctgggtgtggtggtgcatgcctgtaatcccagcttctcaggaggctgagtcaggagaatcacttgaatccaggaggtggagtttgtggtgagccgagattgtgccattgcactccagcctgggcaacaagagcaaaactctgtctcaaacgataacaacaacaacaaaaacagttgcaatatttgtgaataccaccaaaagagcagagctgagaccagagaaaagatgttcgttcaagacagagatacactttctaacagaactgcctatagataacctggggtgccggttgaagggaagggtggggagaatttcctgcaacgggagacacctctgcatggatccataaccatgaagctacaatgttgttgaaaagattccctcagcagatggaatgttctttgatttttctttctactgtgagacagcatacacacccacattcatacacacaaaagctacgtaccagttttacaccactttttcaggtaatcctcacagctaccatataaggataaattattatattttacagatgaagaaactgaagcctaaggcagttaagcaactcccaaaggtcagaaatcttgtgaatggcagacatgaaattagtcttcctgactttaaacatgagtggtacttcttagaccagggttgagcttcctaggaattactgagagttgctgagtacatatggaattttactcaaggactagagtgaatgttagttttgcatgtaatgcctgtcaatggtagactggataaggaaaatgtggtatatatacatcatggaatactatgcagccatgaaaagaatgagaacatgttctctgcaggaacatggatggcgctggaggccattatccttagcaaactaatgcaggaacagaaaaccaaatactgcatgttctcacttataagtgggagctaaatgatgagaacacagggatacataaaggggaacaacacatactggggcctatcggggggtggagggtggaaggagggagacaaacaggaaaaataatgaatgggtactagacttaatacctgcgcgacaaaataatcggtatgccaaacccccatgacacacatttacctacataaccaacctgcacatgtactcctgaacccaaaataaaagtttttttcaaaaattgcatttaagcaagctttcacattttctgaggagaaagaaaaactcataagaacttttaacgcaaaaggagtatttcatcaaagaaatatgacaccttggacaggatgctgaaagctatgtccatactcaaatcctggagaaatgtgtcccggttgtctttctggtgggcagccgttgggtagggaagcttgaggagcacttccaccatcttcctggcacctgggggtgccagtgctcttggtttctgaggcccctttcctgcctctgcttcctgctgaggagtggttttcctctgtaccttggcaccaggaggagctctatttctagccgatgacctgagaccttgaagcctgcagcggtggcaccctcactagcagcagggcctgtctcagcctctgacagtttctggggcaggctcaccctccccccgttgccacaagaccatctcatggcccaggaagggaccacagcccacagtgaaagcacttggcatctatgtagaactgacaaactaggaactgtcacctcactaaatgaacgtgaaaaaagataaaactggagcaaggaagcctttgggcaaacatttaaaaaagtgatttcgaaagtgggtgggctgacctcagtggccaggccaggctgggtgcctgggatgcactccaaagtggcagacgctaggccgtttgccaagagccagtcgccccaagggttgcaggacagacagccctccgagcgacttcccagattcagtgcgctgctaggcctttctgcggacctgcaacctgccatcagctgccttttcattgagaaatcagtaattgtgggaaaggccagtgaaaggtttgtgagccggttaacatttttacaagctgattaaattctcaagttcaccccggactcaatggagtttaagctgaaaagattcctgagtatttccacatttccaaccagaaagaacatgtttcaatacccagggccccagaccacaggctggaagggaggggagaagggcagagagagggtgcaggcagctgcaggaaccgtgtcgctgtctcggtagctgctttacacgtggtctcagtgccttgaggacgccaggcgcagaccagttttggggctcaaccccagcaagggaagcatttccttccaattggagggaagggctgatggtgccaaaattggagctgccagatggttccctaagaacggattacaaactagagtaaacactccatcaattcatctttgaatttattactaaatatttttaaacaccctttaacaatccctacaatctaatccattctcaaatgctaaagaaacgtgtataaagaaaaacattaagtgggtttgtcaaaagattggaggtttggatggaaaagtttattttagttacttggcaatgttggtacccactggttttagcccagcatcacaagaacctgggtccaggcagcagaaagacctgaacccaaaaaggacagaactcaaggcagctccaggcttctgtctatggaaaaagcagctaaactttgatctaggtttaaaaaacaatggaaaggcaatgtcagagaacttgaaacaatatggagatttttttcctctattttctgtgattgcttagaagcagaaagttaaaatagatgccctttcaaatttcctgtatctcatttcaagtcaagtgtccccgactagtgagttcctcctttccccagcaactctgtgacactggagattcaagacctcagcagctaccagggatatttaggcctctggagtacacaaaggccaccaaaggaagaaagggcttaacaatgcccccgggatcccatcaagccaatcaaaaggattgaaaaccctgaataagcaaggtttatcaccagccaaactatgtcaccatcctggtgccacactgcccattcccaccgagctctgggaaaccacctatgtgctctccttgccggagggacatacccagccccagaacgaaactctgcagaggggccagctactggcactcctgatgtcagcaccagcagctgacctggcaggcgcccaaccaggaaacgaacaagggaaactggaagcggccaagggatttgcagaaccttctgagcccactgcaaaagaccatgccatttccattctgaagacaaaaacgtgaagtccctgttcccaagaccccctacagaatccaagaaaaaacaaaaagggaacatcaaaatgaaagagagaattcttcatggatggatgtcacgaacgtgttttcagggaagaaccccaaatggcagtcagatggaggtggggcgagtgctgagctcacccaaagaggatgcccattctgagaactgtttcaggagaaagaagcgcaaaaggccggggcgctgcctgtcccaccctgccgccagtgctgtgtgtcttgggtggctctatcacaggtcagcaaatttttctgtacagggccaaagagtaagtagtttaggcatttctgtttgtttgtttgtttgtttgtctctctttgctttacaattctttgaaaatataaaacccattcttagctcaagggcctataaaaacaggcagggactgtaattccctgacctttgtcaggcaccatcaagccacaggtaccctcctgatgaaaggagtaagagtccctgacaggtggtcctctgcatggggcggggggcacctggaaagggagggcctgggaaatgcactcatctgggagggagtctttccattcccactggctgagtcctcagttaccgcagggctgtcgagagtctgagacagaggtctgccctacaacattgtgctgagaagtaacgaactgagctgtacactgacacatttgtgaagagggaagatctcatattgtgtgtgtgtgtgtgtgtgtgtgtttaaccacaatcttaaaaaagaaagaaacaacaattttaacaattttaagagactttctcctcataaaaaagattaaaaacaagtgtgggaagatctggtaattcccaatagcgatttccaaaaccaaactagaggaacgactaaaatagcgttaactgtccctcagtcctcatcaacacatcctatacattaatgtattaacgtcataacaacccacgcaggaggcaccattattatcccattttacagaggaagaaactgaggaatagaaagtttaagtaagttgctcaggttatacagctaggaagtggctgagctggggactgagccaaggtatttttggctccagagtttatgttatggaaggagcctctgtaagatttggacaaaagggattttataaatgtccagatcattagctactctatcagttttcccactgtgattagcaaacaccatagggaaggtgtgggagggaggaactgagccccgtgcccaagccaggcttgggtgggcagaatcctgtgtgaagctgttgaatgggaacagatttcaacgcagaaggaaagcaggctgactctctggcacctgcatcaggaaagaaaggtacaggtagagaagctgcctatgactttcgagtcactgtccctccccgccccatcatttctggggaccagtctgcgactcaagaactgatttcacctgtgagcagggtgacttctggaggcaggtggtagtttaggaagttgcgggtttttgtgaacatgtaggtctcatttggacatctctcctaggaaagctcatctcctaggattcataaatcccccagtcagggagcctccttacctcaaatcaggcctttgctcttatgccatgaaaccaaccatgcatttaagatgaaaacctagagcaaagtcatccattagaatttggccacttttaataaatgacttgttaacatttatttcgggcataccaagaaaagttttttaattaaaaagcaagtcaaggccgggcgcggtggctcacgcctgtaatcccagcactttgggaggccgaggcgggcggatcacgaggtcaggagatcgagaccatccgggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcgcgccactgcactccagcctgggtgacagagctagactccgtctcaaaaaaaaaaaaaaaaaaaaaaaaaagcaagtcaaatgtttcctcatataagaactgaagtacttttcttttgtcttttaaaattatcattattcttatagcaacttggatctaaaaaacaagtcatgctccttgatgtaatttaaatacaaatgtttaaagtgctttccccactctgactgcagtcaaaatgtcaagccttatatttcacatgtctctccaaactttcaccttgcttcatgccattactatatacacgagtttttccctacaaaatggaatcatattattctatatcttgtttttataaaatgtaagaatatatagtaggcattttccctaatcaatacatatagattgatttcattttataaaaatagttacgccatactgaatactaggtatgcactataattaattcaacaatcctcctgctgatgaacatctaggttgctagaaaattataacaacagggggcctctctgtcttgtccctgattggttttgggacaattatctattcatttggagaatgacaaactagttccttacttcatactaatgacaaaaataattccagatagattatagacctactagaagaaaatgcaaagaaacttttgcataatcttaaaataaaaaaaggccttcttaatgtagactaactagaatctaccaaggaaaaagaacctgccaggtttgatgacataaaaatgaaactttctgtgtgactgaaagaactatatgaagtcaggacacttcatatccagatttaatttttctaatatgcaaagaggtcattgaaaataatattaaaagataaaagaaaaatggagcacaaaacagacttcacagaagaggcaatacaaatggaacaattattatacaaactagccatggacatgcaaattttaaaaacaatgagctactgttgctctcaattgggcaatatttttagaaaactgatagcatctaggccagcccttcccaatcgtctgcacctgggaatcgcctggggaccttcaagtaactactgatccccagctaccaatttaattggtttggggtatggcctggggttctacatttttaaaagtttcctgagagagtctaatgtacagactttgaacattaataatttgggaataagtcccgtaatttggaaaccactagtgtacattaaaggagggtatgaggcaaaggaggttttcatctctggtgtgggtgggagtgtaaatcatcacgacttttttagaaagcaaacgggcagaatttattaaaatttactaaaagaagaatgtacataccttttgattcagtaattccactttgaacaatacatcttggagaaataaaagcagcactatcaaaagatacacatgcatatacacgcaagagtgtctactgcagccgtgattcctaacaaaccctggaagaaaccagtggttgaaaaagagatactgagatctctaactcagtgaggatgatggcacaggtaccaatatgtctgtgggacatcgttaagtgaaaaatgcaagttacagaataataagaatagatccaattcttaaaaatgtatatgttgtttgcataagaaaatcaaaaggcctagaaaggtaacataaaagcgggagatgatgtagagagagtagataggaaacttagttttctgtgaaacacaagaggatcttttgtaatcaaaataattgacttttttttaacaattagcctttaaaatagacacatacacagcgagaaagaaatgaggcttttcctaagatgtattaaaacttgaagtaacaaatatactatattattagttatagtacatacttatatatttgtattatttatatctattttattttgtttttatattatacaaatatatacatcattataataaattatactacatactgctataattaaaacagtaatggccaggtagatctaaccattgactagagttcagaataaaaatccagatttatatggaaaccaattgttcggtgaagccaatatattttgagttagtggaggaggatggggaagcttgctgttactgcttgctatcatggccaactggagagagttaaagggcccaaagatggagaaatccagtgcaggtggtagcttggaagcccagccctagggctgaatgtggtgcattcttaacaggtttccaggtaatattgattctttgagccacaggtgagccaaacccactctgaaagccatggctacttacatccctacagtgtccactcaacctgtaaatcccacaaggaggtgtggggcaaggggtggacatggcctccactgggttcctgccaataaatggggtttggggttggctgcctggaattgctgtcgaagttggcagctgcttggcagctttgctttctgagcccaacaacagctccaagaatgtgtccggcaggatttaagcctgagctgggaacgcacatctgtgaggctctgatgtgaatattcagcagggagatctggatttcttctcgattgcctgtagcatcaaatctgtgacgaggcttacccaggactttcttctcctgacataattgcggttttcaaattcagttatgttcccactcttgtattaggtaacaggttaagcaaattcatgagcctgatttatttttctgtgaccttcatattttagaaagattatatccaagtcccaaccggcttcctcagctccctagattaaatgttctcattgttcagcttgtgttacagcacatcaccctgcttctcattaatcattcccaactgtccagcccccttagcttccttcggctgcagaaggctgcaccttgttcatgcacttattcatctgagtgagggttctctcccaaatttaggcctgtctgtggtagcctccagtggattcttggtgcatattttaaaacttcaagggacaggttagtgagaagctgggaattgaagaataaaagtccttcgctttcagtttcattatctttgggtgactttaggtatgacaatcagccacagttaccccagggtactactaaatctaaaattgagatgaccacactcagaaaaacacctgtttcctgaattaacttctcagtgttatacctaagtgaaaaattgcctccatgcttataaaccactccacctgcctccatttctgcagatggacattcatactcttcaaaaacacatcccactgtaacataaactgggtgaccaagaagctaaaagcagaggaatttgctcatagaaaatagagatctaacagctttaatctccctttcctcccctaaattagatattgtttctattaaattcccttctagtttcctcatttgccttcatcccatttcaggacataactggtgctgggaaatatggattcttctctatgtcaaaggcccactggtgactgcttttaatgagtcattaaacaagaacccacccaaatgcccatcaatgatagactggataaagaaaatgtggcatgaatacaccatggaatactatgcagccataaaaaagaatgagttcttgtcctttgcagggacacggatgaagaccatcatcctcagcaaactaacacaggaacagaaaaccaaacaccacacgttttcactcataagtgggagacgaacaatgagaacacatagacacagggaagggagcaccacacactggggcctgtcaggggggtaggaggtaaggggtggggggcaaggggagggagagcattagggcaaatacctaatgcatgcagggcttaaaacctagatgatgggttgataggtgcagcaaaccaccatggcacatgtatacctgtgtaacaaacctgcacgttcagtacatgtatcccagaacctaaagtaaaataaaaaataaaaataaaacaaacaaacacaagaacttctgaggtcctccccgagaggactccccgagggagcttggagcagttcctgccacatagtgggcattcagtgaactacttgagagattaatgtctgttgctctccccaggcacttctggacctatctggtacacactcaggatatttcaatttctccacaatcccctgtgaaggtttggcgatggtgctggtgaattggttgcaccgaacaaggaacctgtccactgggctgctttcaggcagcccagaccagccctgggaggcccggcttttctggacacgattagctttcataaatcatctctctccactattctttgctttacgatcttttatgtggtttgtcaattaagttttgtagctataatgtcttaatatttggccctggggtgtaggctatcaatcaatctactctaacctgcatttttatagtaaatctcaggcctcggcatgttgaatttcccatctgggccttcagaagtcttctcttctcacttcttacaaaaacaagagaagctactgtgggtccattttccaggagggacattcctgctcctcagccatcatttcccaaaaaatcctttcatttctcccgggatttcttattaagttactacttttagattctaatgccttatttttccatgttagctatattggattctttgttcacttttctaatatttcccatttgcttgtgcaaatctccttaccaccatgttattaacccttcccttcccatccttcctggtcagtggatggtctctttatgcccttcctcacccagcactcacttgggacaccattccctctctccaggccacagcagggctcctgactgtcctcactgcagaaatggaagcttcttcagcagccatcagtgtccttttatctccttactattctttaaaccatcccacatcccttccatgaagctttttctctctgttgccagagcaaccgctgggtgcgggtgaggatgctcatggccccatacccatctccccatcatctgcgtctggcgtggcccttgctaaattggccaatcaatcatctggggaagagccacgacctcatgggttcaatgtttgcactcaccagggttccctacttcttcgaaggttctgttgtttaaatcttcaaaaatgtaatggaaatggatgttctacacccctttgggggtttcacagggttttgagaaaggcacagatggaatgtatgctaagatttttcttaattgaaaccaaatgtttttctcagcaacatttgccatttgattcttcagtgacgggagatgcctaggaggaagtcagttgacagtgatgtggagaagaaatgcttctgaagtctctttgcgcttgccttttccacgatgacactcttcattgtgtgggatttccataccccctgaagggcaaaactgctctggagggaggacttctccttccagatatcgggaggagtgacaggaaagtgagggaagagcgaggcctgaagagtgctccatctcagatgagggtgcagggcacccttcaacgccaatggccaccgctgctcacagcctctccagaagcgggaagatgggacactttaaccacgaggtggtcttctctataaaataacagtgggcggggggcgatccatcgtgttccctgtggaacacgatgggttcatgggccataagatacagacaatctgacggcaagaagccgagtagtagagagaagtcttaaatacagtgtgaaagtgatcaggaaatttttcaagaaggaggtggcttgtgagctgagtcctgtggggcaggcaaggaggaatgaagttaaggaagcagagggcagtgcttttcagcagttaggaggaataaagtctcctcaggcatctctttaaaatgccggctcccaggccccatcccagaggttgaactaggaggtctgaagcaagcccgggacttggaaaatctagcaaaccccaggaaccctagttgagatggactcagactacctgcattatggaaagcacagacggcagtttcaggcaaggtgaagggcctcagtttggtttaaatactcaatttagagcaggatttgtaaacttaaatacctctggggctagggtgacacagaccttgagagaagttgaaggtttacaagtacaaagaggagatactctctctctctcccccaattctggaagggacagcagccaacaagctccggcaattactgccatgcaggaatatgtgctccggactagggcaccagagctgtctaccagaagagaagccagagacctgagttttatgtgccccagaattattaaatgatacattaaaatgccacgagcatcacataattccatgaagtccactatagtaggcaagttcagaggagcaaaataaaatctcattgcatatggacttaaatgatagaagaaaactgtattttatccggtagacaatgaacaatagaaggctttgcagcaaagaaggaatctgaacagaagtgtgctttaagaagatttctgtggctgttgtctgctcgcaatggaatggagaagggacctcagatatcagctcctaggaagcctctcccatgtgcaaaaggaatggagaatagaggatgaaaggtttccggaaacaagaattcaggagatttgattgactatggaaggaagagaaaaaaaggaatcacctggggtcttctatgtctaaatccatgctgcctcttgccatccttttcctttaatatacactaatgttccagcttcattcattgcacagaaaaatgatcatttaggttgcattctgatcagtgcctgcttaataatgaaacttagagttatttgtttagggaaaaaaaagcacagacaaactattttataatatctataataaatgcaaagaaatcaatacaaacaaaacttggctttagcaaactgtacatacataaatatctttttttttttactataacattcaacttttttcacataaagccttccatgatcttatttattacatctagtttttctttatacctctaaaaaaaagtgccttttagatttacagcttgtgcttctaaagcaaaggttaaaacatcatgccccaaaggaaaacaaggtaaaaaggaagctgccatataagctcttaaaaattgtatgttacaaggttctaaaatctcttcagcactggttggttggtagattgtacgacactgacatggtgcttgggagggtcatttatctgatggttggagcagcaccatgggaaagctgcccagatggtctactgaagtccttggctgtgcacagaatgggccaagggcccagaattcatgagtccggggaactttggaggtccttactcaatctccttagtgctaaggttcagagtctcaaaccagatttcttccaaaccttcttgttgtctgtttgttcccccgtcactgtttatcttccacctctgaagccataatttgcacacatgtgatctggaggagggctaaagctgccacaccgagggctttcgccaagatcaaggtcctcttgt

SEQ ID NO: 1 - DNA, 2725892 bp, Homo sapiens (residues 1,362,947-2,725,892 of 2,725,892)
tggtagtttgggattgcttatgacccgatcctccttatgctaccagcacttctgcagatggcatctgcttagttcagagtggaggagggccattcgtgtatctgagcatggggtggaatgaccgggcaaagttgttggagagggcacagctgtagtcttcctctgacattggtacaaggcaggcaagcccgatgaggaggagcaggagaagctgaaggggaagagctgctcggaggactctgaacaggaagccgcggccggaccgacctggccctggctcagaaagggaggaatcggagccaccttttgtggacctgagagaagaatggacataaattactcagataactccagtgtcggagggacgctgctttttgcctctgcaccttcctggaagctaaagggccatgccaagcacaccccagcctggcgatcagctgccagccttccacagtgtgcccaggtcaccccccaccatcaaatgaggttgttggaaactgcactgacaagaaataaacatttagtcagtcaactaaacgtaagtaattaggttcaaattctactccttttaccccttaatgtggtgaaacattttctatcaacgaaaataactgctctatacacattctactagcatgaattaagtagatccagaataattaaaatgtagatatttgatgcagcatatttttgttttaagaatatcatgaacattgttaagcaaaattagttgctgtcagaatcataccaagtatcccatctagccatcctggatatgccaaaatccatgcagcaaaaataaaaacagtctttgtcattttgcacagacccataaaagcttcattaatcatagagcataccctggtttcatcttgcactgaatcagcatcaggccctgacattagcgggttccaaagctgtacgaacaaggaatagcagtggagtctgtctacagaacactggtgttgtatgatgtagatgctaggctgatcctatcactgacgtcattactttggaaaatggacaccattttctgaggaggatggactgtcatcctacagccccttctacactcaaagtgacaagtttttctatttcacttttatcttccttttaaacagtgcattagagattgagtacaggtttcagaactcttaagaaggactgcctggaaaatacagaatctggaagtagattctgagttgggtgctactgttttctttttgtgaacagccattacctttttttggttactagcagaaaagatgaagaaagaaatgttgtttacgacaggcatttggtgtacactcagacccatacaacattgaatgaacaaaaataaaagatgtagccaaaagaaacactccctcacaactagtataaattccttaagagttttaatatcaccaaggataaggacattgtatgtgaggctactgaaataatatgagcgtgtgaaagctgtattggtaactgtaggtttggtccagaagaaagcactatgtttgtagctcacctattacctattaatttctgaagacagactaccctaatatcggtgggggatgcggagtgacacctaagaaaataaatgttaaaaacagatagaatccccttagaagggaacagagggagtattcaaaactcttttattaaaccatcaaagaaaaatgggagagggctgggcacagtggctcccgcctgtaatcccagcgctttgggaggctgaggttggcggatcacttgaggccaggagttcaagccagcctggccaacatggtaaaaatacaaaaattagtcaggcctggtggcgtgtgcctgtagtcccagtcacttgggaggctgaggcaggagaatcgcttgaacccgggaggcggaggctgcagtgagccatgatcggaacaccactgcactccatcctgggcaacagagcgagactctatctcaaaaacagatattggttctgcagaaaccccaagaaacaggcagcacgcagtgtttctatacacttcttgtggtgtaaggaaaaatcaaatcactggtttaaattggaagcatgttcttttctgaaatccacacaagtaacggcagggtaatgtaaccttgaacaactcacttcatctctaggtgtcaacctcttcactaacctcttcaaattagcatagatggtcttctaactttaaagtttactgttcgatgtttttgtcttctactgatttgtcagtataaataatctcccaagaagccacaagagctcaatcaccatctagtggtcaaactgattaactgcccttgtgctaagaccaatgagttattcctaataagctgagggaaaaaaaaagtatattttgtgaaaatatagtagaacataaaagaagtatgtcatataccttattaatggaaaaggaaaatagaaacttcttgagttacctgagcataaaatattcatgttgagacagggccttagagagcatccagttcatctcctaattttgtaggggagtagctaaggacagttcatgtttactcttctaattgctaggcagcactctgagcatttatgttgggttctgtcatttaatccccacagcagtcctctgcggtgtgtacttattaacttcattttacagatgatgtgaaagaaagctcagggaagtgaaataactggctcaagctcacacagccagtggcagaagatttcaaccctgtgattttaactaccagaacctggagactctagacaggctgaatgacttgcttcagattctacagttaaaggaagaggcctagcagggactcaggcttccaaaatccctgcccaccgcactctctgctgtgaaatgttttgctggttggtgataggaataatggtaatggtaattcaggtcgtattcatttcacaggtatctcacatgtagaagcaaagaagagaatcctgaacttgcatcctaaaatatttggaaacaagtggtttcctcgtgtctaaagcctctggtcataaggcctcacagtatcctgcagatcatcaaatccgtgtgtggacgtggggacattttgttttgaggcagttacatgaccatgggcaagtaaattagtctctctggccttcagttttctcatttgcaatgattcaatggtttgccttaaagtgtcttaagaaggataggatagctacccacaaactttggatcaaattttcttcaaaacatccttcccctgactttaaaatatgccctggcaaccaacactcaacacctgtagctagatgagttataacagagtgactgaagagagctcccacaattcctagttattaaatacctgactaattttcattaggagacatttaagaactttagtgatgggaagatttacatatataattgatagtacaatctgacagagctgaatagctcctgtttgtcaactgttaaattctttgtgcaattaggtcaaagatcaagatcaaaacaagggctgcccattgacctgttcactcctgagaaaaatggcaaaccattgaatcataaatcatgacagccaaaataattttaggatattaatgcacccctcatctttgcaaatgagaaaactgaaggccagagagactaatttacttgcccatttttgataaaaatgtcaccatttacagaatgtggactcctatgttggagtctgttgaaggacatggcacatttaacagcatcagagcattttttattaaaatttaatttgtgcatgacttctaatgctgaagaacgccaagctaggaagaagtcatgggctgagatggggacagagagaacacacaatattcagtgactgtccgtgcagctggctgcccttgaaaatatccgaactatccactgggaaaatgcctgtccccttggggtaattaccagagtttcaacatgcccaaagctgcctcatcttcagggggaacttgttctagcgattttagtatcaagaagctaatggtcccagggaaagggttatttttaatatttagctactgtgctaaaaatcacctaagtttctagagtcttgggaaatttcataagggaaagaacaaaggcaacttgttgactacccactggtcattctcctctggtcttattacatacatggatgccagtttagattgtgtttatataggaaaaattaaatgtgtgagcctccttaaggaacatcatcaatacagatatatcagatagttctgtccagcaaaaaacgtgcttatttgctacaagtaaatttttatttatttttctcacttccctcactccttcaaatttccaggtaaatagctgcccaggagttgcttcatctctgtcccaaaatacctagacaattgcgggataaggagaatggcagggagggagtagtggctaaaatcacacccttcaaaagaaagtgtgtaggacacacaattgtgagaagtctgaatgccatgcacatagggtatgactcactttgaaaattgtttataatcaaggaaatgaaaatgagttaatttcgtgcatgcatcatttaaagccaaatgagaagaaacttctaatttattttgttacttttcggctaacactggcagtatgtaacagatttattttgcagaaacatctagattgtccgtgatcttgatcctgcccttatgtgtcttgtctttgaaacccagtgtttcctggatatatggttcaggagacaagtttccagaatcaagttaggacccaggtcttctttttttccaaaccaaacattcttgctaatcctaaactacctgaggcagcctgtggtggcctcagctctaaaaccattgtttaaaggcttctacccatcaatggcccttcagcagagtggtacggttaacggggtagggtctggagtcaggggagacctgggttcaaatcctacatctttacacctctaatccccagtgtccttgtctataaattgggaatatagccatgtcatgggattcttgtgagggttaaatgaggtaaaacacatacaatgcttagcatgtatacaattaagcactaaataattgaaacacattaagtactaaatgaatgtcagcagcttatcactattatctgtataatgataccaagggtgtgccgactcatacccttaggggttggctggattcggccttttctctcgggaaaacatacctgatttattaatagtgctttcaagcatgtgataaatttctcaaactgcctgtcttgttccctagaaacaccaggaaggcctacctcaaatagcaacagagaaacctatcggagccttaccctacagctttccttggggcacgggtgagcaatctgccttagaggggagaggctctgtgctgaggctctttgaatgctttgaataaatagatccccagataatgaaaagacttcaaaacaaattctacaagaaactgagtagtgtttatagtgaggccctagtgtacatgcaaaaaacccccactgcccttgcttaaatgtatctgattaacttgaatacatttttaaatgagggcttttttccctctttcagtgtttcggccagtcatttgccacttctcattccatcttagttctctgtaaagaaggtgccagagacctaaggtgcccaaggcaattttgcattttacaattctaagctttagaatgaagtcatcaatttgctacatccggactacagtgcaattattcctttgccttgctggaaattggagtgaaatctttctagctgtcaatttcaactcagttgcagtagtgttttgaagaattaatggcgataaggttagaaaattttaagtcaaacgtagggaaaaagtaccagctagaccatcataagcatttgctttgaaagcatgcttctaaagtgtgtttaacctcaaataacagtcacaaatatggttattatgaatgtatgcacagatttttatgtttctaattttaagaagttctagggagctccctgtaacgatttagggaatctctagattctgatatactgcaagtcttttaatggtaggaatcacattgaattaattttgtaggcccagggcctaaatttagtaggtgttcagtacctattggcatcaattcatatgtaggtttaaaatactgtatgaagatacagaatcaccaccatcaaatcaaattgaaatatgtaacaggctagtataatattaacatctgactttaaacaacaacaaagaaaccaaatgagtaactcctcccttcaaactaatagtcagtttcttccaactcagtctctttctcctctcaggaagaatgcgtatctaaaaatttcccattgcagactgctggaaacaacattctaaactatttatgcttctgcaataacctttccaatttgctggaccagtgcaagattaaacacgagatatctcaagtctcaatgtaaaggaacaccacgacagcctggactgtgggtgaagttcattcttccccagcagactctgcctttcattctcggggttgggtgtgccccaaacagaggtaccgacggtaacgaagcccaagaatgttcaaccacaacctgtctgtgaaggtgttggatgacgtttgccattcaggtgaagattatttatgttccagtcccacctgagtagcaaagtgaacactgtgctgaatgctcagaaagatgttaatgaaccgtgctggacagagcagagctgaaaggcgccttgcgagtgtcgtagtgagaatgtggctgtcccagctgcaaagccctgttaggaggcatgaggaagcacttgctgccctaagaaacgatgccttcgacattttcaaaagatctatgtggctgtctgaaacaatgcggagagcagatagacgcaatatttgggaaccaaagagtgactgctgttggcgttgcatcataacataagcgctttcccccttctcgtcactatcatttgtatcaaccaaagaactgatctctggtatcctcgaaggaatgctgtggggatattcttcatctctgttcatggtacatcagcaatttgtggggaaaagatggactatataacacaatgatctgcctaaaagaaactgtctctacttatagggggctgagcaaaccttagagcatctgcggatgctcgtcattatcttcaaaagtccccaagagtttttctccatactttattattgctattttgtttaggctagaaaaaaaaaaactcataaaattgtcttcaaaccaaaccaaaggaaatgaaaagaaaaaaaaaaacagtacagggaggtctaaaaccagagaacatatgaaaatacgttctgcctgacttcagccgagtgggaaggaccaaatgaaatagccagtcccttatgtacagctggaaaactaaaattattactcaagggttgtttacagttctacatttcctcatccccaccctccttccaggaattcagattcctgctcagtggtgataagtttccagagggacaagctactttaacagtgaattgctagggactggaatgaaaacaggctccgaggacagtgttttcattttttagaaagctgtctggggaaacttgaactgatcagtggaggagcagaggagcacagacaccacaccgacaacaaagaaggcaaagcactgctaactgcgggagtgaggggctgctggaggccaggcaggaagcgcggagtggcagctgtgagtcggctctcgggaggtgactgggcaggggcactggctgctgcgggttccagagtgagcttgccaagtgcccggaaagtgagtggctgggtgtgctggatgaagggaagttttaggataagcagaagagagaaggtacttataaatttccaatgaacaccaaattaggacttgccattttgagactccaaaacccacaatctggataaaacatgaaaataaaataaaaagttggggatgttagtatattttattcagatatgcgggttttgtgaatggtaaaagaattcactgatcgattacctgtcttattgtaaactctagaaataaagaggatgataaaagtctgccatgaatcaaatggcagtggtgccaccaattgtaatcaaatccttattgacaatttgatgaaaagtaccagatgggctatgttgagacaaacagaattttcacggagtccaaatattttatgctctgaaatttacttgaacatttcattcagaaacttctcttccaatgtatgaggaaagggtgtggactgaaatgagtaatttcccaactaccctgaggcagaccagatataggtcaacctaagtcatggacaattttcatcatcctcttggggttctagaacagtgtggaaaccaggagaaggaggtacctgctatgtggactgctgacagagggtccaggctgtgagagactacacttgcctcgtggctgtttgcaatgaacagggggtaaagaaagaagaatgttcagtccaggcaaataaagacaagctactaatgaaaattaaactaaaagtgcagcaaaggaaaaataaatcaaatgaaatgatcagtacccatgaattaaggaaactggcttttcttttgttgaagaagtaaaataaatttatatctatgtgattagccactgataaaacattaagttgggattctggagtccatactatggtgggcataattctcatggcttttcatggtagaaacacatgtgtatatttacatacaataaatgtaaaatgcactatgccatatcacatatttcaaagacacttaatatattttttttcatcttttagaatagtaaaacagtgttaaaattcttggcccataagaaataacaatggcaatatgagattggtctttgtagtgatgaagcccaacttaaatattcaacttaaagaaaggttaaaatttgacttgaaaagccagtattccttcacattcttaaactaggatctataggaaactagtgaatgtagtaaaaaaaaaaaaaaaatcctaaaaaagataatacatttatcagcatagaacataaatgtttataacaaaaaagtcaaatgaaatcaaaacttctaaaaactaaggaaaaatggaatgaatataatcataaagctggacaaaaaatatataacaaaacaaaaaacaagcttctaattacacagagaaatcaaggcatagagggtagcaggggccgaatttgtcctttcatcctctttgtgttcagtgaggcagcccccgccaaggcctgtgggtgagttgttgccattttaggggtggcacaactgccgcaaaccttcaggaccaccacccagaagcggcttagcttgagagtcaacagaacctccacttgccttaacgagtcaatggctcacaggcgttcacggttctgtgcacctccagccgaggcgccccgcaagtggaggcctaccttttaagatagtcgtggcagccatggcttgaagaaaggagccaccaaagggacaaatgggcaccattctggaaattttcttatttgagcaagaaaaataaatgttctccctgcataccagccacacgttgagtcctgattcttttgaaaaccagaatcgctcttttccattcctgagcgcgtgctgggaggggatgtggcagggctgaggaagcgcgctaccctgtgtgacagccctcctctggaggggacgcctgcctgtgaaccctgtggtgggtgcaaatactgtcacttcccagtgttcactcccatgggccaactgaaaacgaccagtggaaagttaccgttttctgtctgtttggggtgctccttcctgatgtgggactcacagaccctgaggtgtccagttcatcagcagaagaccaggaagacaaatcctatgtgggagaaagattcttttaacaactccatgtcccagacccatgggggccctctgttgcaccacgttatctcccactccatctccatccacccccatgtctccaccataaaaatcaaaccattccttggggaaaatggaaccagacaggtacaagaatagggccaaattcttctagtgtgttgggatttcctagctgtccgtttggccgttctggaaaatatagctatgattttgttattgctatgtttcacttatagctttattatttcttggagacatggatatgaatgaattgatattggcttgggaggggaagacacctgctgtagagcctgctggtcactcaggctgaacagaagtcaatacattccagttggaaacaaaagatagtcatctaggagtctgcctttttgcattagaggactttactatttcagacactgctgctattcagagtagattgttcttttgcatgcttacagcagggcaaagcatgtgttcatggcaggatttcacagcagaatggttgaaatcttaccaggcatcaccacatctcacctgcaaatgcatttctcaaaaccaataataccacaatggagttgattgtagaaaaaaaaatataaaaaattaaatgagcagaggactgttttttaatttttttttttttttctgtatacataatggagaattcatgcctgagagtggttaaatacaaaactcagatacaacaattggtttgctctaccatggctgtgtaattaaagtgtgtaaattcttaaacagggtgaaataaaatgccacagcagttgtggtaatagcattagtagcaacaacaagagagcttttggatttaacagaatcaaaagcagtgtcctgttgtaaaagtttatgtggctgcttttttattttgagacaggacttgtaagagcagtggctgaaaggagacactccattctgacaagtactatatttaaagtctttctaaaatgcatgaagatgatgcttctttggtctccagtaagaaatgctacacgatgatgtctgtttattgcttacctgctgactacttgacacgtctaataacttctccagttccttgatatgacgactgacctccttcaagagaagtttgagccgatttccaataacatggactttttctttggcttctaaacagtctgttccttcagcattcaccagtagttggcaagacatgtcttgcaaagaggctactctgagttgggattccaacagctcatgctttatttgctatgcatacaaaaacaaattaatttttctaagcatttttgataattggcaaaagctccaaaagtgcagaatgcaatcaacttaacttggtgggaaattatacctgagcatcaaacgtggagctcacacactaaaggatgcagcagctcacggcctgagttctaatcctgcctctgccaaaaatattctataagacccctgaccgtctctgatctcagtttgatttgatgcctggtccacagtattattggaaggttcaaattagttaatgtatatatgacagtaattaaaatatagattagtatgcaagtgagatgtaagataatcttttaaacagaaaagcacaacattaaatatagcgaagcagaagtatgtctaggtatcctctgatatctagtcaagatttgaaaaaaaaaaggggtgattcgtcattcacagcttgatgccagaggtcaaagtgaagtaaaaatgcagttccacagctatttcctctaggtttctaagactattatggtactgaattaaaaggtaccaattctgtagtttaggtgagtgttaaatgttaagacataacattttaaaaatacagagagctacaaagtgcataatattttcttctaatggaactcaaatatgcttccttatcttctataaagtcacttaaatatactgtacattatattgtccaaagatccttgtataagagtctaccagttaatttcctcttgaatttagtgctagaaaaagtttctccttccttgagaagtggtatgttttgtttttgccagataatgaaagtaagtttactccttgtttcccattttgtcttggctttcagaaaacttgatgctcaggttcatgtttaatctgatgtatttaattcctctttgaaagactcggctgggtgtggtggctcatgcctgtaatcccagcactttgggaggctgaggcaggtggatcacctgcggccaggagttcgagaccagcctggccaacatggtgaaaccctgtctctactaaaaatacaaacattagtgaggcgtggtggcttacacctgtagtcccacctactcgggagggtgaggcaggagaattggcaggagaattgctcgaatcccggaggcggagattgcagtgagccgagatcgcaccactgcactccaccctgggcaacagagtgagactctgtctcaaaaaacaacgacaacaaaaacaaacaaaagacttaattgtctcattctattctaatattttaatgaccttttactacaagccaccaaatatacttttgggccatagatgtaacatgaagtttaaattaagctgccttaataaacaacacaagctaattaagattgcttgagaacactaagatttttacaactgagcaacaactttagaatcagattctaaagctagcagatatcatcttctatgcacatgtttgctttacaaagattggaaaccacagggagttaaaaaagtgtaaagtagagactataatgcaaaaagttaaaaaaaaagaaacaacacttaccacttatattcattttctgtaaatgaaatgcaaccctgctaaaaataactggaggctgccagagttcacacatcttaccataagctgtttgtgatggtcctgaagtatctctgcatcaaggttagaatcaatagggacaatttcatttttccttctgtcaatgttctccagcataagaagcaaaccatggctcatttcatggaaaccctacagaaaacagtttaaagtaactgtaaataaaatatttttatttctctcaaaacttaaatgtctttcaactgccaccattagcaaacatacttggttttaagaacatacatgcaactcctttctgaggaaggcactggtgctgttgtaatgacctgatcgtgagttcacgttcttaccaaaagcatctaatttattacttggaggacaatttagacgaaaggaaaactggcatcaacatacgttatttctgaaaaaagggtagtgctattatacagtttggaaggaagcaactctgctgccctctcttctctgtgtagtcaaatctttccatattttaaggcccacctaggctgaatctcatatccccttcattcattcatttattcactcattcattcatccatttatttattcaacatacagttactaaagatctcctacagataaggcactgtactaggagtgggtgcagaggtgaaacagcagtttaggtacccgctttcaaggaactattatattactcttggggcacatataaacctggagagcaggcttcaactccttccagggctttccatggcgctcagaatatgatccaatctcctggcctggacctacaaagccatctggttcctgaccacctcctcagtctttcttctcactccctggctcagctcaccgactacactctggtcacaatggcctgttttctgttcctaaagacactaagtcctttcctgcttctgggactttccatttattatattaccttcatagcaacatccttccaatgttagctcaaagagccaaataaattccctgactaccctctcaaagtggcttttctcagttacttttatcatccacgtctgcaagtatctggtttaactatttgcttgcattttattgatcttgtcttccccaacaaaagcagaggccatgctgtattcaatgttttagcaccacgtctgccatatggtggacgcccagcaagtaattacagtatgaatggaaaaacaaatatttgcaatgctcactttgatgttcaagaagggtctgcctacttgcccagtaaatatctgttgaataaataaaggaaataaatgaatgagtcatagaaggagcgttgcgacggagataaacatgaggaatagtctcttcttatctggacagaagataggacctagagattttgaacatgatcatgaacatgtagaaatgctccagtaaaatgaaaagtttgggcacaaggttatctcactgaaatactgactttggggagcaactgcgtccctctagaaaccatgatacatcaagtcacacactcagctaaattgctaatgtctctctctgagtcacctcctgcccaaagctctacagacctggcactgcatcagggcatcctgcagcaggccccgccactcctccagcagagagcacactcggtcccagcgcccattcatctgcgacaagcgatcctgcaggtcccggctctccttgctgtcagcctgggtgaactcagggctgcagagattgatggagaggatgatggctttgcggtggtccacagctttctggagctcctgaaaagaacaaaaaagacaatcaaacaaggacaataatgacaaagatattttcccttgaaaatgtttcacatgaatgaaaagatccattaatttaaactggccttaacaggatggctaggtaaaagacagagggtgcgtaccactgagaactgtatggcagttggaagaaatgaattagatgagtacttaacaacatggatgaatcttaagaaaacagggtgtagagtgaaaacgtcagaaacagaatgttacatggaacacaacagcctcaatacattcacacacacaaatccacatttttaaagaatatatctgaacaaagaaggtctgccacatatttcagaatagctaccattttgaaaatcaaatgggaacttagagttcagccagggtagggggtgcaggggggaggaataaagaggagtcttgtaggaggcaacaataacgctaggcaatgacctcattaaggagtatgattgagtccacactctgtacagaggttcaaccacaacaaaattcaaatttgtgggcctaaaaatgaagcaaagaaaacagatgccagggccctgggatccagatgtactgagtctgcaggctcagtggcccacaggctgagaatactgcctgtgccacactgatgtgaaggtagagagaatgaattgggtatttcatgagctaaccagttaggtttgatttcacaaaaaccaggtgactgatttttggctttgtgcatttccaaaacacccagtgctcaattccaagaacttgagcacaggagtctgtattagtaattgagtatctaggtactgtttaaaatcccccaatccagttagggtgagagatcctggaagtcacattgacctaggctgcattttgaaatcatttctcactagccctgcaatgttcccaatctgtcttgattttgcacttttcaataggttcttaacatactgtagaatagattcaaccacacagacaacatgggtttaagagacactgtggaaaatacttgattattccacagatttattcagagaaaatacagacaggaagcatcaggagaaagtacaaaggaggatgtcttttttcttgtcatgccggatgactttcaaggtcttatttccctaccctaatctctctgaggtctcagaccctggccagcatttgcttcatcaactttttaaggaatctggttataatgcaacatggccttactagagtaatttagggactctagataaaaatgcatttcataatgcagccattgtaaatctctctcacgtggtactttgtcctgaaattcatggggtagtgtagaggcctttctatagggatgcaccttttggatcacctggaggggagattcatttctcttgtttgaagttttctgtttgaaaatttaaaacagaccaggcgcaatggctcatgcttgtaatcccagcaatttgggaggccgaggcgggcggatcacttgaggtcaggaattcgagaccagcctggccaacatggcaaaaccctgtctctactaaaaatacaataaatagccgggcatggtggtgcatgcctgtagtcccagctactcaggaggccgaggcaggagaaacgcttgaacacaggagacggaggttacagtgagccaagatcgcaccactgcactctagcctgggtgatagagtgagactctgtctcaaaaataaataaataaataaataaataaataaataaataaataaataaaataaaacaaaatcacacaatcactaaaagcaagccaaaaaacatcaaccccaaataaaaagcatatactaaaaccacagaaacacaaaagcagcacacacttcattccttatcctgaccccggagagcctaggtggccacattttgaggaggagcacatcttaatactgtccaaacaggaaaaaacaagcactgatgggttttaaaaagaaactgagctctcagttcatgagatgctcacaatagtctccatatattaaagcattttagtgtctgggttaaggaggattttaagatctagagctggagttaaggtgtactatatccatgcgggccaagccaaaatcaaacgcaaatgccaggtgtttcaccacaattactctatagttttatttattacagcaaaaattgcttctaccactactgtaatcaatttcagaagtttcacttacttgaggtcaaataacttcattatgtcccccacaaattcatgcagatacaattttggagaggatttctctccagctctagatataggcctgtaggagccaggtcattctgtatttcccttacaaagagttcttgtaggtcccagaagtacctggatgcttcatgaaattttaattggacatttcttaaaatatcaattcattaaatcgtgtgtgcttatttacatggtgtatagttctacaatatggtccccttttctgcccttgaaaaccatctttgtggccgggcacggtggctcatgcctgtaatcccaacactttgggaggctgaggtgggtggatcacctggggttaggagttcgagaccagcctgggcaacacggcaaaaccccatctctactaaaaatacaaaaactagccaggcatggtggtgcgtgcctgtaatcccagctactagtggggctgaggcaggaggatggcttaaacctgggaggcagaggttgcactgagctgagatcatgccactgcactccagcctgggcaacggagtgagactccatcaaaaaaaaaaaaaagaaaggaaggaaggaagggagggaggggggagagaggaaggaaggaaggaaagaaggagaaagaaagaaaaaaaagaaggaaggaaggaatgagagagaaagaaagaaaaagaaagagaaaaagaaaagaaagaaaaagaaagaaagaaagaaagaaagaaagaaagaaaagaaaaaaaagaaaaccatctttgtggaatacaggaatttgggatggctggaggtgaggagagcattctcactcatttttgttagatcccttttctgctgctgtgtaagagcagctcgaactagaggtgccatctgcacggtcgttcacgcggtggctctctgtttgtccgccgtgggaaaggcaaggggcagctaccttgagctttttgatctggagctcgatggtctggatgtcagtgctgagttccagacgctggagctgttccaactcctcctccgtgtcccccagccaggcccagatgctgttcaagtctgagttaaactgctgccacttctggaggttctgcttcatcctcaactccttgctcaatgcctgggcctggagaagctcccatcggtcaatcacacctggcaagacatgcatagaacagtgaggttattttcctctacatgtgatgtttatgaaatgctttaaacataggttggcagccaattttaaatagcaacagaaagaaaagtaattccactgggcattttcgttgttgtcatctggaaataacagttacatgggtacaatggctgtgttttttctatttgtatttctaataataatgaagcaaaaaagttagttacatgggcattcacactgtaaagagctttacgaagtaataagcagtcatgagcacgaacgatcgttcaattcttggatcctgtctacaatagggctctgagcacacacatataaaatgcctgattagatatgtgagaaacagtgcattaaaataattggaacatgagagctggggtggtagtgcgcgcctgtaatcccagctactcgaggggaggcgggaggattacttgagcccaggagttggagtctagtttgggcaacacagcgagacttcatctcaatattaaaaataataataataaatgaaacatgggcaaacactaccatgatggcatgcatcatcccctcactgtcaaaggagactgttggccaggtgtggtggctcacgcctgtaatcccagcactttgggaggccgaggcgggtggatcacgaggtcaggagatggagaccatcctggctaacacggtgaaaccccacctctactaaaaatacaaaaaaatttagctgggcgtggtggcgggcgcctgtagtcccagctactcgggaggctgaggcgggagaatgccatgaacctgggaggcggaacttgcagtgagccgagatagcgccactgcactccagcctgggcgacagagcgccactccgcctcaaaaaacaaacaaacaacaaaaaaggagactgttataacttggaaggaagttctcaggatagaacggtgtagaagaaggccaagccccctaagtggaatttcgctgttaacaaagtgcttcaggatcttctatttcattcactcttgaactggatgctacgcactcaccagccgtttgggtttcggtactatgcaggttaacaaagccaggaaggctctcctcttcctccttcagtttgtgctccagtctcttcacggagtctatactgctactgcattcgcccagcagtttcatctgtttagacataaacaaccggcccctgtcacccaaatcttcatgagtgcaaaagcttccggggaaaatctctttgtaatttctcagcaagagaagtgtctgtgtttggctcctctgtgccaccctgctaaaaataagccaagatggccgagtgtggtgtctcaggcctgtgatcccagcactttgggaggccgaggaagatggattgtttgaactcaggagtttgagaccaggctggggaacatggcaaaactctgtctctacaaaatatacaagaaatttagctgggcatggtggcatgcatctgtagtctcagctacctgggaggctgaggtggatcacctgagctcagagggtggaggctacagtgaaccataattgtgttactgcactccagcctatgcgacagagtgagacccagtctcaaaaaaaagaaaaaagaaaaaataagcagaggtaggctgggcacggtggctcctgcctctaatcccagcactttgggggccgaggtgggaggatcagttgagcctaggagtttgagaccagcctgggcaacatagcaagaccctgtctctataaaatattttaaaaatgagccaggcgtggtggtgagcacctgtagtctcagctgttcagggcactaaggtgagaaggttgcttgagcccaggaattcagctgcatgcagcgagctaagaccatgacaccgcactcaagcctgggtgacagagtgtgagaccctgtctcttaaaaaaaaaaaattaaataagcaaagttcaaaaacatgccttttaaacaggtgatacattcacatatacaaaaaacaatgccttaaagatatactttgcatacatgattttgcacgagaagtccttcaagtttctttacgattcatgactcaaaacagattaaaccaatctgcaatttaaaactcggagccctcagctggcaatgcagtatataatttttggcaagctgctccctctttctctttcttaaattgaaatgtgggaacgttaatgttacgacaaatctcatgggaactttcttgcattaaataattaaaatacttaaaattatagagcaatattaaagccagctgttttataaaaaaaatgtaagcaatgtttaataggcatcaagggactaaattctaaagtcaaagaaaagcttccaaattcatttttaatatcacatacagtattcaaagattaaaagaacaaatcatttcaagatactcctgctgtgcttaccataaatcctttaacaaatcacaatgccagtaggactgttattctgattacttttgattgaggttaagtgtaatcccagtgatgtcagtatgattaccataaaactatatcataggtatttttaaaaagtggtttcactataatagaagttggtataataggccaaactgaacaggaaacaaactcataattgaccgctcttctgtaattataaggataataaaatcaacatatatagctagaacagttttctttcctaatttcaaagagtagaacatgtgagttgtgaccagacttggggaaattcatttttctttccttgtactaaccagtcttttggatatgaaagaagacgtgaggcagagaagagactggctttaaaattctcttccttaagtacgcgtaggaaagcaggtagttctctagggaaaattaactggtcagtaactcgagtagggcaaataaccctctgctagactttatcatacatagccaatagccgcatagatagaactggtagtatatccaatgccttgctatcttttccccaaatccctcttgctagaactgttttcttcagaatgagcacactaaaaaacagaagagaaaaacattcccaaggtcattcggtgaacccaggaaaagaactaccaaaaaaactgcatgttagtaatctattagctaaaatctgctgctccaaggataaccttggtccaaaaattattagttgaatttggaaaaatgcctaatgacttttgggagccaaagtattttgttgctctcaatgaaaaggatctccctaagtgctcagtgtaaaggaacaggtttgtcattacaacagttttgtgggcctaaaaacagacaagttctactcaaatggtaacttaataacagggcttggctttgcacatccaggttcacgagttcaagggcagcatggtattcagagaccacataaagccctgatgctgcagacgaactgttctttgacacagaactgtggtttcgcacaggtcggaatcaggatggccaggatacttacgtagcctttgtagctggtgtctagctccggccccgtgggagttttgctgcgaatgatattttcggtttgctgtatctgaaaacggctatcatccagggctttgcccagttgtcggatctgtgactctagggcactgtggtcccctgcggtggcaaccataagaatctttactggacaaactatttgacttatttaaagcttgatattcaaggagaagtttcagaaatgatttcagttacagcagcatagaaatggcaggtgtgggtaattacaaagcaaatttagtaccatcgtgccggtgggttagacattaaaatggccaaaccaatgaaggtgcttgactgagagccctagcagatcggacgtcgcaaaacggctctccagtccgttttgaacagcttcgtgcacctgaccctcttccagctgaacccctgatcatctgaatgttgtcagtgtggaaggcctttctaaaaatctgcaatggtgtctactgcatctcagtaaggagaaagctgttctttttctcatgttctttctgctatcgcttagtgagcaggggaagatcctccctctgatttttcttcatgcacctcaggggaagatagtgtcacggaaggctcaggttgctgcatcatttactgaaggcataaattcattaatcaagaaaagagtgcctcagaatagatatatacagagatatcaaactagcaacgacttgctttttatctaagatctgaaacaaaaccaggagaaagctaagattttaacatttccatctaggcaggttcttactcatagcctagaattctggctcattctcctctcaaagttgtaacatttctttgtaaaattactgagagtgtgtgtgtgtgtgtgtgtgtgtgtcaaagtcttcgaactacacaggaacatttgatcatcagtgaagctagcatggggtgaaagcagaacaaatattagtaagctttattaaatgtttttatttgtttctaaaaaaggccttctagatacacctaggagaggtccctccctgggaatcaccctctcagtaatgttactttgctttctgtccttttgattttcttcaaaaactgaagcgtaaactagtaactccgtgattcaatatcatatcactgcgttcaaactctattccccgccgacatcccacatcactgatcctgaactcctgcactacagtttgtctaacacaacactaagcaaaactagttccatttttctttctttaattcttcttgtttcaggaatagttctgttcttatctatggctcagcataccgtgaaatacatttttcatttcaaattatcttttacgacctcttaaattaaaattacatatattttttagagctgaaatctgatctcaccccttgtctcatacgggattcttgagatgaggaggataaagtggtggatgggccaaaggtcactcatgcaggctggcggacttgggaccagagcctgcaccctgagtctccagccacaggtaggtctgcatgcagtgaagctgaaattaccacaccacgtagaacactagggcgcagaggctgatgactgggttttccttctcatattttctgcagttaatggacatgagaggtctatacctaatgagaccaatcaccatttaacaagttgagaagttactttatttcgctcaattagtgaaatcttattcttggtgtggatttaaccagctgttttttctagtacagcagtaagagaggaaggctgtgccttaacatgctagagccacaaagctgggagagagacagcagatgtgctaagagaggaggattgctatacaggggagggagggaggctggctccggcttgttgtgcctaccggaggtatttttgattgcattttctgtgagttttacataggcctcagggctttcggggatcattacatctgcaaaaaaagcacagtctaagttgacagctaagttctggaaaccctgaatcccttgtgcaggaaaataactttcctaggggaaaaaaaggaagtcagttattctagacacatagctcctgagcgcacagaggagcgtgcaggctcaccaaagctttcctgaaatgaatcataagaattcacagtgggtggggcatggtggctcacgcctgtaatcccagcactttgggaggccaaggcgggtggatcacctgaggtcaggaattcgagaccagcctggccgacatggtggaaccccatctctactaaaaatacaaaaattagccaggtgtggtgacaggtacctgtaatcccagctacatgggagtctgaggcaggaggatcgcttgaacccgggaggtggaggttgcagtgagccgagattgtgccactgcactccagcctgggcaacagaactagacttcgtctcaaaaaaaaaaaaaaaaaaaaaaaaaagaactcacagtgactgagagtgtttttatgagccaggctctggtctgagcacaaatttatcacatagaaaccctatagggtacctgggaatgttattcccattttatagatgagaaaactgaggcacagaggaattaggttccttatctaagtttaaacagaaagtacatggcagaactgagatttcagcccagactccagagcagcgctgtcccatatatttctatgtgaactatatatgtaatcttaaaggtttcatagccacattagaaatgtaaaaagaaacttataaaattaattttaacactacattagacagggattataacatgtaatcaatataattattaatattttattttctttcttgtactaagtctttgaaattcatgtaagcatgttttccacgcacaacccatctcaatttgcacagtcccatctcagagctcaacagtcccaactggccagtggctggttttggacagctctgcttcagatgccatatgcctgactaataggccttactgtaaagacaaaatagaaatgagagaaatcattttctttttagaacagtgtcatcccttgggaatctgatgtgaaccaccagaaccaaacagaaattccccagatgtcctttgacagaatgtatgagatacatttccaagtgccacaaatcagcctccaactctttattctatttttattcaccttccttacagagtttctgtttctctgtccatcccttcactgcatgtgtggcttgggtggtggtccttcttgttttccttcacacactcttcctgtgggagctcctccgttcactccaggaccattgccatttacatgtgaatacctacccaatctgcatttctggcttctgcacttcacaccgtgcatctacgactggacttttgcatttggatattctgcaggtatctcaagatcaggatgcacacaagcaaactcatcccctccctgctctcacagccccacctcccttgcccacctgcacccacagtgctccttccctcttgtggtcctcagggcctaggaccacctgcatctttcaccaagatgcccagcccagaaaatcgcctccatcccagttcaatggactgagagttctggaggagtcttctctgtgtgatttctcacatcattcccattctccccattcccaattctgcttcccctagttcaggccaccaccctacttctgtctgaggttgtaaaaggtttcatttggactctctccgctgaatatgcccttctccctgtggtatccagaaagatacaatatgaaaatctgcacatccctgaggagggaggatcccagcacctccctccgcagatcctgctgtggctccacgaccttcaggataggagccacagctcttttccatggtgaacaggctgcttcacagccaggctcttctccactttgtccattccatgcctgtcattccagacaaactgccaatgatcaaaagcaccaggccaatcacaaagcagggaggcttcccctcctttcttcctctaagcacttccgagcccacctgaccaactgcgattcaccctctggactctgctccatggtttctttcccgaagtctctcccaggactccggctttgtcgcccctgcttgtgtgtcctgccaccacactgccatctgagccccaaacacttcatacagtggtttctcactgtgtcccacactagagtggaagctctgggagaagaagaggaactgtgtatccctagaacctggcaaagcgcttgtcacctactaccacaaatctacgtggaataaatcaacggccacaccaaattttgcattttataatcacattcatatctaagtgttcacttaggtacaatttccccgcatgaaagaaggaagcaaatgattctggatagctgtcatgtttccagggcaatattaattccctctgactttcctttaagctggcaaactggagaggctctttcctacctgataagccaacagctccccggaggtagaaatctttgtcatcctgaccttcttcatcctcagagggcagagctctggacattgcagactccaggtcccgactgaggtcatagtcgtgatcccactccagggggatggagtccacactagccggggtgtctcgtcctgaccgctcgctccggaggggctgagcgagcgagagggagagattggaggaaggctgtggagaaagcaggctgtctgcagagcggtcgtgccagtgcaggtccgacagagctgcagagtcttccagctccagctccctgtctgagaggtcgtgctcatcgtctgggagctagaagggaagtcaaggcaaccctgtcactgtagtggtcagactagcttcttatctgggccacctgcctaccatgtggggacaatttttaacttcttatgagcaaataaataagaatcttctgatcacagaaatacaggggacagtgctgctctagagtttgactgtctgggttgaaatctcagttacgctgtgtgcttcctgtttaagcttggataaggaacttaattcctctgggcctcagttttctcatctataaaatgggaataacagtcccaggcatcccacagggttttttttttttgagtgggaaaaaattaaaaagtcttataaattatcctacataagcctcagtttcattgttggtaaaatgggaataacattaaaacatacttcaaataattaatataagattaaataaatattataaagaaaggcaatctactaccatgcccaccacacaacacctacacactggcaaggatcggaaataagagcaaattactaagaccttagcttgtccttatagcccagatataaaataggtttgatcgtagaagattccaaatactctaataacatctctataagtaagatgtgattatggtagcaattaggaaaatggaagaatgaaaattcacctaaacctaacctcatcaattaagaagctgttcactttgcttccttttattgtatttcttctagaggcttctcttatttcttctagaggcttctctagagcagtgctgccccatgtttctgcgatcaaaagattcttatttatcttccatagaagatatgagccaaatgttcttctaaactctttgtatacattaactcatctaatgctcaaaacaatcctttgtacagggtagttactgctactaaaccactttcacttttgaggaagctgaggcaagaagggtgaagtgagtagcttgccgaaggtgacagcgacaatgtaggacaaagctaggacttgaactcaggtgctccagctccagagtctgagctctcacccactatcaatacaacccaatcccacacgacttattctctttagatttaatgacaactaagaaaatcaatgttacatacaggcaggcggatcagtttcttatggtatctttccacacgcccgaagacctcctggcagtaccgtcggagctcatctagttcctcctcgatgatcgctgcatccaagggctcactcttttctatcagctgttctccttgggcaattatctgctcaatcttattgtggttcagtgaaatttcctgctggaaggcctagggagtacaaatctcatgtgattttgctattgttgttgcttacattgatataaaagaatcataatagatgtatttctcattacattaaaaaagacatgtaggggctatttaattgaccatatacaatcacaagacaagagtctattaccttctaaagtaaaacatatgcattttcagccagaacaggagtcataaatagaaacattcgaattccatgatcagaaaagcgcttttggctaataaaatttaccatcacaggtagtgtgggtagagaataacaggggaaaatattcaaacccaccgtaagttgacagcactggttatccctaatgaaagcaatggcagtcaatatactgtcactgaaataaatgtagcattttaaagaaatatcccgatcattttaatttcagatatcctcatcctatgtcaaacatgactaagagaagccatccaatgccacgccttcttctcaggtgattcttttattatttcagaacataggcaggtaaagttatgatttgaaaaacaaggaattccaggaggattatttagactcattctatgtgttgcaaaagatttaaatcactgggtatgtttcagtgttcacttttaattcaatacaataataaattgtggaagagctgaattgtccaatggtgaaaaagactcccaggagagaagagagggtagtaataatttccatcatcctgccagggtcccaagggacaagattcaattacacttggcagaaactttctgtggaaggatgtaaatgttgattcgcctgtgagatgacaggagagaggaatcaggggagagggtgaggcagaatagcagggtttactgtttcttccatcctgagaatccatgtctacgggcaagttccttgttttatcataacaacccaaaggttatgggcgtcatgaccattctttaaaaaaatccatctatcttgggaggaaaatttcataagcttccttggaaaacactcaatttgttaaatactcccacttttaggaaatccttacatctaatgtatatccctcctattcgaatttctagctagccactgtgtttgaattatatagtgaaaaatacaaaatgtgtttaaaattaacttggcatctaagaatgcagactatgaggaatgaaatcccgacataggaaagttgtattgctttgcaacatggaggttaaaggaaccatgtgaaggtgctacaaacacattagaaaaaataaacgaaaacaacaacaacaaggccaggaagggtggctcacacctgtaatcccagcactttgggaggccaaagcagctggatcacttgaggttaggagttcgagaccagcctggccagcatagtgaaaccccatctttactaaaaaaatacaaaaatacaaaaatttgccggacttggtggtatgtgcctgtaatctcagctccttggcaggctgaggcaggagaattgcttgaaccagggaagtggaggttgcagtgagccaagattgcgccactgcacttcagcctgggcgacagagtgagactctctctaaaaaaaaaaaaaacaaaacaacaacagcagaacatccctaacaccctggcaatcaagctgattgaaaatcaatcaagctgttgaaaaatatcaacaacaatatcgatatcaaataagataagagcactacccagatataagcaatagtggttatttctgggtagtgctctttatctgattttttatatattttacattttctgaatttttttgcagtccagaactaatttttcaaaagaaaagttatttgctatgttcttcacaaaagagccacaaatcctttcattttcaggctttcttcactttggtaacttgaaaaataatctattaccttgagttgctttattttagcttgaacatcacactcagaaaaatgttcaatattagtgagctgcagatccatctctgtgagccagaccagaatgctgtcccgcgcagtctcaaactcctcacgctggccaataaaatgctggaaggcaagaggaaagtagtaacaattatttttattaaaagtccttctaaacatatggagatggcacagcgaattccagtgttctgtaaagtcattttctcagcaagcaatgagaagcctgcaatcctttgctatatcactccccggtttactcctcctgccatcccattcttacaaaatcactgagactgtgtctcaagactgcattcaaatggcccagtcccatcctctggcctctaaattacagatgaggcatagcaaaaaccttgagtctgcgcaagatggaggtgacacgcttttgcaggttgtcccatctctggttgccttcgtgaaccatctgtttgaggctacatgctgaatcagtgcggttctccctggccaggcggcggtactgcttgttgatcagttccagctgcgtcaggcactcgtggacctgtcgctggaaagcctaaggccacagagaagcatatcagtgtgagaaatcagcgaaggactctcagtagtggctcctggttttcttattgtagcgtctgggagaatgggaagttacactatcacagagggaaagaatgatgtctaataacggtacacttccccttgttaatgcaaagtcatctagtcagcgtaacttaaaggaaagggagaatctatcaaaaaatatgaaaatggggagtagtaatgaataaacacacacgcatccaacacacatatatagacacacacacatacatacacacacatatacacgtagctttaaaaataattaatgtcctggaaacaaatattcccacaaagcaaaccactataaaaaatatacacgtgtgtgtggaaatgtgagtttgaaatgttgacaacttctgctgtcaatatggagaaaaagatatctataatggaactgtttatttgtaaaatatgtacttttctaaaaatctagaaattacctcaattctgctgtccattaggaaaaaacttaaaactaccttttgcaaaaggtcttccaaaaaatcaagctattataagcttttaagaaaagtaatttagtaaaatacaagtaactttatattttaaaaaatttggaacatgctctgtttcttttttgttgttcctgtgatttaattagtttttataaaacatgttagagctagtgtaccacccacacagtagcatcaatttacttttgaggctatcccagggtcagtttagagattctgaaggtaaaatattcttttctgccttttccctccaatgtagaagagccctatagcataagagtcatttggccaaaataaaatgaagctttaaaaaaaatcatttgtatgatttatgactgatttttatcttggcattagaccaaaatgaaaactataattaataaattgaaccgcactcatcaaatccccaaattctgttttccttggctcatcacactgtttacatgtgaccacatttctgtctcttaaattgctttccttgtgagagctgctttcagagccttcatcctaggaaatcctagcttccagtctaaaaaccttaagttatttctccagcaaagggagtggtaaggaaagttcagctctggccatgactggaagtcccagtacatgtttgcccactggggtaaggttggagtacccccaggcagataccccagcacacccatgtccatcccaaacgttcatgcgattggaccagctaaagactgcccccaagcacaacttcgtttctgcaattcatttctgtctcttaagaaaattaactacaaaattcatgataaataataaaatcaatcattatagaagctaactataaggctaacttttgctttaaaatctgagagtctaaaatagcatcaaaaagaatcttatataatctgctttgcagtataagccaattataaaaggttttaacctttatgaagggagtgtgtaagatgcagttgagcagctctccactagcattcattcacatcgagatgacctggaatctactgcagagtttactgtgctttttactagtagttttctaagggagtatcttttatataggaataaaagtgttgtttattttaatttagtggtatagttacatatgaattcattcaccattcagacatcagagtaattcatccatttcaaagtatttgaacatttttctagattcatatagctgtccatgtacaaccctgagattttaaactccataagaataaaaaagcgaacttcttatttcccatcataggcctcagaaaatgcctggttacctgatgttgcaaggtaaaaatgaatgcagctacatttcattacattttcagtcttatttctaaacatctcgaggaacttgggggcataattagcaatggtcagaatgcttctgaactctttgctgttaacatacctgagtacacaactgcctattagtgggaactgaagggaaaaacaccttcaaatttaaaaatggtcaattttgggctaggtcaggtcttccatgaaaatgaaaggcagctgagaagtcagagcttcattgtacaacagtgatagagtggactcgagattgtgcaagcaggcaaggtattggaatcaattcttggataacttctttctttatgaatatgattacactacagctattttcatctcagtgtaattgaaaagttttggtgactcaagaccagtactactcttcactgtgtaattagaaatgaattataatgaaaatgttttattccattctagagtcaactcttttatcaaatacacacacacacacacacacacacacacacacacacacactgcgattaggtaaagaaaatacaaaaatgtatgtggaaggtagatttttatggtttaaaaaaatcatattttaatcttagaaaagatggttgactgtggaataattctgaaataaaaatcatgccaagatcttttgggaggaatcacgattcttcttttctaatagaatctctcttcattactacagtatttatgcttcttgataatcttaaaataaaaacctctttttcccccttcatacgtatgactacgtatgaggtcataataaagatggctgcaaagtcctcacgcagcaatttgagcagataacatgtggtgaacagctagtttaggtcttggaactccaactaccagctggctactttaatagcaaaataaggattaaaaatttggaattatagattacctcaaatttctttagttcttccttggcaactgtatagatcaccccagaagagctgggaaaagcagctgtcctttctgaagacttcagccaatcttcaaaacgtgaatagtcatccagaaatttctgccacaatcgccacgtctcttcgattctggggcggaaaatgaaagaacagattcagattattggagactgttttcgctccagaacccggtctgctgcctgcgactggattaagggtgcccacagaggcaactgttgtgccaaacgataaccattcctcgagccaaatttgaccagagagcaagagagacaactgcttgagctaaaataaaacggctgttttatttttttaaaaacacgtcctgcaactctggattttgaattagtcaaattgaaaattacaagcacatcacacgagctgccttgaatgtgtgcaccaagtttagaaaagcaacaccaggtttacagtgtgcactcaggccagtgtcttacggaaataaagacgaggtcggaaaatccatttaagtccaacattcaactcacactgacaaaagttaatctatgacagcaggacaaatattaagctttcaacagtttaccagagagcacagccatgatgatcactttgtaacacagcacgattttctgccaccttgaatttcaaagggcttaaagataaatctgcttttattatttaatttttaataaaagaatgttactgttctcacagccacacattctgtaatgttatgcttgtttgacaagggtgtatttttatgtttccgtattatatttcaactgttaggtcagacataacttggcttgttatatttatatattacctttatacctacttattttcccaactaaatgtagacaatagtaagtttgggaagccacagctatttttggacattgtaacgaacaggaaagagtgaacagtggatactctgggtgatttttattttctttttggtctttcctcttccctatctgtttcagcatcccagctcacttcagcctcctttccatggacatagcacaaatgtttctccaccgccggtccaggtttctcgtagcctgctgtatagagtcacactcggcatcagtggcacaggcgtcacagtcgtgcagcaggacttcacacaggttgaggacagatgcaacacctgtactgtgcttctctatgtctctctgaagctcctgcaggggaacgtaacaggctttattcaacaattacatgtatacagatgagagaaactgaagcaacctatgttggtaaatggctaggctacaccttgacaaatatttaatttccttgaatgtatgacatttattgagcctcatttatgaaatccagcaagctcaaaagtactagaaaatggatgtagaaatattttggctatgcgagcaatgccaaaatataaactgaacaaatgaaatggtctacactaagagtaaaactaacttctttaatcaataaaaaatgaatcttgccccagactctacttcacgaatacatcactttcattccaatcaatcaatcatcatctcttagtatctgtcaggggattggttccagaccttccctcggacaccaaaacccatggatgcttaagtccttgatattgaatgctgtagtatttgcatacctcctacacacatccttccatacactttaaatcatcttgagattacttataatacctaatacaatgtaaatgctatagaaattgttcttatactgtattgtttagggaatcatgacaagaataaaaagtctgtatgtattcaatacagatgcaaattgttttccaaatacttttgatctacggttggtggaatccaccagtgtagaaccgtagataccaagggcctgtatatatgcatgtgctagacctggcactcaagaactgggctttaagatccaaagatttacttttttttttttgggatggagtctcactctgtcacccaggctggagagcaatggcacaatatcagctcatggaaacttctgcctcccgagttcaagtgattttcctgcctcagcctcccaagtagctgggattacaggtacccgccatcatgcctggctggtttttgtatttttgtagagacagggttttaccatgttggccaggctggtcttgaactcctgacctcaggtgatccacccacctaggccttccaaagtgctgggattacaagtgtgagccaccacgcccagctgatttgcattcttttttaaacagttaattccaccatcattaaaaggtaacatggttatcaatggacgaacaaataaagaaaaagtggcatatatatacacaatggaatattattcggtcataaaaaaatgaaattatgttgtttgcagcaacatggatggaaccggaggtcactatgttaagtgaaataagccaggtacaaaaacacaaatatcacacattctcacttgtatgtgggagctaaaaaagttgatctcatggaggtagagagtagaacgccagatagcagaggctgggaagagtgtttgggggcaatgaagtgaggtgtcaatagacacaaacatacagttagagggaataagtcttaatgttcgatagagtagaatgactatagttaacaacaatgtactgcatatttcaaaatagctagaagagagaaattgaaacattcccaacacatagaaataataaataccagaggtgacggacaccccaaataccctgacttgatcattacacagtttatgcatgtaacaaaatatcatatgtgccccacaaagatgtagaaagactatttaagggacctaggttctatatcatgcatgacatcagcagtttcctcagagaacaaattctttttttttttttttttagatggagtctcactctgtcgcccaggctggagtgcagtggcatgatctcagatcactgcaacctcctgcctgattctcctcctcattctcctgcctcagcctcctgagtagctgggattacaggcgcccaccaccatgcctggctaatttttgtgtttttagtagagacggggtttccccatgttggacaggctggtctggaactcctgaccaggtgatccgcccacctcggcctcccaaagtgctggaattacaggtgtgagccactgcgcctggcatagagcaacttttaatgtagggcagaagtaaaatgttttatgataaaaacaaagcattggatttccctggagtcccacaatgtgaaatcttcattttaactgtataaaatgtaaattcaaattgtatgttgttttctctattgaacttttaactccatttactccaagtaagtattccattattaaaagtaagctctaccagtatcattttttgtttactatattcatcaatgtccttaatgtgttttccttttcttttatcaggaagttcttgaatttgcttattttttctcttgctctaaaaattcctcaatttacgcagatacccgggatttatattcttgtgttgctcttcctcttatttttttccttgatgccatgttccaacatctatgcaaacactagctattgtcaaatgtcatagtgcctttaattaattttggagattttataaactagacactagacgataaattttactaaaatatttatatttgtataaacagtcctttcaaatctctgacataacctccttcacttacatgaaacaatatgtcacaggaattgctgttctaaaaaatataaaatgaagtaatataaaaattaaacttagtatttgcttaaagataaatataaagacaaataattctgtaaatgagattaccaagtacatttgaggtcttaaactacattttgtgcaagcatatacatttggaagaagtgttaggcccctggacataaaccatgcatttaagaaagttagcatttttatttcattttccctaaatactcaaaagtttttgttaaaatcaatatatgaaatagcaaccctaagatttgaggggatttataatcatacataagtgccctaagacaaagttttaggctcagcttcaactttttttcttttttttgagacggagtctcgctctgtctgcagactggagtgcagtggcacaatctcggctcactgcaacctccgcctcccaggttcaagcgattctcctgcctcagcctcctgagtagctgggactacaggcgcgcaccaccatgcccagctaattttcgtatttttagtagggacagaatcattcttaaaaattttccacaagggaaactgtggtaactgtgacatgattaaaataaaatgtatcaagccctgactttgtgttaggtaggcactgtgctcagtgcttcttcttagtaatttgtataatcacactgtgtggtgtggactctgatgattggcgttctataaatcagggctctaagggttcaaatagttatggctttgtcccagatcacatgggaatgtagtgaggccaagatctgaacccagaaagtttacttttaaccactggtgtacaggactttttaaagtcttaatttaaaatttaattaaaaagctatatgtgcatatttaatgtagtaaaaagtaaaaaacgactagcaggttctgaagaaagcagcatgttttccaccccggagttcacctgttcaggagcaaccatttccatctcttgcagctctttcttctggtattacttctaccctttttaattttttgagacagggtcttgctctgtcacccaggctggagtgcaggggtgtgattatggctcactgcagcctcaaattcctggcctcaagtgatccttctgccttggcctctcgaagtattaggattacaggggtgagccgccacattcaacctatttctatatttctcagtaatatataacttctctatttctaagtaacatagctactgcttgatttgtccatactttatgaattcttgtatagtagagaagaaataaacttctacatggctgactgaactctaatgactgttacagtacaacttagagctagggtaataatcactgttctcatgattatggttatttaatatttttcacatttgaggaacaaaatatactatggttatgtttcttttctttttttttagacagagtctcagtctgtcgccaagctagagtacagtggcgcgatctccgctcactgcaacctccgactccctggttcaagcgattctcctgcctcagcctcccgagtagctgggattacaggcaagcaccaccatgcccagctaaatttttgtatttttagtagagacggggtttcaccatgttggccaggatggtctcgatctcctgataactcattttcctggattttacaatcctctctctctctctaatttataatgcttgcttctattatctctcttattgaactaataaaactccttccggagtggttaagcccatcagataatctagcccctcctggctcctcctggaaacatccctcctagagcacccagagcccctgctcccatctggacaggtgctggcttggctgcagtacagctgtcatcagggactttcctgcaccttcactctgggaattccctttttctttctcctgagttgaatagcatttcccctcttgctttagtgcgtgtagcatatgcagcatatatagcatagtagtacgtagcctgtgtagcaagtatgaagtgtattttcctctcactttcatgtatgcagcatacctttcattagcttcctgaaaatgggtacataggaggtaaaatttgtagatattaagtggcagggtataaaattctaaattataaagaatttttctccgctttctgaagttagagccattgtcttccagctcccagtattgttttggagaagccagagtttatttcatcctggaaacctttaggatctccttatcccttgtgttttgcagttttacagtgtggctttgctttgttttacattttcctgggcactcatacagcccttatcatctgcaaatgcatgtttttcattttagatatatatatgaatatatatacacacacatatgtgtaatgtgtgtacacatatacgtgtaatcttccacaaagtaaacaaaaagataaatatatgaaaaataggagagaaatatagacataaacataataaaattaacaataatgcgagagtttcaaaatccaattcagttattttataaaagtccccccaaaaaagaataaagaaaatggagaggagaaaattaacatcgtagtaatgtaacaaaaatataaatatatatttaataataaatatataaaatatatttttacattactacattatttatttcataataaacatatattatttaataataaatatatatattacattactactatggtaattttctcctctctattttctttatttttttttagcaggggacttttacaaaataactgaattggattttgaaactctggcattattgttaattttattatgtttatgtctatatttctctcctatttttcatatatttatctttttgttttactctgtggaagatagtctccattctgaatgctttttttaaagaaaaatggcatcctatcattttatgaatgcaaaacctctcatttctgtgagtttgtttgttttgttttgtttacattttctttctctacaatgtgtttcctctgattgttcctttctttatttccctctatttatttttttttcttaatggtagaagctttcttaagtggtgaggattcttgcctacccacacatattcaagaatgagtcagctatagaagctgtgtatgcacctaaagtatgtcaactgggaggcttccctgtggagagttaggcaggggtctggccttttctgggttaccttaagtatcactaattgaaggtactttttgcttgtctgatcagttctccagaaaggatgctccaatctcctggctagggtgtaagcctgggtactgacatagtgggagccaagctggggaagcgggctgggagccctagcatttggtattgagccagtcacatcatctccccatttttaacatagtgactctagcctccacggtgtcctgatccccaaacccagagtccctctggtttgctttctccagagagtaatcatctgatcttctacctgagtaaaggaagcagagttccctggctggctgggcttaggaggaatctgccagtctcagcacaccttattcagattttcaagtaatcttccattttacagctcaataggcaactcaactttcagcttcacctgatctccactttctgagccttcttcgaactctgtggcatgaatcaactttctccaccctccattctgttaacaacatcactgatctatccactttctatcttgcaaaattatgttggatgtctgtcatctctaccattttctctcctgttctctttgccattgtggttttaacctttttccctctctaccatcattttattggggttttagtagtaggtggggctataaatacatatgatcaatttgccatatttaactagatattttgttgattttcatacacttgtgaaattacgatacccgccatttgcatttcaactcatcactatagacatcattaccatgttctctggaagaatctgggaagccggatgccaaccaggatccctacaattcaatcatcagaatctcaaacatcaccacccatcagaaaactttaatttcataaaaattgaaaaacgtcttgctaacagtttttttaaagcaatggaatatagtgtatgtttcaagatagctagaagagaagattttgagtattgtaagaaatgataaatgtttaaagtgatagatatggtaatcaaattacctcagtttgtttgattattacactatgaaaatatgcattgaagcaccacgttgtaccccacacatatgtacaattactatatattcattagaaagaaaaaaattttaatgataattttaatattaaaaaaacctcaacacccaaaactgtattttgacacctatttcattggcttaaatagtctgtaaaatgaagtaagtacataaactataagattttaaaaataggaggtatttacattttatagcattttaaaattaagcaactttgctgcaatggcctaaatgtaatggagagaaccagagtgtggatagaatattcaaagcaacctaaatgcatggagtaacaatacctctagcgggggatttacagtgtttgctattggcaactggagtccgatatacttagcaaggataaatgagggggcctggcacagtggctcacgcctgtaatcccagcactttgtgaggccgagggtgggcagatcacttgaggtcaggagtttgagaccagcttggccatcatggcgaaactccgtctctattaacaatacaaaaattagccaggcatggtggtgcatgcctgtaatctcagctacttgggaggctgaggcaggagaatcgcttaaacctgggaagtggaggttgcagtgagctgagatcgcactactacactccagcctgggcaacagagtgagactctgtctcaggaaaaaaaaaaaaaaaaagaaagaataaatgagggagggaatgggaggtgaaaatttcttctgtatacattttccaggatcatccctttttgctttgttgggttgtacgccgccagtgagatattctgtctttgctacacacatgaaagtggaattactgtgtgcgatctgcaggtcatgcaatcctttttgcaaaacaaaattttttcaacttgaaaaattctaagtatgccttgtaatctttccccaaacactatacacaggaaaaaaagtcgggggcaggggggctcctttcagtcctgtctaagtgtatggtagtgggctagggctagtgactctcaaataaataaaccaatctgttagcactgttttagatacgtaattgcaactccaccttacctaccatcttagaaggcttcttggtggatggatgacactaactgtacaatggcacaaccatctttgtaaggctgaactctgcagtgacatggaacctgttggcctcaatcgcctgcctaggcaaagcccccttcctcaccagtcctgcctagctccctgctgaccttccatctccaggcaccatctcatgcccaccccatcatcctggccaggaggacagatattccatggcttattaattccatttccattttaagtcttacctgctgctcattaagctttctctgtatttcttccgagttacaggaatcgtagactattggcttggccagctctgactcgatgtgagcgagccaggtcctcaggctgctcatgttcttatcaagctgctgcacggctaccagggtctccttcagcttcttcaccctgtgggcagagaagggggaatgtcccacttcagcgagaggcccactcatgtttctctagcgtgcagaggagaacactgggctttaacaatctttttaggcagagttagaaactcatgtggaagaagccaaagacagaagacaaaggaggatagaaattagagatgaatacagacaaaggagcaaggatgcagaggaggcaggggtccagggcacaggagcagagatagataaattagttttgaacacagttttcccagtgtgagcaaggtgtgatcagaagtttgggaagaaccacaggtagtatttctcaactccattactacctacttacagcaaaaatcaattattgactccctgttaagagcctgacatggctgagtgtacacagattgctctaaagagaaaggtcatggtgataataagcatatgatcaatgatctattagtgcccttatttaaaaattgctgctacctttagactatgagtctcgccttttggttcaggaaatatggccacctaattggcactgctcataacagaggtaaacagcagatgagcaaaatacttcaagctgctagggtgtcatcttggctcaactgaagaggtatctatcttcttgaaaatatgtcaagagcaacatgacttgtaagactctaggtttgtgatacatttaaaggcagggatctgcaatagaatgttctcaaagattgacaacttatacacttagagtcatcagatattcgcgccccctcccccacccccacattacttccaggcatttaaagaagtgattctcaagctgggattgtcacacagtcagtggagggtgctttcaaaccacaggtgccaactaccagccaccaccgccaggtggttctgatacgtttctctgatcaagacacactgttccgaagaaaatgtctcataatcaaagtattttgaacatttgatttatttttagttgcttaaaattgttatcatcacttctgttccagtttcaataaatcaatgtgtctctctcaagtgaaaatgtagtcatttgacaacatgatcgcttttcctttttgtcatttttcctcaaagcactgtcatataaatgctcttaaaggattttcactatggtcagctgttaataatatctatattttaataattgtaattaataattcttctatttgaataacattttcagtttgtaaaaaccctcaggaacattaccttttattgttttaaaaaatgtgtatttaaaaaattatgttcatatttcacaatatattcttttggtagaaaatgaaaatatgttacaatgtttattgtgacttacaattccactcgagataagatttccccaattagctttataaatacaaattgtaccctgtcccccagacacttcaaggcattggccttgaacactatttccaagaacttttacatacaactcactcacatttctctcatggctaagacaaaattcatctgggcatcagtcagtgaatgacagttttattatggctactgggtacaaagctcatggagtgcatttgatcgaccacagcatggacatggaattttacatggctctggccatagtgccccagactgaaagaagagtttaccatcaataaacccactggaagaggcctgaagaatggcacacagcacagagaggtccgtcctgcttttacatctgtaggaatgtcttctcagcagcctctcctgcatgacttcagatttcgtaggatctgaacacttactaggcttggggatggtaatgtcatcagggttttactagaggttggagtgcttgttttctcccttccttattttagttccctggtattattcatgcattaattggtctcctccatggtaacttccttggaaagctggaaatgtgaatttctatatttggctatttccctaccccggccatgctaaactcagtgctttgcactaaactgggtactgtttaagtggttgctaaacattaataatgaatattctaagcgaattgtgtttatttaattaacatgttttcattttaaaatttttatttgatattaagtgtgtattaagttttacttctagattcaacatttgccagtgctctatttgtcaagtactaaaattcattcgtttttttggttcaaaactcacaaatatgatcaaaagatccaaagcacaaaaggatgcaagtaaacactgttccataggaccgtctacattagaaaaataaattacaggatagcttttgtaatatcgaatgagttccaagtcagagtggttagtatgcaatatgtcaagggcatcatgacatggaaatgtgtgttcatatagtccattagggacaagttcctctttcaagcaaatgtgtaaatttagtaaagtcgacgggggtgaacatttaagcagttctttttcatttttttaaaaattgtgtttttactacaaatagcaaaatacagtgtgcatgtgtgctgggggagcagaggtgagcctgtagggcatgggtagtaggattaataagccttggcttattaaacttgacatttatttgcaggacagggatcattcttttttttaggagaaatgtcccatgtttctttccattatttctttaaagataatttttgggtgaagcgtcacagtatttttatttatctatcatcgtgagaagtctgagcaacattacttttggtaagcatccaggattatcattcaaattagatacttgcagacgtcacatgtctgggtaagtttagcagcttgataaatctgtaagtccctgcagcttatggttctttcacagtccagtgtgtatcacaggcacttgacctttcttgaaaaggattctactatgaaatccaaatgtccagcttcttaacactgaaacacgtatatacaaacacacataaatatgtatatacgtacttacacatatatgcttatatatctatatatattgtatctatatttcaccactttccttcaaagtaatttagtatatccataacccaaaacaaaacaaaaagtccaaattctaaatataatagaacaaaaattaccattgggtaaatcctattcatttgtagaaatttatctgagggatgatacagtaaagaaaaacatattaaaaaaattcctgtcatatttttattctaactgaaaaaaatcatgaactaaacatttgcataatgcactaaattactattttagacattaatttgtacactttgcacatatattttataagcttcatattagggactaaaacttactgacaagcacaaacaaaagcaactttctcaaacacacagcattttctagagccctgaaatagttttatttcatgaaaggaaagctttcaactacaaagctgtgaaccagctaaggctaaatttcagtttcatcagaagcccatcctttaaatagcagatgatggactaactgagtctttttctggatcgctttcctgtgtctcagcctctctactctagccatactccttgtatgacgcatacggtccagagacaactggaatacagagtcataataaagtccattaacctttttgtccagctctgcatgcccagtagaggtactagaaaacaaaccaacgaataactcttgggagtccacatggccagctatctcccaacaccaatcctcttcatgtaacattggcaaaaacagttctggattaaggcttccagcgtctatcctacaaaccccacgtaacatgaaagctatgtacaatggaagaaactcaagaagatgcctgccttgtgacatcgcagttacaatctgggagatctgcatccacacagctgtcctctgccatcctcagggcactcaggtcctccgccaccaccatgaagcttccacttgcaaaagttagactctgcagagcaaaaagctatatcctgcgtggggatgaaagtttccccttgtctgtgtatagaagtatgaaaatgctcactgtagacaaatgttggtagtctctgcccgataacatgacactgggcagtgacaagtggtcatgtttctaaataaaacctacattcattaacatgtgccaggcttgatctcctggaatgtaggccacgagtgtaagaaggggaaaaagctcagtgtaatctgtaaggaggaggaagctacaggtctaaagaaaggacagcaaaaacaacatcggctgcacacactctgctgttctgtaaggacagtcaacttttcttgcgggcagtttgttatgctgggaaagctatttaaagaaaacaaatcatcccactgcaaacaaacaaaatgtccacaaacacagcaaatggtagtagcaaaaggagtaacttccttcttttttgggttcagtatgccagctcggtagtgtatgcaagagttttaggggttgtttgcgaaggtgggaaagtacatgctctttatctttgagtagactatttggggaggaaaaataaggaagaaatattattctcccttacatatgcaaaacttttgtcctttaaaaataatcatgtagatgacaaaaataacattttcattttaagacaattaaaaaaataactatattcatttgctcagggggtcttcaggtaactctttttcttttgtgaatttcaagagtttccaaactttctgcactaagcagatgataatttaataatttatacttttaaagaaaataagtccccaaattattaattcctataattcaataaaatatgattaatgctggatgctttacatcctttaggggattaaaaactacacacaaataaataataaatattaaataaataatgaaaatttgctaagttctttccaaaaaggactacatgatgatttgtaactaaaataaaacaaagcatctggttctggtcatgtgagttgactgtttttaaaacagaacactacaggaaacacattttcttaataaaagaaatacattggtggctcacgcctgtaatcccagcactttgggaggctgaggttggtggatcacaaggtcaggagatcaagaccatcctggctaacactgtgaaaccctgtctctactaaaaatacaaaaaattagctgggcgtggtggcgggcacctgtagtcccagctactcgggaggctgaggcaggagaatggcgtgaacctgggaggcagagcttgcagtgagctgagatggcgccactgcactccagcctgggtgacagagcgagactccatctcaaaaaaaaaaaaaaaaaaaaaggaaatacacctgccagcctgggttacaaagtgacacctcatctcaaaaaaaaaaaaaaaaaaaaatcaaaagattatccaggcacagtggcatgcatctgtagtcccaggtaatgaagtgggaggaagactgcttgagcccaggaggctgaggctgcagtgagccattactgcaccagtgcactacagcctgggtgacagcgcaaacccaatctcaaaaaaaaaaataaaaaattaaagaaaactgcattttatataagaaataaattctagaaaacatagtacttaaagatattgtactgtgaattcttttataaaacaatcattcttcttatattaatgtatttttagtaatcagaaatgaaaatattttaaactttgattaaagaaatatattggttatgaatctaccactataggcaactttgtttttttcttgattatgactaacattttaaaaaacctgaagtcttcaaaacattttattgtcataatttccttagtttaatttcttttaccttatttagtttacctcatggagttaaaaaatttgaaatttttttcatgcttattattgttagcataatatatgtattccaatgaactaaatatgagacaaggcaaagctctaaagatacaattattcaaagagcaaaaatggcaatgttcattgatacagaaaatcctagataagttgtggtatatttatactatggaatactctgcaggtttctaaaagaatgagactggcatagacattgttttatagtaaacacagtcctttcccttgcattttctcattggagatgtggcagttagtttcattaacactttgaaaatgagcaacttgaggctcagagaagttactcagtaagacctgggccacacagcaggaaccaggtggactaaactcaggcctcttgattagttctgtgctgtttctgtgctcatcgcatcaatgcattcctgatccttaccaggcaccttccgactcaaacacccttaggtaataccagccgtgaattccaagaatttcatttcctttgacctccaacgtgggtagaacaccctttaaactgaaagtcctcctgagggcagctgctaggaacttcacaaagccttgcttgcactgcatatgtgttttacctccacagcctttgaactccctctgggatgagagctgacctctattgaacatattctatgcttagcggttgatatggtttagctgtgtcactacccaaatctcatcttgacttgtagctcccacaattcctatgcgttgtggaagggacccgatgggagataattgagtcatgggggtggtttcccccagactgttcttgtggtagcgaataaatctcatgagatctgatgattttataaggggtttccccttttgcctggctttcattctctcctgtctgccaccatgtaagatgtgcctttcgccttccaccataattgtgaggcctccccagccatgtggaactgtgagtccattaaacatgtttttctttataaatcacccagtctcgagttgtctttatcagcagcatgaaaatggactaatacagtggtaaaccactaatcattcttctgagctagctactattatgattctcattttatacatgtggtaaccgaggtgctgagaagataagcaagttggtgaagcagaatcacgctatgactcaggcagctgaagcccgaagccaatgctttgctttgtgtatgctttcatttgtgtgcgtacgttttccaccctatggtttagatttgagaaactcagcaaatacgggagtgactgctatgtgcaaagaacaaggtcaggggctgggactactatggtgatcaaggttagatacacttacattttagcagagaaaacaggcttaaaatgactgatcacacaagatttcacatagttcagggaaatgctatgaaggagaagcctactgagcccgtaagaagaatctgatctaatctggagagaaggaaaaacaggaagaaccaatcaggagctggccaggccaggggcaggcaggagaatgcccaggaagagagaatagaaaggaagaggccctgcagtgaggaacgcttgtgtacttgcattatgacacttatttggttagggaccattttctttctcatctttatatccctagagcaggccacctgttttggtaaacaaaattttgtgggagcactgccatggttttctatttacagatttttctatggctgctttcactctataataacacgctaatagcaacagagactatttggcccacaaaactaaaaatatttactatctggtcctctacagaaaacatttgccaacctctgccctatagcaagaagcatagtacttcatatatagtaggcgttcaatcattttaaaaaattacttgtttttactctacttctacaaaatgttgaggcaattataataaatatagagattaaaaacaaccagtcacaaaaggccacatattatatgacctatgtatatgaactattcagaacaggtaaacatgtagaaacagaaagtagattagtagtttcccagggctgggagaagtggggaaggaagaggagggaagaaaagagtgacggctaatgggtaactgtttttatttgggactgacgaaagtgttttaaaattgattggagtaatagatgcatagctttataaatatactaaaatcactgaattacatgctttagatagatgagttatacggcatgtggattatatccccaaaaaagctgctattgagaaaaacaaaaagataacagccaaataactaaaggatgcttttgccttggtgatggggatttaggtttagccgagagaaaaagaattttctctattagaaggtccagttacccacttccctgcccccaaatcatcacaacagagtgcgcaagttgaatttgaccttcctagatgctaagatgagaaatgttactaattcgttgtctgtgataagaaacattgaagaattaatactaaaaagacagatttccttttagtcctgagctctagagaaattgctatgtggattttctgcactggattcattgacaaaacgagagccagtattcttaaaggcagttttacagaaattagagtgatgcgtcaccaatgacagcttcttatgttgacttttaaaaaaagccaagggctcagaggtactttaattatctaggccactgctgaacaacagaactttctgagatgataaaaatgttctgcattgtacagggtccaataaggtagccactagcctcatggggttattgaccacttaaaatgtggccagtgcaactgaccataattaaaattaaggagtaatttaattttattccatttcagttaatttaaatattctgtaatttaaatagccatccgtagctagtgactgctgtattacatacagcagatctagaaagtatggaaaggacactagaacattattcactgagtcctaaaagtaactgagcaacttttgttgccctaaaaaattgacaatgcttgacaacacaatttaaaaactcaatgcaaagcacatctattttgtactcagagtaatctaaactaatctgatggtgatgtcaagttgactctaaattatgcgttctatttttatgtatgtaatagatttgttatcagtaaatctttttcttttcttttttgttgcttctgtgattgaatattaaagacacagttcatgtttctattagctgagatgttcacctaaaaatactatcatcttcaaaaataacctctccattcccacaagagcaccaatacaggacagaaatgtcgaaaggcatacactgggttatattttgctttagtgcatcagcgctggaagaggcaagagtggtgaatggactgaatcatagaaacctaatacttcagctggcagttcacagttgaggatgggtgtgggaaacatgcatccaatctgtgcactaacgaagcaccaataaacaaggaaatgcaatgcagatgtgacagccgggtgtctttcaggagaagctgcaagggtgactgtgactctaacatggtgttaaactccaggatggctcaatgatcagtgcctaatctagtctaatttggaaggaggcaattagaaacaggcaacatatatacaaaaatctcctgtggaattttatctgggtattctgaggctttatgtaagaggaaacaaaaattagtattgtataagtgactatagtgagaagcatgtgtaccttataaacatgtaattgattcaagtttattaatatgtcttttggcaaagtaaacaattaatatctagaaaactctccactgaacagccagacaaaatatgttataaataaatgtgaattcaaggagacagcagcaaactcatttgctgtaatattggctcatagttgggcatacactaagttagctgcttatgactagattacattaaatctgatttaaaatatctttgacatagtgcatccttactctccacatcactgagtcactaaaagtaggaaaataatattaactagtttaactggattacgtggaaatgtcaatcaatctatgagtcaaatttgaccaaaaaactccccgggggatgtttaccaaacaggcagtttccctaagaaggatatttatagcttgaaggacttcaattcctccttctgaaacaggattttgttatcattttagtgagggagaagtgggactgaacacagcactgggattttaaaatatacatttgttgaaactccgagaccagtttaagctaaaatattatttccatctctttatagtgccttttccagagctcctatttatctcattgttttactccattcccatcctgaacttctcaaaggagaagttctccttcagttctgtcattttatcttgactctcacagtcactgtcacattgtaagtactttacaaagaactgagaaattagattgtcgagatcaaaaacagaacttatcttccatttaactgtcttctctctaacagggaaaaggaagtcacaaacttgagaggcaggagggcacagcactccaggacacgcgctttggagtctgagcacaggctgtgccacacaatgtgtgcgtgatgatggacaagcctcaaccttagcccctgtatctgtaaaatgggcataatgataaggccacctcaaaggacattatgaacaatacacaaaaagatgcctatgaaacccgtagcatggtcattggaatcagcaaagtgttcaataaatgttagctatatcagtgctatggttaaacatttaaaaagctgaggctgggtgcggtggctcacacctgtaaccccagcacttcgggaggccgaggcgggtggctcacctgaggtcaggagtttgagactagcctggcaaacatggtgaaaccccatctctactaaaaatacaaaaattagccaggtgtggtagtgtatgcctgtagtcccagggattgggaggctgaggcaggagaattgcttgaacctgggaggcagaggttgcagagctgagattgtgccactgtactccagcctgggcaacagagcaagactccatctcaaatataaataaataaatataaataaataaaaagttgatatacatttattccattttgtttcattgtcactaaaagataatctcactttcttgagttagatactttttgataactctcttatagaaaagaaatatatccaatgttttcaaaatcagcatacagggttgtggtgcccacatgcggttttgatgagcacatggtacgcagaggacattgtttcacgtccacttttatgcagcacggctaaggaaagaaacccagattttaaaagcgtattgtgggatggaccccaaatggcaccatttgtaacattccaactctcctaattgccatgaagaacatttactcaaatattcaaatattcatttatgcactgaagtattcattgagtccgtatttaggcactgttcttagtgcttgtgatatgtagtgaatacaatggagaaagtttcctgacctcagggtgcctaagttccaacatgaagccaaattcacctaaaataagacatctcctttttatattaatagcatagaacatttttataacatagtgcatcattcatattagacttttatattgctagtaaataccctcatatatttttctttttgactttcatctctcttacccaaccctacccttctgcaacagaaagtgaatgtaatattcttcttaggtatgaggcaaacacttatagttagcactaaagctcaacacaaaattactataatgcagcagctgatttttacaactgagcagagtggcaataatcagatttatttctataccttgctaactaaaaatatggcagagatttagtaattttttttttttttttttgctactgcagacaaaaacactctccacaaatactggtcagcagtttcttcctgataggagtttgaatacccatgaagccctaaaataaagaattttctcttgggaattagttttgtttggatatgactctctctctctttctcgcagctacatacaaacaacatgagatttataaagtaagaggagaattttcaaggtaactaaagtgccacttatgagaggagcatgaacagttttgaaaatggtgagataacccaggaagagagactgatttattggattatctttggctgatgaaaggcagactgaaaggctttaaaatactgcccacacgtgccctattgactcaggtcctctttacctggctgcaatgaggtccaggagatgctgccaccggtcgttgacctttcccagcttgtattcaatctcagatgctttgctttcatggctggctttagcaagtcgttctcccatttgttggagctgtattttgttctcttgagcaatagcaatttcctcttgataatcctgtgtaataaatagcaatcacagaggtcagaaagcatattcttaatacatccagcccagctctactagaaacatgatgattactgctttctactgcttggaagtagtttgagcataggaataccatgtggatatcagcccatgtgcacaagtattagtagtgcctattatttttggtatgtatgcagagttgggattaaatttttatatagaggttctcgaaataaataggatgctgcttcctatttacttgaaatacatattaaaaaacaataaaagatagatataaaaaataaaacttaaaagattttaatattggaaaattatagtttatttctctcatcactaacctgatgttatacttagaataaattctcagacaaatagttgctgagagacttataaaatgcacacacacatatatatatgcaattgatatataggtatatatataaatgtgaatgtgtgtgtcaattatgttatttgtgaggaatattttaaaagagttccttcattttaaagagataatcctctatacaatgtcaatattttgcagtaaataaatcaatgataaattaactttcaataataataactattaactatagagaatcgacaggcctcaaaccttcttaatttactcactttctgtgctagcttctcttagattgtttgagttaaagaggacagactccatatggactatttgcaagagataagcacgaaatggtgtgatttaactgacgatgaaaggacaatcccctccccctgactgccactgctatccccaatgaccctcttactctcttgccacagtgacaggatccagtctttaggatcaacttttttatttttggcttaagctcctgttacgtaataaatagtttctcagcaaaataatatatgaagacgggtattatatgagtgtgaacattttaaccttctcttggtctaaagttagtgtggtaacagagctatcctcccaagtcatttacctaagccaaagggccccaggggaatggtagggaccaacaaaactttattccattccagggctgactgctgtcctcatacctgcagccccacccaccctcctttttatgttatttcaacacaatgggattcaaagaccaatacgttgaatgtatttattaacattataatatttcagcaaacatttgagatgattttattgagaagtgtttctttcaagggaattactttaagacttaaaaagtatttataataaaataatcctcttggattgtctttaaaatcaaactgtttttgagtgttaataccaacagacactaatatcttggcttcaattttttttatgaatggcctttttctttttccttcatcttattagcacttcccagttgacaactgcctttttctatgttgccaaaattaccaaaccttgatgttattttcctttacaaaagagacgccacaaagaggaaaactcaaaagccctttaaaaaaaaacccatgagttattaatatacgaggtagtatagttaacattttaaataatattcctaacattgtgccaaacaatgtaataaaattatctatatgaaaagctgaaatttttctaaattttaagttctggttatagattgttcaagagatggtttttttccccacactctcacaatatacatcctaaatttagtaaaaaaaaagcaatgagaatagagacaaacttaatcaaaatttattctatagcaaattttactctactacctatagtgcatgaatcacgcactgacagcattctctgacacccagcaacttagcaaagggcaaccgtgagcagatgctaaaatgaaatctgtatcatctcagccaagagttttaagttttacaatatcaagtaaacaaatgcttatccatttggatttatccaatggataagcaaattggatacataaaggcttatctaatggcaaatccattagatttgtaacatcattaatagtacatgttggctttggatgttttaattttctatgtgtgcatatggatagaaataatttttcctaataaccatttatatttcttttcagaataaatgcagtaaatactggctgagtgcttatgagaagttaggcactgtttcaggtgcaggggatatagcaataaacaaaattagacaaagcccatgctcctggaaagctgacagatcagtggggtctccatttggacaatgaataagtaaatacaaaaaatacattgtacattagatggtgatatgtactaatgagaagcacaaattaaaataacattaaaatcactgattgttcacaagcactgtggaaacaacactgaaatcacccaattctttttttttttttttttttttgagacagagtgtcactctgtcacccaggctggagtgcagtggcacaatctcggctcactgcaacctccatctcctgggttcaagtgattctcttgcctcggcctcctgagtagccaggactacaggcatgtgccaccatgcctggctaatattttgtatttttagtagagatggggtttcactgtgttggccaggctggtctcaaaatcctggcctctggtgatctgcctgtctcacttcccaaagtgctgggattacaggcgtgagccaccgcacccggccgaaatcatcaaaaattttaaaatgctagcaaatttgatcagctttatatagacatcagaaatgttttggatccaaatgaatatgtaaaataatttgataagatatacatacctttaaaataatatgaagccaaaattatcaggaaactcttaattcctatctgtggtctataaatcatattttagagagaaaatgtcaattcaatttatcttaagaatgttttctttcagtttctctctagtggctttacctttttaaaacaaaaaaaaatacacaaaaaacaaaaaaaaaaggaaagaaaaataatacatataaagggttcctactgaacaggtaattaagacccccaaatactgaactgaatagtagatgctctatttcatcacaaattgcaagtattctatatattttatgtgtaaagcaggcctttttatgcaagtttattttatgctggatatccttttttttttttttttttttttttttttttgagacagagtctcgttctgtcaccaggctggagtgcagtggcacgatctcggctcactgcaatctccgccttctgggttcaagtgattcccctgcctcagcctctagagtagctggtactacaggcgcgcaccaccacgccaggctaatgttttgtattttagtagagacagggtttcaccatgttggccaggatggtcttgatctcctgacctcatgatctgcccacctcagcctcccaaagtgctgggattacaggcgtgagccactgcgcccagctgcaagtttattttatattaaaaagataaaatgtttaaaatatactgctcctttgacaggaaagtaattgtgagtaaagccaccttctgtacctgtgaaaagtacacataagccttatgaagaatgaaaacctaagtagccatgcattccataccttcttgagcttctctatcatttcttcaatgagaatgtctccattctgagaaactttgctttccatttgagtcaaccactcacagagttccttgttcttttcactgaagactgcccattcattcaatctttcacctatttgctgccgccttaaggagagctgaaaagtttaaaatgggagaataggcaaaatgattatcagagagaagaccacactccaaggaaaatagcaaataaactaggactaaaatgaatgatagtcatacatctttttagcccactgtttcctgaagtctaggatttgctattataaagtgggagacattgaatcctctagttctttcctgaagattcacatacacattagcttattaaaggttctggataatgcaacttcacacaattggttcaggatagataggatacatgaccagtgaatgtaaaaaagaaagaagaaatggaaaagagtagggaaagaagaaaggaaagaagggaagtaaaaggaaagagagatggtaaagaagggaggaaaaaaaaggaaagaaagaaaaaaggaatagaaagatgaaagaaaagagtaaaaatagggaaggaagaagaaaaggaagaaaagaagggatggaagaatgagcctcaggtatctagagagtgaggaagcgggcagcatccaagcgaagcggcctgaaatggaggcaggtgccccaaggctcagctccatactgacacgtggactccaggcaagttcctctacttctctgcagttttcatttttatttatttaattttgtttcttttccttctttttttttcgcatgacagatttattaagatgtatttcacatatgatacaatcacctgtttaaaaatgtacagttcagtgcttttgggtatattcacagcatttgtgaatcaccaccatcatcaattttaggatatttttatcattccaaaaaaaaaaaaaaagccaggtgcagtggctcacgtctgtaatcctaacactttgggaggccaaggcgggcagaatcctaacactttgggaggccaaggcggacagatcactagaggtcaggagttcgaaacctgcgtggccaacatggtgaaaccccatctctattaaaaatacaaaaattagccaggtatggtggcgcacacctgtaatcccagctacttgggaagttgaggcaggagagtcgcttgggcccaggaggcagaggttgcagtgagccgagattgtgtcactgtgttccagcctgggtgacagagcaagactccacctcaaacaacaatgaccaccaccacaacaatgaaaaccttgtagccatcagcagttactctactgctcctcctcacttacctcccagttctaatctcccttctgtccctgtggatttgcctattctggacatttcatatacatggaatcatacaatatgtagtcttctatgactggcttctttcacttagcatattttaaagattcacctatattgtagcatgtatcaatacttcattccctttattgctgactatattccattgtatgaatataccacattgcatttatcaactcatcttatttgggttgtttccatttttttgcctattctgaataatgctgttataaacatttgtgcacaagtgtttgtatgaacacatgttttcatttctcctaggtgtttatctaggagtagaatgtcttggtcatatggtaacactatagattgttttccaaagtggctgcccatttcacattcccaccagtagtaggattccaatttctctacatcttcaccaacacttgattacagccatcctaatggatgtgaagtggtatctgatgatggttttgatttgcatttccctaaaggctaacaatactgagactcttcatgtttcttagccatttgtatatctcctttggagaattatctactcaaatccgttgcctgctttttaattagattgcctttttattactgagttctgagagtttcttatacattatatatatacaatgggcttgttttcctatctctaggtctagaattatcctttccagaattctaaaattttctgatttcaaaatataatactcttgtgttcatagtgctggttgaaatactaaggaatgtttctagttgagttaaactacacgttggcaaaacataatatgatttggtaagaaggtctgaagacgttcttccacagtcttgttcataatgctagctattccactattcattccactgcattaaacatatccctattgattttattttacccccaacattttattacaaaacatttccgacacagaaaagctgaaggaattggatggtaagcactcattacatactccctgggctcaaactgttaacattttgctatattttgttttaagacattttccttccttaatacatttactttttatgtatttcaaacaaatttcctttttaaaatgaaaatgaaaatatttctaaggtattatacactttctagttatcaattctgtcttggatttgctctgttaatgattagacagataacacaaaactaaatatctgtgattctacatccttgtacactagtccaggagcccaggatacgtatcccaaggccagccttaggcatagtgagttgcctagagagtgagccccataacctaccataaattttgaaaggccaccatgagaaatttattcttttgattcaattatgatcttttaaagtaaaagtttttctgggttgggtgacactggtgaacctactaagtatttccccattagtataatttagtttctcattgaggtttttggaggcagaataatacagaacagtcaaagggcagtgaacttggggtagggcctactagaaatggaaaaagctaaggaaacagagatttaaaagttttggggacaaattttgtcactttacaccataccccaaatagcactgaagaacataatccttccaggaccccttacccctctagctctgagagccgcgtgcactctgatcttctgctgatctctcagattgagaactctctggtgaatacggccttttccctttcattcacagagcagcaagagtcaggagtctggctggtagttaaaatcccggttcaattgatggccaaactgaaactatactcttattatttggactgcccaaaataatcattgtctatgaatcgaagctgggcctggtggcacatgcctgtaatcccagcactttgggaggccgaggtgggcagagttcaagaccagccgggccaacatagtgaaaccccacctctactaaaaaaacaaaaattagccaggcgtggtggcagccatctgtaatctcagctactcgggaggctgaggcaggagaatcgcttgagcccgggaggcggaagatgcagtgagccaagatcacaccactgcactacagcctgggcaacagagtgagaagaaaaaaaaagaaaaagaatcgaaactcctgcccttcagactgaagatgaacaagtaactccttacactgcccccgaatcttggccataagccaagaatgaactctaggcctttactcaccaatatctgcagggaggatggtcccaaaatagaaaaatattacctattactttcataggtaagtattattatccccattccagagacaaggaatatgaaagttggacaaatttggggcacttgtttagaatcagtacaagataagaccagcaaagtttgagtctttgacatggggtgcaaatatgattaaatatccagaggcagctgatattcaaaaatagttcatccatcactgactaactgcatgatcaggacaaggtccctcattttctctacgacttactcctttcatttggaaattattcttatgtttgctccaaaaattcattaaacaaatgtttattgtctgtagtaaacaagtgtctctatgtgcccagcactgtcctatcaatatggtaatattagagaaataagagagtaatttaagaaattgactgatatggccaggcgcactggctcacgcctattatcccagcactttcggagactgaagcaggtggatcacttgaggtcaggagtttgagaccagcctggccaacatggtgaaaccacatcactattaaaagaatacaaaattagcagggcatggtggcaggtgcctgtaatcccagctacttgggaggctgaggcagtagaactgcttgaacccaggaggcacaggttgcagtgagccaagatcgcaccactgcactccagcctgggcaacaagggtgaaactctgtttcaaaaaaaaaaaaaaaaaaagaaagaaattgactgatatatattaaagacctgacaacagctggccattactatgctgttgctactagtactattatacatgactacagggcatcacttaagttttaaattttttttcctcccttgacactcatgtattccatatctccactaagcagctggattatacacatatatagatagatagatagatagatagatagatagatagatagatagataaaatatatattaaatcccttgtgtttatcacacaccatgaaaatgttgctttcattttcttaccacggagctacaccttaaaaaagacacagtgaggctacaagcactgggtgcaaacccaggccaaacgcttttcaaaagataagggcaatggcatcttccttctggtttgtacatctagtatttagtctatatactaagtaaacattaccatctctttctttggattcagatgaaccctcaaattatttatcagcttagcacctatttatgtttttgcaagggcacaaatacattgcattgccaacagctgagaagcaccagctaaaaccttcagagtgtgcagcagctcaacaggaaatacatccttttctggttgaaatatttttaccatgatgttttgacaaaacaacgagcaattacgatgatgacatatacttatatttcagctagaattacacacaaatctacaaaccaaaacagaataaaaacaagtataagctctggctgtacacaggcacaacaaaacatttgggctgtctacttgaaaacagatactttaatatattaactctgccctgcaatgtttactcacggcctctattccgcattctcatcgccagtcccaggtactccagactcctcatcaactgctttggtcagaataggaacagactacttgctccttagtagggataatgttatgttgaactcaagttttgacttttacaatgagacatgggcacaagctcatttccttttgtggtttcatacttgacagaaattcaccagaaacaactaactcaagaacgagaaactaatctatatcctccttagagttacatcctggcaccttgatcaaacccatgactaaactctcattggtttaaatattatttttcagactgaagtattaataacgtaagtacgctttagcttcaagcattaagacacttcaacatggaaagtttctaaaaacactatgtattccgtttgctgtttctttttaacgtcttagtctcctcacaggtgcaagttattaatctatttacagcatatcgcatgatcaacatcagcttttgaaatatattttcagatggctgtctagatatatctaagtctggagaacaattttacaacatatgaatgactactttagcaattaataatagcaataattccatggcatttttatacaacacttttcctaaatcaaaaagtattgcataaccataatcttcttaatcttcaaaatattcaaaatcttgtcattattttacactaagagaaacgtaagtatgaggaaatagaatcgatgccataatgtcttcattataaacaatacatcatgaacacttagctactctagacactgaagatgcaaagaaatggtctttgcatatcaaagtcctcatattcttggaatgaggtcacaaacattgaaaagaataataacacaatgccacataatggcacaaccaaaagagaaataagaattcagaggaccaagaacatactgagggctgagaatttcataagtgacatcacaggagttgtggaatgtaaaagaaaacaggttagaaaattagaagggaagaccgggcacggtggcttacgcctgtcatctcagcactttgggaggctgaggtgggcagatcacctggggtcgggagttggagaccagcctgaccaacatggagaaaccctgtctctactaaaaatacaaaatttacagggcgtggtggcacatgcctgtaatctcagttactcgggaggctgaggcaagagaatcacttgtacccaggaggtggagtctgcggtgagccgagatcacaccattgcactccagcctgggcaacaagagagcagctctgtgtcaaaaaaaaaaaaaaaaaaaaaaaaaaaaaaaaaaaaaaaagaagaagaagaaaattagaagggaagaaacagtgtcggcaggaagagtggcataatccaggtctttggggagggaagttcatggcatgtttgaagcaaacaggatccaatctctaaaatattatctctctgaaggcttcacaggcatcatttagctaaagcaatagatctggtctaattcaattcatcgaacatgctaaaaaatattaagagagcaggtagtgctagacttctcctaaaattaagaaaaacagatgaatgggctcacaaacgtaactgaaggttgctgtgataatttcccacaatttgtacccaccaaatatctttcattttgatacatcatgataaagtctttacattgcaaaattataggatgatttactgtataataaggtattgctttcagtttgaagaattcagaaatgaatcaagtgttgtgattagcattactaccctctatgcgtaaatccatgtaaattcctcattgtgttcactgagaaaatgaagctttgtgaaagtagccaaattcattttgaactcaaatcattaacatgttggtaaaagccatctcatacatgtatcccccgttttaaaaagtatatattcataggaaactgctcacacatctaccatgtgtgctccagagttttctgttggcccacggattgagaaaaacatgggttttcacctaaatatacagagagaaattttcctgaaaatacacttcttgttgatatcacatcaatcaagaggctctgagcctcttaaactctgtttaatggttcctgaagtatgaggataagcatctctaaagtcagagaaagggtggaggatgggagacaaaagagatcccagggcagcacaattggcagggacataagagtagggacataagagccccctctcaacagccccttcctcagtcttcccacaccagctttttccagccagttcctctgctccaactgccaccttgtcagagtgttcatttgcttcctcccatcaatcagtctcctccactccccttttcgaaactcaattcaaaatgtatccatctcaagaaacatttcctttattccttgccatccacactagccttagcttgcttaaatctttatacagtttgtgtgtgtgagagagagagagagagatggagttacgctcttgttgcccaggctggagtgcaatggtgtgatctcagctcactgcaacctccggctcctgggttcaagtgattttcctgcctcagcctcccaagtagctgggattacaggcacccgccaccatccgcggctaatttttgtatttttagtagagacagggtttcaccatgttggccaggctggtcttgaactcctgacctcaggtgatccacccgcctcagcctcccaaagtgctgggactacagtcataagccaccacacctgggtcctttagacagttttatacattgtttttacctgtttatgcctggttttcttcttaactgtacacattctcctagactgattttagtctcagatcaagtttaaacttgacgatagggacatttattacagtttgttaacatcacaattattaagatgactgatccatttaacagagatgtatcacagcctattatgtgccaggcagggcactcggggtatagaagtaacaaagacagggccctgcttcctggagaacataacctcaaggcatttgggtctgttcttcattatgagcctttgaatctgtttttcctctttgcctaggatgtcttctcgctgcctttccaccaatctttccctttcatttccaactcaaagtcaatctgggatatttttttaaaacgttgtgcacatagaaggtatttaataaatgaataaagtatgactaaaaataaatgaatataaattaccaggaaacaactacagtaaattaaaagtgataataaatattccctgaacaaaaccagctccacagtattagctaatgttgcaaatacaacagtagtttttcacgtttcaagtatatctacccagcaaaatcacatctgtgaaccataacattgtgctttctcttaaaaatattatgccagcggccaggcacggtggctcacgcctgcaatcccaacactttgggagggcgaggcggacaaatcacaaggtcaggagatcgagaccatcctggctaacacggtgaaaccccatccctactaaaaatacaaaaaattagctgggcatggtggcaggtgcctgtagtcccagctacttgggaggctgaggcaggagaatggcgtgaacctgggaggtggagcttgcagtgagccgagattgtgccactgcactccagcctgggcaaaagagtgagactctgtctcaaaaaaaaaaaaaaaaaaaaaaaaaaaatatatatatatatatatatatatatatatatataaaatgccagccagcaaaagtgaaagaaaaagaatccagtttaggtttttctaaaatgtggtaaaatataaatgtattgatctgaaatgttctggtagtaaccacagtgttcttcctttgtccgtactaagaattatgggccgggtccacatgtgggttaacccatctgacgttcaaattcatctcccaattttccatcatcaagataattccatttttagaacttatcttacctggtggcatagttcttcccactgcctttgcagaagctctacgcgttcattaagaatggagatatcatcagcactgatataggcagagagggtgtccttcagcaggctcaactgggtcaagtcatctgtccagctcccaactgcattttctaattcctaaataaaaaaacaaacttgaatacccacggacatctcctgccaatgatttctgaagtgtttttgaatcccctcttgatagaatttcctttgtatagccctcaatttaaatatctaacttgggatctagaggcacatcatggcaatattacagatttggttccagaccactgaaataaagtatatatcacaataaagtgagtcacaaattttttggtttctcagtgcatataaaagttatgtttacactatactattgtgtataaaatgtgcaatagcatatgtctaaaaaaaccaatgtacataccttaatttaaaaatactttattgtttaaaaatgctaatgatcatctgaggcctcagcaagtcataatcttcttgctggtggaaggtcttggctcaacgtgaaaggccattgactgatccagtggtgattgatgaaggctagggtggctctggcaatttcttaaaataagacaatgaagtttaagcagcactgatgactcttccttttacaaaagtttccttgtagcatgtgatgctgtttgagagcattgtactcacagaacttttttcaaaatttgagtcatcctctcaaaccctactgctactttatcaactaagtttatgtaatacttgaaatcctttgttgttacttcaacaatatccacagaatttttaccagaagtagattccatttcaagaagccactttcttgttgacggccataccaccctaaacatgcccaatcttgtctggtctcagaagaaaccactttttttattgatccataagaagcaactccttatccattcaagttttaacatgagattgcagaaactcaatcacatcttcaggctccatctctaactctagtcctcttgatgtttccacctcatctggagctactccctccaccactgaagtcttgaaccccctcaaagtcatccacgacagctggaatcaacttcttccaaacacatgttaatgttgacattttgacctcctcccatgaatcatgaatgttgcttttgtgaaaataaaatttatttttaatttttgtgggtacatagtaggtgtacatatatatggggtatatgagatattttaatagatgatagcaaagtaaatatggtattcatcacctgaagcatttatcctttgtgttacaaacaatccatttatacccttttatttatttaaaaatgtatgattaaactcttactgactacatttgccttgttgttctatcaaatacttttctattttttgtaaccattaaccatcctcatcacccctgcagcctccatgtaccctcccaagctctggtaaccatctttctactctctatctccatgagttcagctgttttaatttttaactcccacacataagtgaaaacatgttgaatgacagtggtgaaagtggacatccttgttgtgttccagatcttagaggaaaggctttcagtttttccttattcagtatgatgctacctgtggatctgccatatatggcttttattatgttgagctatgtttcttctatgctcagttttttgagggtttttatcaggaaaggttgaattttatcaaatgcttttcagcatcaatagaaatgatcatataacttttgtctttcattctgttgatctgatgtacacattgattaatttgagaatgttcaaccatcattgcatccctgggataaattccacttggtcatgatgaatgatctttttaatgcacagttaaattcagtttgctattattttaatgaatatttttacataaatgttcatcagagatattgttctataattttccttttttttttttttttgatgtgtctttgtctggttttgttagcagggtaatagtagccttgtagaatgagtttggaagtattccctcctcctctatttttcagaatagattgagtaggattggtattagttcttctttaaatgtttggtaaaattcagtagcgaagccatcaggtcctgggcttctttgctgggagactttttattatggcttcaatcttgttacttgctattggtctgcttttggatttcttcatggttcaatcttggcaggttgtatgtctctaggaaatcatccatttcttctaggtttcccaatttattggcatatagttgctcataaaagccgctaaagatcctttaaatttctgtggtattggttgtaatgtctcctttttcatttagatcttctctttttttcttagtctggctaatggtttgtcaatttatcttttcaaaaaataaacttttcattttgttgatcttttgtattgttttcttcatttccatttcatttatttctgctttaagctccattatttcttctactaactttgagtttggtttgctcttgcttttctaattctttaagatgcattgttaggttatttatttgaagtttttcttcttttttgatgtaggtgcttgtatctataaacttccatcttagtactgctttcactgtattacgtaggttttggtatgttgtgtttccattatcatttgtttcaagaaatttttctatttcctttttaacctcttcattgactcactggtcattcagaaacacatagtttaatttctatgtgtttgtatagtttccaaaattctttttactattgatttctagttttattccattatgatcagagaagatacttgataaaatttcacttttgtttgaatgttttaagacttgttttgtggcctaacatatagtctatccttgagaatgatccatatgctggggagaagaatgtgtattttgtagctgttggatgaatgttctgtaaatatctgttaggtccatttggtctgcagtgcagattaactccagtgtttttttgtttattttctgtctggatgatctctccaatgctaaaagtggggtgttgaagactgcagctattattgtatttgggtctaatgtctctctttagctccaataatatttgctttatatacctggatacatgagcatacataagtgacagaaaaccaaggaaaaaaattaaatgtatattattattattatttgagacagagtctcagtctgtcacctaggctggagtgcagtggtgtgatcttggctcactgtaacgtccaccacctgggttcaagtgattctcccacctcagcctctcaagtagctgggactacaggagcacatcaccatgtccgactaatttttttgtatttttagtagggactgggttttgccatgttgaccaggctgttctcaaacatataaatatatattatatatttatctgggtggtccagtgttgggtgtatatatatttacaaatgttataacttctgttatatcctctggctgaattaacccctttttcatcatataatgacattctttgtgtctttttatagtttttgtcttgaaacctattttgtctgatataagtatagctattcctgccctttttgctttccatttgcatagaatatcgttttccatccctttattttcagtgtatgtgtgtctttacagatgaagtgtgtttcttgtaggcaacagatcattgggtcttatgttttttaatccatttagtcactcaatgtcttctgagtttagttcatttatattaaatgttgttattgataagtaaggacttaatactgccattttattatttgtttttttctggttgtttatatggtcttctcccccttccttccttcctgtcttcttttcagtgaaggtgatttcactgttggtatgttttaatttgttgctttttattttttgtgtatccactgaatgttttcagacttgaggttaccatgatgttttcaaataatatcttaatacacattattttaaactgatgacaacttaatactgattgcataaatgagcaaactaacaaacaagcaaaaagaaaactagtaaaaactctacactttaactttgtcagctcactgcaatctttgcctcccagattcaagcaattctcatgcttcagcctcccgagtagcagggactacaggcacacgccaccccacctggttaatttttataattttgttagagacagggttttgccatgttgaccaggttggtctcaaactcctggcctcaagtgatccacccaccttggcctcctaaagtgctgggaatacaggtgtgagccaccatgcccagccatgttgtttcttatttatatcttatcatacttgtctatatattgaaaagttgtagttattatttttgatcagctcatcttttcatctttctacttaaggtatagtttatacaggccaggcgcggtagctcacgcctgtaatcccagcactctagggggccaaggtgggcagatcatgaggttaggagatcgaaaccatcctgactaacacggtgaaaccctgtctctactaaaaaaatacaaaaaattagccgggcgtggtggtgggtgcctgtagtcccagctactcaggaggctgaggcaggagaatggcatgaacccaggaggcagagcttgcagtgggccaagatcccgccactgcactccagcctgggcagcagagcaagactgtctcgaaaaaaaaaaaaaaaggtatagcttatacaacacaattgcaatgttataatattctatgtttttctgtgtatttactattaccagtgagttctgcaccttcacatgctttcttattgctcattaacattcttttctttcagattgaagaactccttttagtacttcttgtaggtcaggtctgatgttaatgaaatcccttagcttttgtttgtttgaaaaagtctatttttccttcatgattgaaagacgttttcactggttatactattctagggtaacaggtttttttcttcagcaccttaaaaatgtcacctcactttctcctgttcggtaaggtttccactgaagagtctgctgccagatgtactgaagctccattttatgttatttctttcttttctcttgctgcttttaggatcctttctttatttttgaccttcgggagtttaattattaaatgccttgaggtaatcttctttgggttaaatctacttggtgttctataaccttcttgtacttggatattgatatctttctctatgtttggcaagttctctgttatccctttgaataaactttctactcccatctctctttctacctccttttgaaggccaataagtcttagatttgccctcttgaggctattttctggatcctgtaggcatgtttcattgatttttattcctcttcatttgtctcctctgactgcgtagcttacttcaagctcacgaattctttcctctgcttgatcaattctgctattaagagactctgatgcattcttcagtatgtcaattacatttttcaacttcagaatgtctgattgattccttttagttatttcaatttctttaatttatctgatatgattctgaattcattctgtgttttcttacatttatttttttattttttatttttttgagacagagtcttgctctgtcacccaggctggagtgcagtggtgcaatcttagctcactgcaacctccacctcttgggttcaagcgattctcaggcctcagcctcctgagcagcttggattacacacatgtgccaccatgcctggctgatttttgtatttttagtagagacagggtttctccatgttggccaggctggtctcaaactcctgacctcaggtgatccacccacctcagcctcccagaattctgggattacaggtgtgagccactgcacccagctcaaaagagctattttgaattatctgtctgaaaggttgcatatatctgtctctccagaattggtccctggtgtcttatttattggtattttttgggttaggtcatgttttcctgaatggtcttgatgcttgcagatgtttgctggtgtcttcgtattgaagaattaggtatttattgtagttgtagtcgggacttgtttgtatttacccttcttaggaaggttttccaggtatttgaagggacctgggagttgtgacctaagtttttagtcactgcagtcaaatctgcatcatggggcaccccaagcccactaaaactgtggttcttgcagactgatagaggaaccaccttggtggtcttggataagatctggaagaattatctggattaccaggcagagattcttgttctctttccttattttctcccaaacaaacagcgtctctttctctgtgctgagttccctggtactggtggagaggagagttacaagtacccctgtggatcccccaccactactggaactgtactgggttaggcctgaagccagcacagcactggctctctcccaaggcccactgtaaccactacttggctactctctatgtttggtcaaggccctaggccatacaggcttgtgttcttctcttcagggcaatgagctccccctggccccaggtggtcgagagatgccagggcttggagttggaaaccttagaaatctacctggtgctctgttctactgcagataagctggtaccgaaaccataagaaaaagtcctttccactcttcccttccctgtcccaggctgaggagtcgctccccaggtccactgccacaacagaaccgtggggaatactgccaggccattgctgatgtttacattaggcccaagggctcttcaactcagcttgtggtaaatgctgccaggcctggaacttacccttcaggggagtgggctcccctctggcccaaggtagatccagaaatgccacccgagagccaagtcctggaattgagtacccctggagcctctttggtgctctttcctgttgttgctatgctggtacctaagttacaagacaaagtcccctttgttcttgcctctcttttttgtaagcagaagaggactctcttcatagccaccgcagctgtgaatgtgctaggtcacacttgaagccagcatgtctccgaatctgacccaaggcccacagtgtgtaatacctggttacactgctgactatccagggcctatgggctctttagtcagccggtgataggtcttaccaggactaggtccttcccttcaatgcagcaggttctcttctggccaagggtgtgtctagaaatgtctggaaactagggcatggaatgaaggcttcatgactgtgcccagtaccctatcttactgtaattgagttggtatccaagttgcaaaacaaagtcctctttactctttcctcttttctcaagcagaaggaaggggtgtcttttggagctgcaagctgtattgcctggggttgggggaggattggcacaacaactcctttagctgtcttcctggtgtgtcaccgggtcatgtacccccaagtccactggctccaagcccagtactgcactaggacccacctaggagtgtagtacttgtggcctagacagcctttcaaatttatgtaggaccccagagcattttagcccatggtagcaagtgcttgtcaaaactcagattctgttggctgggatgggagcttcccctttggctaggtcttgtgtaaatgctccctccgtgggcatcagctgagttctgcctggtattggcagcactgagctccaatgcaatgcagaccaactgctgggctctccttcctcgatatgcacagatgctctctccgtgccatgtggctgctgctggggcaccgaaaagaagaggtggtgtgggcaatccaaggttgtctttcctaccctcttcattgcctctttctgtactatgaagttgaaatcaggtaatgtgattgctcacctgattttttattcttatgaaggcgctttcttatgtagatagttgttacatttggtgttcctgcagggagaacagtcagtggagaattctactcagccatcttgttctgcttcctcaggtcaaatcgggaatgttcttactgccatctgcaatgacgaatcctttccacagggttttccatttactttgcccagatccatcataggaatcactatctatggcagctatagcctcacaaagtgtatttcttaaataataagacttggaagttgaaattattccttgatccatgggctacaggatagatattgtgctagaaggcatgaagacaacattagtcttgtacatctccatctccatcagatatctagggtgactacgtgcattatcaagaagtggtaatactttgaaagaaagccttttttttctgagcagtgggtctcaaaagtgggcttaaaatatcagtaaaactgtactgtaaacagatatggtgccatctgggttttgttgttctatttatagagcacaggtagagttagcataattcttaaaggccttaggatttccagaatgttaaatgaacactgactttaagtcaccagctccatttgcccctaacaagagagttagccttttctctgaagctttcgagccaggcattgacttcttttaagctattaaatttctcaatggcatcttcttccaacatagggctgtttgatctacctctagcctgggcaacaagagcaaaactctgtcaggaaggggagaggaggggaggggaggggagaaggaaggaaggttaaaaggaaagacggaaagaaagagggaaggaaggaaagaggaaggaagggagggagggagggtaaccacttccatcaatgatcttagctagatcttctgcataacttactgcagcttctacttcaacacttgctgcttcaccttgcacttttatgttatggagatggtttgtttccttaaaactcatgaaccaacctctgcctgcttccatcttttcttctgcagttacttctcctccctcagccttcacagaattaaagggagttacgaccttgctccagattaggctttggcttaaaggaatgttgtggctggttggatcttttattcagaccactcaaagtttctctgtatcagcaataaggatgttttgctttcttctcatccatgcattcactggagtattacttttaatttcctttcagaacttttcctttgcattcacaacctggctgtttgtggcacaagaggcctagcttttggcctgttccagcttttgacatgtcttcctcactaagcttaatcatttctagcttttgatttaaagtgagagacatgagatttttttcaattgaacactcagaggccactgtatgaattggcctaatttcaatattgttgtgtctcagcaaataaggaggccagaggagaaggagagagattgggaacattgttggtggagcaatcagaacacatgctacatttatgaattaagattgctgacttctatgggcacagtgtgtggtgccactaattacaatagcaccatcaaaggtcacactgactgtagatcactgtaacaaatataacagtaaagaaaaagtttggaatattgtgagaattaccaaaattatgcagacatataaagtgagcacatgctgttggaaaaatggtgctggtagacttgttctatgcagcaatgccacaatcttcaatttgtaaaaaaaaaaaaaaaaaccaaaaaacaaaaaacaaaacataggatctgtgaaacacactaaaacaagtgcaataaaatgaggtttgcccatatttcatttgcttccacataatttgataaattgctaagtccttctgataaagtatgattgcctgcagaatctttctgccatctactcatcattttattgatttaaaatttttttttcctaaattgaagtttaatcactgtattgatcttctttactttagactgacttcataaacctctaacttatcctttctttttgtcctgaattgctgatcacactgatgaaatatttttaaaaacagacacctaaatttaactttcattttcaagcactatagagttgctacattctgtgatctatacttataatgtaatagctgagaagatctgttgctgttactactcaatttaaaacaatgcactgaatacattttctgcaggatcagacatttctttaagttactaaaaaagattatgtaccctgtcttttaggggaatgatttaagaaaaaaaaattcatatagcaatatttgaatgagttgacattagtttttacaatattttgaccaattaccagttttgcaatttgtataaccagctgttgtttttagattccagctagttttgtgtataaatagagtatttcatgtgccgtttcccctccctttatgtgtctttacacggtagaaaggtttccaaaggcaatggcaattagcggtgctgtctgaggctaacttcccaagcaatttaggcaaacaagattttagcctgaattttccaggtaattgccttgttttgctgctaagggcagtttggggaagagtagcaggactagacgaaaatacattttttaaatctacacactcaatagcagcgtgtgtttgtaactgtcatgttttttgggagataaaaaatgacgccccatggcaacagtatttggctgaaagaccaaaccatctaggttaattaaatatgcaacatttcttctaatacttctaaacatattcaattgttataccactggaaagattttccacttttcacaccgatttctacccccccaactcgagcatcagatttgtatatggatttaacaaaagtacataataacaccaccaccaaaaaccaactgtttcagacgcacagtataccaaccccttaaacgagtcagtgtggcaaaaatatagcctgtagatacaggcaacccagatatttactgactttgaaaagttattaaatttccagaggcctcagttttcccttctgaaaaggggcaataataaatgttttcacgagcttttgttaatgccaactgagataacaccaatatagtcacagcccctaataaatgcccattcctgctttgcagaagttttctttaataatttttaatgtatttatttttttacagacagggtctcactctgtcagccaggctggatgcagtggtgtgatcatagctcactgcagcctcagattcctaagtgatcctcctgcctcagcctccccagtagctaggactacaggcaagcaccaccactctggttaatttttaaatttctttagatatggagtcttgccatattgcccaggctgatcttgaacatctggtctcaaatgatctgtttgccttggcctccaaagtgctgggattacaggcatgatccaccacacccggcttctttatttttaataaatttatcatcacaggttcaaaatgcgctttttaatctttgtaaccattgcatacttctgaatgtaacagctcaagatagtacttctttcactttccatccatgatgtaaaatatactaccttttaactttcctaaatctgcctttttcaagtttcaaataatatccttagattttacaactgaagaaaaaattcttatagccacacttttcatgatttctagacctctttaacaattatcatctcttaaatgcttaggatttctttgccaaagtgaggcagagaatttctaattaaaacccaagtcatttaagtatatgcgaatttttaacagaattaccctagagcaataatttgcaaatgactggggaacacaagggcatgtttaatttgaaagaaaaacatttttaaaggtacgtttgatatgatcagcctattgctcagcaaagaactgctgtttggacatttcacttggctacaaagatgtgaaaggcatgaatcttatagccactgaattgtgttggtctcggtgagctcataatccagggagtgatctgtattagctactgacttgcttccaagtaccatttgaagtgttgatcataatctttaagtacttagagccctgagcaatttagggattgtgtgtctctatgcagtcactgagataagctatttttccccctttccttgcataatggtctagagggcagggtgtgttctttggagggccactgtctgcagattttccaggctgttgatccttttttttttttttccttcttgtagactcgattcttctggtagaatgactccccagtgtggatgcttcaaaaaaaatgactttattgctcttgactcagcttttaaatatcttttaatgtgttttaaattttcatttgcttccttggagtaatccataaactagtctataatttcatcaactgcaataaatcagccatacaagtttcacctgagttgcctgtccttatgtcatatactaggatcttgtatctgcatgtagataacctaagagtttgactggattatggccccaaagacattccagcagaggcacacaggtgacggtgaaaatctcagttcagtaatttaccttgcaacgcatttgttctgcatggagctcttcatggtgatccgggagagactgcgaaagcttctttttgaaagttcgtagtttctccagggaatctgctattcctttctcacatttttcccagtcctatcatgggaataaaaacaaatagcatagatgtttttgatgtaggaaactggggggggaaaagaaaagaaacactcttcttcattcccagagaaagaatgaaagttacactgatggctgagtgtggtggctcacgcgtgtaatcccagcactttgggaggccgaggcgggtggatcactcgaggtcaggagtttgtaaccagtctggccaacatggtgaaaccttgtctctactaaaaacacaaaaattagccaggcatggtggcaggctcctataatcccagctactcagaaggctgaggcaggagaattgcttgaacccaggaggcagaagttgcagtgagctgagatcacaccactgcactccagtctaggcaaaagagcgagactctgtctcaaaaaaaaaaaaaaaaaaaaaaagcaaaaaaaaaaaagaacaaagttgcgctgatgaacaatatgaaggtatgcccacactcattgccaggggaggcaacatgctgttgtcatcagaagagctgagttcaaaactgactctgttactgactatctgtgtggctttaagcagataatgctctatgtttccattttccctacgaaaatggaaaaaatacaaactctccatatttattggagcccaaaggaagcaatgagtgtcaaggcatcaagcacaatgaccagaatattatgggtatccaagaatgttatctgaatccacatctatctgcagaggtaggactataatctcagtaccttgtctctttcttaaccccatccataactacacccaatgtctaccctttcccaaatgtactataagggatttaaaaaaaaaagaggatatggcatgtcttacagaaagagaaatatgcactacaaaagcatggcatttttgactggctttatcttgttcatgctgaaacatatgtagcaaaggattaaatgtgtaatatataaaaacccatgtaaattaagatgtagaagaagagagataatgcacaatttaagaaatctatatctaatatgcaaagtagcagtaagtgctctggagaggaataggccagggcaggtggtagagataggcagtatagaatgaggtagagctctatgtactgacaaaataaaacatctattgtgtggttatgttttgaaaggttacacagcaaactggtaacaatggttacctcttgagaatataggagaatttggatggcacaataagggaaatttcattttttactctgtatagttaaattattacctaatttttaaaaatcagacacacgtaatttttttgtaataaaaaagtagaattttaaaaaatgacaggaaccacagcagagcttgatcttttttatagcaccttatctacacattaactcctatccggtgtcttagtgccagtgaaaattaatttcaactaaacaagtctccttcatgttgtccaacactgcccgtttgtcaaactctccaatccaggccttcctgctccccactcatctccccagtggccactccatacaccgtgaattacagaattccaaagcaagacaactagaatcatgactagaatcacttttagttgtcaatatggtgtcaaatcatgttccatcttccttcacaatatctcttccattatcatcagtcttttcttatctggattatttctacttctctcctgacaccttagtttgagcataacaacccagaggtgttattaccacaactattttctggaagcagtgttgactaaagtgcccccttactcaaaatgtctttattcaaaaactgaactgagaatttggcacaagtctcatttctctttaaaattccttcatagaacttcttagagtgcataaccacattccctcttcccaattaccagaaaaaaaaattcttaaaaaacaaaaaaaaattgtctatcagggacagagttgttcaaattctcctttgttttatgctttgtgttcccagggctacaattagcttatcaatgctaaccatagtgagggtagacaaaaagtttctctttctgcttaaattaaacaacattctcaataaaactatcaaacatcctgaattgatcaacatacagttgataaaaatttattgatctaaaagagataagatcatcacgggtgctgtgacccacacctataatcctagcactttgggaggccaaggaagggcagatcacttgaagccaggagttcgagaccagcctggccaacatggtgaaaacccatctctactaaaaatacaaaaattagccaggcgtggtggcgtgcacctgtaatcccacctacttgagaggctgatgcacgagaatcacttgaacccagaagagtggaggttgcaattagccaagactgcaccacagcactccagcctgggtgacacagggagactctatgtcaaaaaaaaaaaaaagaaaaaaaaacaagaaagaaagataaaaaagatcagcttcttacttttcagaacaaaattaagagatgatagtgaagaaggtgaacatacagagcatggaattataatgcctatatttggcatacttactaacagtattaaaagctaaatatagataagtattatagctggggtaaaaaatagactaaaatgaggctatataaacatcaaaattcagattcataaattccttcttaggcaaacggatgtagtgtaaaagtcaaaataaaataaactttaacaagaacagaagagggattcctctttccaaggatgacttagattctaaatctataaccaagtccttttatgacgtgaattataaggaaataacttaatgtcatgagcctgcaaatatctattaaagtggatgttttctacaccaacaaacagacagacaagaaaagcaaatgtagtgactcagacatcatgccttattaagtcttggaaacatctccaaaaatcacatcacaaatttaaaaaaatatatgattaacatgttctctacaggatgagttacaatgttttaaatcctttcctaaaagcaaaaggaagaaaatgaacctggcatattacattactgatgaaactgtgctgtgtgcaaataatagttttttatagatgtccagtggcatttttgatggattgcttactacacagaaggcaatatattattaaataaaattcaatagaataaatccaatgggtatgtatgcacactttaagcattaaaaaaaaaaagcaaaatcttttctattaaccttagtcattacctttgatccaaacatgtgacaggccaaatttaatagataccctcactgaagtgttggtgattatcaacatatacaggaccataacatttaggtgtctttacttttaaagattgtaataacatcaactatgataatcactatcattcatttagcgctcagtatgagccaggtaaggtaccacatgattcactatcattatttcattaagtcctcacaatggccacatggaggtggtgaaattatatacccactctaccgatgaggaaactgaggcttagataggctaagttaactgggtcacttggtttaccatgattttaacttgagattatcttattttagaggtcctgtcctttttaaactgctcatttaattatgcattatacatgcaattgaagagtgagagagaaaagcatattgtgggaggtccggataaatctacattttccaaaacttactgtgtgatcagtatgtgatctgtatccaactaagggcttaatacacctcctggagattttatctcatggcaacttgcttggatcagctaagataaattaagagtatctttctggattggtttttcccttccataaaagaagagataccaatcttgaaaaccactttagagtctcagattagggagtggaacctaccctttgaatttctgtgtggatttataaagtcatcacatggctaaggtttcatactggtcattaatcagaattcatagcttagacagtcttattagactttactttgttgggaggttgtcctgaaaaattaaatgctgaaaattgggaaacttttccagtttgtgcaagataagacaaagtcttaaataaaacacagagaatcaaaatactgcagggtattatttcatgatctttgcattatttgatttgtagaataacaatgggaggaagtagtacaacgactaaaagggttttttggttcgtttttttctaactgaacttactttcaacaagaaggctagttttttcttctgttcttccagccgcatgctggctgatttccatttctcttggatttcagcgagttcggcctgcaaggcggcctcagcgccactgtccgccgagagaaggagttgcttgccagcctccacagtcaggatgtagctgccttgttgccgcagaaacactttttctttgaactgaaaggaaccatagctttttattttctcattctttctttcatcgtttccttcccataaggatttttaaatggccctaacttttgccctctttcatccagcaagcatttaccgtagtggtgctttgcacatgcatgcaccagtgaataaatgagtgagaatacaatggagacaggcttagtttctgtctccaaggtaagtacgattgatgtaataagataaccactctttaagattgatgcgtggaaatacagagggacatctgacccagcagggggcgcaccaagaggcagagaggcttcctcaaagcagtaaaggctgaatgtgtcttgcgagacatgaacttcaccagattaagaaggacctggtgcggtgagatgagtgtgatcaggagtggaggagaggccaccttctcacagagaaatgaggatgcgcacattcactatatgagaaaaatatgataaattcaggaaactaagtatggttttcagtggctggagtgtggatggcatgtgagagagtggtaggagatgaggccagacgacatcttgcagaaatttggtttttatactaaaagtgactggggttcacagaagaatattgatgttgggattaaagttttcataaaagcactcaggaatcgagtaaaagtagaatggaagaaggatgtgtgttggatatactaagattaggaagctattgtctatctgggcaagaaatcgcgagcacctaaccaaggcagtggcagcagggatgtagagttagggagattagataaggggatgatagacaaggagaagtatagctctcaaattattctaggattcctagactaatggcacttcctggaagtgtgatgggaaagggagaaaagttggtccagagaccacaggttctgctgggacccacagggtacaaggcatctgtgatgcacatagacataaactcacaaggtggttagaaacacaagtcaaaagcacagcaggtaaatatgaccagaagatatgaatatgccccttctctgctggcagggggcagttgaagtcatgtctgcgaatgagggctctcagagaaatttggaggagaaacgaacgaaagaacagtgactttaagggaagaggaactcattggatacactggggagaactcactagagtgataggagatatctctctaagatgctagaagcctgaaggtaaggggcaacctggaaatgaacaaagaactcaaacaggacagggcttcctgtcttctttggaatactcaagttacgtgtttaaattgctcaagaataaaatgtatgcaagcaacatgaagtttttcttcccttgccattaccttttcatccctgctgggatttagtgagctgcggcaggccatagtgtgtgaagtgtaagcagcctttgtgagaggctggggcttactatcatttcaccattagatatgggctttgtattgcaatcattttgtatatttctgttgacatttgagaacaatgtttgtcccagctgcaatgtcactctagagtccttttgaaaaaccgaggcgaaggtaaagtgtgcggtggaaatgcctaagaggtgtgagaacactgtgttttgcatcttacctgcacttcatcaaagagggtccttgcttgttgcagtggtataggaacacttccgagaccactcatggggaggtaggacacttcaaccaaccatttacgaagcttttctgccatctccctatagcgctgccactggcgaatctggctgtcaatgatcccccgcctctgctgggccctgcgaatcactccctgccattgattactgaggagtgtcaatttcaggttgaattcatccctagtgaagaaataattacatggtaaaaaagcactgttatcttggatgcagttacgcaatcagccaatgtatacactgtcaacaaccctaagccctgagaagtgatctagggcggtggtttttgaatatcatgccatgatctcttactgggttttgggtctattgcaattaatttttaaaattaaaccaccagtgtttgcaaatggtgagtgttttcatgtctcagcataggttgaaggcaaatatacaataaggtcattgtccttcactgtctccctgagagcatgagaggggaggagtggacagctgcaggtgcaacgggaatagctgcaaatcctaagcagctccatagcaacatgtgcagctcgtgatgatgatatcatcttgtgggacacactgcaggaaaatgtgtggaacaaggcttatgtagaacctctgtcttcagttcgaatcataagccacttgaatcaaattatgtaatttaaaaagattttttaaaaactgtactccataaactctctcagtattccctcacaataaacagccccaacctttagcaaatcattccagatgttcatctgaattatctcttctacattgtaggctgacttcactttattcttagaaagatgaaaacttgttatcatagtctgtataaatgtcattaatatatttagaaataataaattttacttaagatttctcaagttcaggctaaagtatatcaggtcttctaatgtgttcttacctctctgttttctggctttaaaaaaatataggtagttctttattacgttttatttaatatttaatttatggctctagaactggctagtaagagtctgtcccgcatgaaacagaatgagtttctatgtagattacagtgttattcacacctaaagtgcaagtaatgttgcactttaatactaaacacttgcacttctctattacaatagttttgcttttcttcctcagatatactatcctcttctcttgagggtagcatcaactttgaattggacttgctattgtgaacttgtatcttcttgaaacttcctattatccagaaccactataaactttgattttgtaaccaaatatgctgttagtcctagaaacttatttaatgactcaacttaaacaaaaggtgaataacacccagacaacgtcaacaaaacaagtattaaaaataaaatgtactaagtaaagcctctgcaaaaaatttcgtatgccctctcatcttaaaaatagatccataatgggccgggcccggtgactcacgtctttaatcccagcaccttgggaggccgaggtgggtggatcacctgaggtcaggagtttgagaccagcctggccaacatggcgaaatcccatctctattacaaatacaaaaattagccgggcgtggtggtgcgtgcctgtattcccagctacttgggaggctgagacaggagaatcacttgaacccagaaggtggaggttgcagtgagccgagatagcgccacttcactctagcctgagcgaaagagcaagacgctgtctcaaaaaagaaaaaaaaaaaaaatccatgtgatagctacttagattttgatgatgacttctgtttttgaaaggaaattttgctgtattaatcaatgtactagcattcaagtgtgatgaattaggttcatgatacttccctaaaagttacaagcatctgtcatcgcagaaaatgtacaactccaggacttgagaatatcgtataatcttgctttccctaccaggtaaccatccaaggcctcttaggattccccaccctctcttgatacaaccaagctgtcccaaactacctgccagcatgaggaattacttaaaacatgacactgttccctgtgctgaacttgaagctctaaaaaacgtaactcataaattaactttcagaacaaaatacacttgcaatctgaggccttcttattgtcagtaggctctaatctgatttttttttcccttcaactttcaaaattctttaccctcaagtctaacctcccattttcatctctttggtgtattttccctaaatgttagtattgaaaagttaatagatgctggcttgcatgtgagtatttaatttttattttacttaatgactcaaacatttataatattgttatagagttggctaagaaatgataaagcaaaagataaaagttaattgtatttgaatttgttttattttcaaggccttaaattctcaggaaagctcccatttaagtttggcttacttagagtagaataaatataatatcacattctgttgttccaagcttaaccatgaagatcttttatgtacttccaaagaaatagccacttaaaactgaaattgcttctacaacattaaagacaaaactctcaataaaaataatttattttttattttttgaaaaaatatcaaattaattttagtcacaactactggttcctaaatatgagaaaggtatacatatgtaatagaacacatgaggctaatactccaaatatcaccacggaaagtcgattagataaagtaaatattgttcctaggaaatgtaaatatagtatgaaattgtcatttctcataccataaatctggggagaagctaaatttttacctctccatttttaataaagagataatttgctattgtaaatgaaaaggaagaaaagatttcaggcggcatgtaatctgacttaaggtagcaaaccattttcaaacacagaattctcatggcatgagaaagctggctggtatgatccagtactgactgaaaaccagacatgagctccaggcctgattctgctgctacttagttctgtgaccctggtcaaatcagttcacatttgtggattttgggtttttcatctgtaagtaagagagatgggctagtgatctctatgctccttttacaaaaaaatttctgtaattatataagaatattagaagcatctgtttacaaaccgttgataggtcattgatatggttcatgctgatctattcattaattccatttcctacagatgactagtgaaggttggctaggtgatttccaattactctatgcccttcatataatataatagcagctctccaaaaaagattcaatactcattcatttcagagattgagacaagtttctcctccaattactgaggccccactacagttcaattgcctcaggaagattggatatatgccctccaatctgctcattaaaaagaaaatgactaatttactggaacctttctttgtaataatttatcaaagatcctacctgtcatcaacttgaccttgttctagaagacgttgcccatcaataatgattgagtgcaaaatctgctgacgactgaacatctcggcttgaaacaactataatttaaaaaaaagaagaacatactttagagttcctaattttagtgatcggttctctgataactttccaaatattctagttttcgcaagactatgaaagctatcaccagctgaaccagaaaatgtgtgaaatcctgcagtttaggaatcatttatttttaaatcatcaattaagatacactcaaagataaagtttagtgtttggtttactaaaactagatgaccaaaagtagaattatatttctcttctttctttcaaaaacacctaataaagtaagttaatgcacaatttgttttctggtttattttgtatataaaatatggtccatattcaaaacttagagaatagcttaggaccgttaaagaagtcaaagaaaaaaaatagcctagtctttttctgtcttttaaaactcactgtttttaagttttaaattttaaaattaataaattttaataaatttatttcactattttaaaaaactcaagagaaggtccttcgaattatttctactgttttttaaacaactttattgagtaacaattcacataccatacaattcactcatttaaaatgttcaatttagtggtgtttattatatttacagactttacaatcattaccacaatcaattttagaattttcattgccccaaaaagaaagtccatcctcattagcaatcattccccatttcttcccaatcctccagccttcagcaaccactcatctattttatgtctctatgaattacttactctggacatttcttgtaaatggaatcttgcgatatgtagtcttttgtgactggtttctttcccttggcataatgtttccaaggttcatacatgttgcaacatatatcagtaccttattcctttttattgcaaatagtattctattatatagacatttcacattttatttatccatttatcagttgatggacatttgggttgtctccaccttttggctattatgactaatgctcctataaataatgtacttacacaagtttttgtgtggacacatattttcatttatcctgagtatatacctaggagtggaatttctgggttatatgattactctacgtaactctatatggtaactctatgttaactgttttccaaagcagcttcaccattttacattcccatcagcaatgtattagggttccaattcctttacaccctcaccaaaatttgttattttttcattatagtcatccttgtgggtgtgagatgcaatctcattgtagtcttttttctattatttcatcatctgtcaattcaacaaaactggatttaaaaataccttagatatctttaaattttctatttaaaaaattctgaattaagtttttcttttctcttaggtaagacctatctctccatgtgcatatcattcataaatacacaaactgacttagttataccggtaaatagcaacataaggattaacagtgggcaaatttattaatttactttgtgtatatagttcttctccctctttgtttcttaagaaataattataatgcaatttaatcaagaggtacacctggagacatttgatagattgatttcctggtataaaattcatatacgctctttgaagatcacaaaatttttaaagacttttgatcaaagcatagtctcttaagcaattgtccttggcatattaaagtagtctctaacccagtttgaaaattgtctaactatctatacacgttccaccaactttgcctgtctcgagtaagtagcctttaaccacaattctggcattatactttacaaggaactgaagattgacacgtgcttataaacaatcatggagcagcgaataggactacatttttataattaagttatcaaaacctcaagcttaagaaagaaggcaaaatgatgcatgcatttagacactcgtgcaaagggcatgattttaattctcccacacagcatttcgtagcatcttctaagggcctaaaaatttcttattacccccaaatctactgatacaacttacctcgtgtgctctctgctgttccaaaaggtgctgataatttcctgaaatctctactgctaacttttgttctgtctgaactaggaattccatccatgtttcacatttttccaagaaagtctgatgttgtagcaaaaatgactgcaacttgctgaaagaacaaagggcaaggaacaatggttatttcactgcttattcttacttctctagcatataaaactagattaaataatctctgtgctcaattctaattgaaccaccacaaagctttcatgtcaggtggtaaaattattttaaaaaagaagaaagaggccagttgcagtggctcacgcctgtaatcccaacactttgggagactgaggtggacagatcacctgaggtcaggagttgtagaccagcctggtcaacatggtgaaaccccatctctactaaaaatacaaaaattagccgggtgtggtggtgtgtgactgtaatcccagctacttgggatgctgagacaggagaattgcttgaacccaacattgcagtgagccgagattgtgcctttgcactccagcctgggtgacaagaatgaaactccgtctcaaaaaaaaaaaaaaaaagaagaaagaaagttgaaaaaatgtagaagtttaaaatgtacctcttttaaaatgataaaaattatgtatatacttttaatatattctcacttaaaagagttttctgattaaagtgctatttagtacactaaacatgagaaacgactttacaatttgaatttcccacttttagttcaaattttgtcagtgttatgggaaagatcagaatttataaacatacacaagtcatgagcttatattctattgatacattggtgctatggtgtgaatgtatcccttccataattcaggtgatgaaacttcgtggtgaatgttggtagtattctgaggcagagcctttacacggtgattaggccatgaggactcctcctttgtcaatgggattaagggtcttttaaaagaagattcacacagcgttcagcactgttgtccttctgccttccactgtgtgaggacacagcaactctcccctcctgaggatgcagcaaaacctgccctcttgaaagcagagagcagccctcaccagacaactgaatctgctagcaccttgactgcggacttcccagtctccagaactgtgagactgttcaacatttctgttctttataaattatgcattctgtagtattttgacatagcggcacaaaccagactaagacaactggagcaaccaagacatctcttgtttactctacctgaatctttctgtagtctgagaggagatcagagaccaatggcggttcagattctgcattcttttgatttccttatcattcaagggtaacctatatccaagctcatttagacggtctaaatctggagccatgctgctgaattttaacatctgtccctagaaggaagatttaaaagtaggtttagcaccatggtcaaaaaagtcaaaactttttcaaagtgcgcagtgaatttctgatttcaggaagtagctggtcttcggtctagtggcctctgcatttctaggccacttacttacaatctctaggtacgaatagcgaaaagccaaatctacttttcagtctaaactgctgctgctgctgctattgctactcaagctactcattatcctttatggactacttaacgtgtattctgttatttacttgatatattatttacttgtatggtttatacatacaaatatattatttactttatttacacgtattatattatttacttgatttttattacgtgtattatattacatatactatttacttgatttactcatatgtaattatattacaagtattatattatttacttgatttatttactcataggcaattcttgacagaactgattaaggatgaaaattatgctgataagtaaaagaccttacttcttaccatttacgtttaatttgttcatgctaatttcctcctttattattcacaactaacaaaagttataacagtgatagctaacgtttattgagcacttactatgaatcaagcactgacaagagctttacaagtaagaactcattttatcctcaaaacgatcacataagataagtcatgctgctattctctctttacaagggaggaaagggaggcacagaaactaagtaaattgctccaggccagccagctagtaaatggaagagggtaaacgaacctccttgggttcttgctagagaaaataagatttcacttgagctatgaagtgaccacacattttaagagctccagttttaggtctctgacccgccaccccacagctggtgagactcaatcaaaagagcaatctattcttttggatctcttccctcccttcaaacacaggacaatgttgtcggttctgattttcccatgggtatccttatctccatctaggaaattggttacaggaaagaaaaaatgtcaggccacctttggctatgtgtgtgtcttctctttgcatgttctgcaaaagactcatgttttttgaagaaagaataaatctcaaatattgaaaccaaaatataactgttaaatggcataatgtccatgggtagacatcagcaatgaacaaaatagccatgacacagtccttcccctcgtggcacttacagggaataagatactattctagtagtcaaaagtgcaacagtagtcccctactcacaggaatgtaattaaatgacatgatagagcatggaagaaaaacaatagtgtgctatgaaaatgtgtcactggggggcctggtcctggacagacagtggagactttcctaagagagtgacattgaacaaaatgaccaggactttactctttttagtgaggagtgagctgacgaggacaagaaaacaaatccagagagaggaaatatcacgggcacagtggcacgggagtggctggagggagagagtggctatggtgcaacagaataagatcctcaggaaaggtggaaccaggatgccgccttgagaagccacatggtcttttccctaagagcagtgggaaaccttgagagctttaaccaagggaataatacaataaaattttcatgcctgttgaattattttgcttacttgattgaatatttaaaatcattcacaattggcagggcacagtggctcatgcctgtaatcccagtgctttgggaggccaaggagggcggatcacaaggtcaggagttcgagaccagcctggccaacatagtgaaccacccccctctccatctctactaaaaatacaaaaattagcagggcatggtggcacatgcctgtagtcccagctatttgggaggctgaggcaggagaattgcttgaaactgggaggcaggggttgcagtgagccgagatcgtgccactgcactccagcctgcgcaatagagcaagactctatctcaaaaaaaaaaaaaattcacaactaagtaaaacctttttttttttttttttttaaaaaagtattacattaggcctgtaatcccagcactttgggaggctgaggcgggcagatcacaaggtcaggagattgagaccatcctggctaacatgatgaaaccccgtctctactaaaaatacaaaaaaaattagccaggcgtggtggacagtacctgcagtcctaactactcgggaggctgaggcaagagaatggcgtgaacctgggagggagagcttgcagtgagccgagattgcaccactgcactccagcctgggcgacaaagcaagactccgtcacaaaaaaaaaaaaagaaaaaaaaattattaaattatttttgatggacaaattataatcgtatatatttatggagtatgatatgatgttttcacacaatgtggaatgattaaatcaagctaattaagtaaaacccttaaaaagaacaaaaaaggtcattctgacagccaggaggaggggaggttgggtgaatggatgcagatctgtgggaggcggctgtagggtctcagagagataggagtagattgagctaggagtagatgatgttagaaacagagacgagaggttcaaaagttaatagagaggtgatggactgggtacaggaacatggagagggaccagccgtggaaaggaggagtgaggtggtttccagcggtggaaagagggaggagtgaggtggcttccaggagtgagctgggaaatcagcctgtgcccactgccagcacacagtctactgtttgccagagaaagtctcactgggggctcactcgaaagaaagagtgggtctacatcagctttgagtttcacttaagattttgaaaacagggctgggtgtggttgctcattcctgtaattccagcattttgggaggcctgacctcgggtgatcagttcaagaccagtgaaacctcgtctctactaaaaatacaaaaactagccaggagtggtggcgtgcccctataatcctagctactcgggaggatgaggcagaatcgcttgaacccggaaagcagaggttgcagtgagccgagatcacaccacggcactccagcttgggcgacagagtgagactccatctcaaaaaaaaaaagatttttgaagacagatggtaaaagatctgggactcagatttgaacacacttaccttaagttcttccatcctttcctggattgtggagaggtcagatgagtggctagggtcctgcccttgtagtatttcttcagcttccactatccaggcctccaaagcttctaaactcttggcaaaggtttcataatcaagaactccagcctttttttccacaaaagaaattggtatttcagttaaaaaaaaaaaaattggtattttaataaagtctggtaaaagggcaagtggatattaaaattatttttcatattcttgtatcaaattgccattctctagacgttcctataaaaaaagctataacaatttaaatcttctttatgtaatttttctaaaaactataattatttctatgcaccataagtcaataacaattcaaattattctttaaatacatgatcaaacaacacgtctgaaaaatcttctgattcttgtaaaagtctgagttaaataaacacgaatatttatattaaagccgcttagtgtttattaattgaacaggccatggtggcaggcattggttcaggggcttgcatcttaaaccgattttaaaattccttggcagagaacagcgcaaaacgtccaccttcatcgtccccaccagaacttccaagtttgtttacttgctattttcttgagtcttgaaggaggcattgttgccatgacaaggaattctttttctgtgtttgtgcccagatattagagaacagccaatatacagaagatactaaataggagctctgtacctgtaatgaagtctgctgtttgcagagagcttgctccagggcacacaagtgttgactcaaagagagttgatccgattgaatagctgatgctgcggaagcatccacttgttgcttcagttgctctcccagctcatggagaaaaaagagggaatctttaactgtgcccagtcctttgaggaggtcctagaagaggtgaaaatatgcccactctgaagcatgttgatactccttatcataaacagcaatcggcaaagggctacacatgtagaaacacaccattcctacggatcatattattaggctaaataaacttcacctgtggaaaaatgaacacgcactgaaccccattttttaaaatgctatgttaatattttaaacatacattatacacatataacctatggctatatataattactcttttgttagtaaaagctatgtaggttcattacaggaccttggggaaatgcagaaaaacatacataaacaagaaaaaaaaaaaaaacaaacatgacccaagagtagagccaataactggaaatattttggcagtttttttcctgcctctttatgtaatttgtatcaaattgaaaacaaaatgttatatttttcctttttctattattatcatacacaccaggaatttgtccgtggtgtcttctatatgtgtggtcacattattgcaagtacagcaacctcctatctcagtagggtacagaacacagtgatgattttggtgagcagggggtgagagtagcctgtattcccattcttttccatgggatctctttgcctccactttctgtgggaccctcctacaggttaaaaaatataagccaatggaaactccctgtttctgctttctatcctatcattgagagataataagtgactgcttcttctacctgttgctggtatcccactcagtcatgttatgcctaggcagtgacttctgtgagagaaagaagaacaaagggctctttacgcttgacacagataacagacaaggtgtatttcaattcaggagtattgaaaatgacagttcttgtacacacaaattatgtggatgaaaaaagcactgtattatctttattttaaaatacccatctttagctttaaagtgattattcaggttgaagatattagaataggttaaacttttatttacatagtttttatagcttgcctaattctaataaactgatttggaaaagtttataaaaagatcctcgtaacaagctcttaaaaataaagacaaataaggacaaatagtaagagccatgtaatgcttgaaacaagagaagagctgttccttaaacccttaagtaggttattggcagctacagtgaaaaagagaattattaaaaagccattaaaagaagtataccagtaaattaggagagaaagacttctttctaccattaatatcttagatgaaactattgtgtagatgcttacataggagttaatgaatgtaaatggacaacatctggaacagaagattttttaaagatagaacactattccccatatggtcatgtcttatattgaccaccctagaaaacacaaagagcctcaatctttcacattgactaaattccactaggaaaaatgggaaaacaactcattttaaaaaataaaacaatgggaggagacctcttagtctgatgcatgtgcacctgtgttctgaaaatcaggcaggctctttgatcctaagacagttatttttgggtaactgtctcacatagaaagacataccaaagcttacacagaccaaaagctaaacttgggcagtctaagaagggcatgtggggaaaacaaggtagctcctgaacatacgttgcaatcttgaatccatgtggcaacctcatcatcggcaatgtccttgtttgtggctgccttcaacagctcattggttcgatcctcctgctgctgaactgtcgaagcacactgtttggagtagtccttgtatctttgccaaagctgaagtagggccttgctggactgtagctgctcagcaatctcttccagcaagttattccatctggaaataataaccaacactcatgagcagattaccacctctcaccaaatgtggatatgtgctattttatttttcatgatcctggttcatgtgaatatagacataatcatttctagttaacataataaaaattaatgtttcatattcctagtttcagggtaggtaatgaggatgatggcaatctttgggtgtacagtacttctaattctttctaaatctcttcactacatttatttatccttaaattcatgttgtgaaagagaagtttaaaggaatagaatctatatagctcaaattcaaactgtcattgttttaattatatcattatttataataaggctgtgatataaatagtgtgtaaagttaacatactccatacctcatgttgacttctttcagtgtattggtaagagtttctgtcacgggtgggtgacactcttttaataattggttggtgatagagccaaatttctgtaagctcctttcctgtttttccagatcatcttggagattctgccccaaaaaaaagacccatagatgacataacaggatctaaattctaataagcaagtttaaaaggaatttgtatatgttttcataaatatgtacatatacttgtataaaccaggcatgacttagcaccaatgctttatcagctttctttagataatcatttattctcttttgtaggattttgttattttggctatgagaagaggttctgagcaatgaagccttcttctattggcatttgcattctgctgaaaaactcacatagggtgcccttgtccattgtctggtaggaagctgccagagatggtaaattcctcttcaaagggtttaattgtgtaatgtccttgtccttggttcagaggcctcacctccttgtactttcttgtttctggcctgtgagcagccctcctgctcttgttgtgtcctgacttgcccagacatgtccaaacttgccttgtgctgtaacacagggaccactcctacccctccctcccttgagaatcacatatttaccctaattggaaaagtttaagtcttagccaactgaggtcagtttagattgagtggtccaaccctagccaacaggggaaggatgcagggatagggactgcgttagggataaaaactccttctctcctttgttcagtgtgctcttgcagcagccagaagtgtgagtggcaccctcctgcagaagtaaatttgccttgctgagaaatcctttaagtgctcattttccttgctaccccaagctcttgtttctaacaaagccatggcaatggtgttatgtaacgtgctatctgccaaactgtggatctctttgacactcaaagccaaagccaggtctctattttgttacatacccgcagtgcttctaccacaaactcccgaagatgaagactctaagaaggcacagctttgccaagctttatctctgggtgttcttccttgccaagaattatttttaacttaaaaaaatgattttcaattgacaaataataattgtatgtatttgtagggtactatatgatgttttgatatatgtttacattgtggaatgaataaattaagataattaacatatcattacctcacatacttatccatttttgtctagcaaagttgaactcatagaagtagagagtagaatggtagttaccagggcatgggataagggattagatggggaaaagaaagatgttgatcaaaaggaacatagtttcagctacacaggagggataagctttagtgatccaccgtacagaatggagactataattaataataatgcactgtatatgtcaagattgcttaaagcaaagaatatttatcagacaggtttggcatcttctaccaagcctatctaaatagtctgctaccaaggaccagtaagggaactgaaagaaagttgtttctctggaaatagtgctgaggtgacagactcagttcttcataaaactccacaggtgaagtaggctacaaaaatcgagtactgtttaacaccaatatctgattaccctcaaatgaaaacagtcaaggaaaagacccttaatcctttcatgtcttaagacagctcttgcaagtattaaacataacatatattaaattaaaaagcatttctaacctcctcaaagttataagatgtgcttttaaatttactatcctcagaagaagttttcgtgatccttagtaacgacaatttaagggttaagaaattatatagacaaatttgtccttcctctcttccaccctaccctaaaaaaaatatttccttaagaaagtcggccgggcatggtggctcatgcctgtaatcccagcactttgggaggctgaggcatgtggatcatgaggtcaggagttcaagaccagcctggccaagatggtgaaactccatctctactaaaaatacaaaaattagccaggcatggaggcacatgccgtaatcccagctactcaggaggctgaggcagagaattgcttaaacccgggaggcggaggttgcagtgagccgagatagcaccactgcactccagtctgggcgacagagcgagactctgtctcaaaaaggaaggaggggaggggagggaaggagaggggaagggaggggagaagaggggaggagaggaaggcaggctgcatctgaggtcagcaacatagaagctttgattggctggccagggaggcggactagatattagcagggcacatgctggtctcttgttggcctcccatcccttaggggcctgccctgcccatcccatagtctgtgttctttagccaagaagaaagagcagtgacaggtgagagtggcccggtgcacaggagagtgggggcagcaggaatttgagggcggtgacctgagacaggagagagtgctatgttgaagacaaacatcagggatatcattttacatggacacaatgacaaaggacccacaggaaaccaagcagtaagtgctagaaaggaagattctgtggacacgctggataggccactgatattttactgaatggaagcaactgaatggtttaaacatttaccacttttgccgtttttctctgtgttttcttttgaacattccttagaatatgtttggagatgcagataagaagagaaaaggaagacaaaaggcagtgacaatgaatcaaggaggttcagttgggcataaaatcattgtataaaagacgatgtgaatatttttttacaacaggatcttggaaaccatttagttatataccagctaatccagaatttggcacacacaggcaagtttgctcaagtaacaataacacaggtaaaattaattttaaagatcttaaaaaataattaaacgtaaacaacatatggcaatatttcaggatgatgtctccatttggtaatttttcagttttctaaaattaaaatgaacgttaaggatgtgttaaattaattccttacctgaagattgtccacctgaacttgcacagcttctaaggagccagtcagcagacggaatcgggaaagagagtatctggcctccatgaggtaactgtttatcttgtcaaaggccactttgtgactactccattggtcaagcactgatttcagcagtatctttaattgtccaaccttttgaaaaagacaaatatggcttataatttcataatatctagaatgatggaatatatattcaattgatgggaaaatattaacatctaagaacttcatcagggtttcaggtatcataaacaaacaaaactaaaaagaaaaagatttaaaaggtaaaatgtatcaactttgaaatttatgccttccacactttaaacactcagttctaagtggaaatgcttaaaagggtaactgataaatatatatatatatgtatatatatacatatatacatatgtatacacatatatatgtgtatatatatatacatatatgtatatatatttttaagttataagaggttgatacttttaataaaacagtttaagaattgtattaaatgagtgtttcaaatgcattaactcatttaatcctcacaacaccttatgagataggtatgatcattatccccattttatagatgaggaaactgagacactaagaggtaatgaaaattacccaagattatactgctagaatgtgagaaatttcaatttgaatacaggtagtcaggtcccagaaagtgaaatctatctatagctataacaatatccatatctatctcacatatgcgcaaacacacacacacacacacacacgcacacacacacacacactcagataaatatcttaagacaaaacatctaagatattccttcctcataattatttatctctgtcagaaaagtgtttagcttggtttgcatcacttagatacagatatccactttgtatatcttttgccaggctggagacagatgtttgagaatgatctattgccatgggaatggatgagatcattaagagagtaatgtttaaaataaaggcttattctagaaaacaccagaaactagactttaaaaaaaaaaaagaggataacgaagtggacttaaaagtacaaggagataatgtatagatttgattatttcctctgctactttaggaaaaccaaaacccagagtttggacagagctggcaaacacggtcctggagctggctttctgtgagcaatattaccatgtgatctaaatttgcccaggtttggccgagctctcgcagtgtgctcatgacaatgctagagacgtcttctttcttgttctgaatcaaagcaagtccattctgctcaattttctctacttctttttcttttgctttaatcaaatcttccagatcctgaaagatttaaaaaatagtcactttaaattgttctattatggaactctggggtgcactgaaattgggccattatagtttcatgtcctaaaaaccttttactaatccaaaaagcttatctctttcagaagaggcacgctgcagaagtacttcttcctacactcaaatgcaaaaaaaaagtcatctttttacacatggcaaattagcataactttaaaaaagtaaaatttgatattctaccagataaggaaatggtactatgtaattttctcaagaggctgtgaggaaagaaatacatgtcagaaactgtaatattatttatattattaagttcatatatgttggtattcaaaaagttacgctgcctacctcataggaagaaatgtgatcgaatgtggtattctgggccctagtatctgagatttagtcacatttctactactcacctacccaaagctgagtcactttgggtaggtgagaaatttctactgggtctcagtttcttcagatgggaaatcagaagactgacttcagatgggaaaagatcatctgtatgatcctctctctctaaaatactctgaattctatgtgattctgaaaggcttcaggcttctttgatgaatcaaatcctcattttatttgggatatgcattcataattgtcagtataaaatgttcaagaatgaaaagcaaaatgaagaaaagatctggagctcatactgaacctgtatcataaccctaatttctattttaatgccatctgaaaatttgagaagctcagtgaagcagactgagactgctatcaacattttataaataaataaattgaagatcaagtcatccgacctgtcttgggtaaaagagctggtgagggatggagtggggattagaacccagtctttggagcctatggactcccagcctgatgccagaaggagtcggctgaacctcagactgtggagggaatataaatcccatgttggggtgatatgaaaagccaggcattaaggcatggttacagtcccatattcagaagtataccctcagaactaaaagcagatttgtagttcttggagattcgaatggagaaaattcccaaatactttaactttggataacacctcaattgtataaaaaatattttcacccccctcatgatccatacatgagtaataagattgaaattggatagtgctgctgataaggtgttaatgaggagtccagtctctgttatattaatttcaaatgtcatgcctctttaaaaataatttttgcctcttttatttctgtttctattatggttcaacttgttaatctctctctacctcatttttaaaatagtaataataagacattttctccttactccaaggagataaaattaggtaaatatatataaaatatattttaagctgtcaaaaagtagctaaatgcaagatattattatgtttagccatttggcaatgtgccatgtttcagtgcaaatttatttatttttctctattgaattatcatgaagctatttttgttttggttaattagttagacactcacgcatttggcagcttaaagtgatcatttttgtttttcatattgttctcttatttccactctataattttgtcactattttgacagctttgataattaccagagaataaatatagtgattgctggggttacaggtcctttgtgtagtataggaaatataattaatttactatttagaacttttctatttctgtaaagagattaaaagaccagaaacaatccttccaatatgtctttaatatgattctaaaattcaacaattagaaattgagtttatcctcatttttctatgatgttaactttttctcagtgaggaatattaaatgaatgttccattgcttagaaactatttctaaaatgccctgcacacgtatgttggtagaagagcaaaacccatgagggaaacagggctgaaatatatattttataaaaaataaaggtgtgtttcccttgctttcaataataattaaaagatgattctgtttctgatcaaaaaggggaaaggccaaacctaccatttttaaaaacaataaaacattcttaacttcgattaattcataaatatcagttttatgttggtttaaattaataaatcacctataaaagactgggaaaatactcaagatttttaaaacaaaataaagctggaatccagtcaccaatttaagtatactggcttgaatttcacactttggtccaaaaaacaatttctcaaaaatgacagttgtatcaagacctgtagtatagccaaatagaaccttccagttaggccattgtgatttatttatatgcgttgtcccaaaataattatatgggctactttcattctgtcttttgtttcaaagatatgacttttcatttgaaatcatgaaccggcatcagtacaaagttctttcaaccacactttaagctttccctcctgacactgtctgacctggctctctgaaagactaaaacttaggtcctacacttggtaaaacatggtcaagctgctgctatattttccagatggtaaggtgtctccctgttaaatagaagaaatgaacaggagaagaaacaaaatggaaaatggcagaaaaagctatgttaaagagaagaaaaaaatactaagagagagaaaaagtaaagtatggaagaaaagaagtggaaaaaataaaagaaaatgcaaatggtattaatgtggtatttcagtctttcaacagtaaagtttatcacaaccatgcaaccagaaggtcctcactttgctaattctaatacgcagaattacctttcaaaatcaatggatatgttttaatttaggaactcaacaaaagttatgacattttgtcctcagaagtaaagagctgaaattctggattacttgtagatttttgaatttatggcctaaatcagaaataccactggcctctagaaagttggaaatgcaatgagactagctgaggcatgttcttcaacttcagtctttaagcacccattttctgatgtgaggcttttttttattaaataaaaaaactattattacttcaaggtattctctatacgatgtttttctttatcaattttatgcagtctcaaaattgtaatccattagctggggagccagcacttctcttccttttcagaaccgaaaagctttgattaagtgcttaaatatacctctctttatatgtgtcccaaacagaaaacataatgattggaagagagatcattaccaaagttctttctttctgaaacccgaaatagaaaaacaagatttgcagagagaagcttttctgtagaattacttcactgtttagttttcaattgtttttaggaaacactataagggaacagtcataatctgtaacaatatatgaattcatgaattattttcaaaaatcttattactgtattaactgcaatagctcacttttcttttgggcacacaagaagacctgtggaaagactgtgtgtccctgagtcactggaaaacatttggaacgttactgcttcacctgaactttcaatccgcatccctcagagtagaacaagcacactctgtgtacttctccatgtgacaaaaaaggaagtaacatggatacttcctattaattaataatgggatattattaataattaattaataggaattccactgtgaagtgcttgttcagaggaggtgaacgggaatccaactaagcctctagtgctaacttccatttataggacatacagaggagagaagaacaaattaaacatcttaaggacattcataggccaatcctgaacatggcacccatcaacagcttctgcgacaggttatggtcttaaaaaaatattcaaaagatttaagagatctaacaagcaaatgtagcatatgcatattgtttgcatccttattttgaataagttaacatataaaagaaattttaaagacaaccgaggaaataggattatgcgttgaacataaaataatattagaaattattaaacttttggtggtgataataatatggatgcattaagaaaatgtctatttttcaaagatatatattgtatgtaagaataaagtgacatgatgtctggtatttactatgatatctattttagaaaaagaaataatttaggcaattttttttttcttggaaacagggtctcactctgtcacccaggctgaagtgccatggtgtaaacatggcttactgcagcctcgatctcctgaattcaagcaatcctcccacctcagcctcctgagtagctgggactacagggacaagcaccaccacgtctggctgatttttgtagctttttgtagagagagggtttcaccatgttgcccaggctgcaaatcttgacaattattaaatctgatgctcagtatacagggttcatagcatttctctctacttacgagtatgtttgaaaattttcataatttcaaatttttaaaaacgagtgaaaaaaacctaatgtattttaaaaaaaaccctataaactcacaaaatcagcaaaatttgttactaaatgcaacttttaaatatttaaaaaaatatttaacttgcaactctcaaggcctataaacatattagcatacgctatgaaattgtgagatggtgcatgttagccacctggacaagttacctgacagtctttcagtgcattttgaacagaagcctgatctccaattcgatgctgttgttttagtctcttttcctgggtttcaaaccatgttttcagacattgtacattattttcatattctgaccaagattccaataagccttccaacagctggatctgaacaaacacaataaaatgaaatttgcaactttattttaataaaatcaaatcattagcagactaattattctagccagtattttctccaaattaagaattcttaaaatacagttcatcgtatatatgatttaaaacaggggtgtctaatcttttggcttccctgggccacactggaagaagaagaattgtcttgagccacacataaaataaacgaacactaacaatagccgacgatctaaaaaaaaaaaaaattgcaaaagaatctcataatgttttaagaaagtttacggatttgtgttgggctgcattcaaggccgtcctgggccgcatgcagcccgcgggctgggcaagcttgatttaataaatgaatttcataaagtatgaatcaatgactattactgggaagcaagaaaggactaaagtcaacttgaagcaaaggcaaaataaatcaagaggcatctttagaaaactgaaacaccataaaatatacaaagagcagagaatgtataagagaaaatcatcaacaggttaaaggaagtttagggtgattaaccttcagcggtattattggaagcgttctttgcccagtatagccacgctacttgtgaacccagtcttccttacagagtgtgcctgttcttggggttttcatgtaaatctggacagtgggaagccactggcttaccttctcagttactagaccttgcagaatttgccaacttttattcattgctccaagttgctcagcaaaatcagtcttatcactacgcttactttccacatcctgactgctgatttgtagcacggactggttcacaaaatccactgtcagctgtttacagttaatgtctatcttaaaaccctaaaaaaaaagaggagaaaataagattatacaataaatgtctcattagttttccaggagttggaaagccttaagtaaccttaatattaatattatcacttccataactcagctgaaatggcacaatttgtctgtgttcacacaacccattatttttagaagccgaatatatatttgtatacgtttatatgaacataaacacagatatacgtgtgtatgtgtgtgtgtgtgtgtgtatatatatatttaggtagaagatttagaactagataaattatataacctcactataaaatatttataaatttatttttataatttctgtaattctttaataacacaaaattattcaaaatcattcctagtactggatatttcttcttatttctataactgataatgcatttttcttgctattgaattcctatctggtcactgtgtaggaaacatacattccaagacttgattaccataatttgagttttttagttctttcaaataaaatggtctgaaaatatgaaaagttaaaaacaaaaaattttaattaccttatatttctgaaggtattcatgaattgccttgtaacctatggaatttttaatattatcttcatccttctgaataacattttccattagagaaatccaactcatgacttcagaaatggcatggcgggaaggcagtttatccatctggagctgtccaagtcagggagagaaccagtcccaagtgttaaaatggaaaccccaacttctgctaacttaaaaaccctacaataattcttaaaaatgtaccaagagagataacactccttaatgacatttggagatcttaccctttctgaaagcttgaagttaaacatcaggcaaatgttgaggaataatagtcattttatgttcacttgatatccaatactgtaaacactgtataaacattaactaattaatcaaagcaccagaaagaagagaatattattcttattttataactagttttatgagtctaaaaaaacttaaccagaaaacattcaacagatgtattttattaattatcttgtaaaatctctgcatattatgactcaggaatgttaaaagaagaaagaaaaataccacactacaagctatcattttctagagtttttggcactctaatctttattcctaagaacatagccaatttcctcagcccttagctgatatacactacttacaattcgaaatcttacttaacatatcacacatttatgcatatgtgtattacgatgatttggaggaacaaaagcaatcatttaaaatctttgtatatcaacttctgtgtggtgctgaaagatatagcaatgaacgtgggttggttcctgccctctgggggcgcacagctgttgcttaggagagattaggcatgtacacaaaacacagctatcctgcctgaaacacagtgatgagtgtcaaagagagataaagataaaatgttctgggatttcaggggaggtgggtgtattttcagataagaggattatttacatctactgaatgccagttgctctcctatacataagatatttttaacatatattacgttctaaatcttcataaccactcactttatgagaaaagtgtatgtaactgtccacattttatctgagacaaaacagagtttaaacaaagccagacaaacattccaatacacatacccacacccacatacacacattaaagaaaccctcagaggaaatgcctttggggcagggctttgtagcgtagttcactcttttttttttttctggagacagtctcactgtcacccaggctggagtgcagtggcgcgatctcggctcactccatctgcctccccagttcaaacaattctgctgcctcagcctcccgagtagctgggactacaggcgcacaccgccacgccaggctaattttttgtattttagtagagacggggtttcaccgtgttgcccaggctggtcttgaactcctgagctcaggcaatccaccctcctcagcctccctaagtgctaggattacaggtgcgagccaccgcgcccggccagagttcactcttaatattaatacaacgggagagagaagaggccaggtgtctgggacaaagctgatataaatttgtgagcaaaagcaaattaatgtatttctccatgtcaaatagcttaagtcagctatttcccacgaaagcaatcctttctgtacctggtggagcttctcctggacggctgggatattggttagcaggtcagtccactggctatcaatgcgcgacagctcagagcgcagcgtggctgtgtccaccttttttagtcgaaggagctgatttccagtactcagaacagatgatttcagggaagattgggcatccacttctttagaaaactcctgaaacaagtagcgatgttcaaattagggttaaatagctagaccattcattaaaaggaaagcgaccaatttagtgcatgaaacaatttcctttacatcctggagggggttatgctgaacactcaaaagaaaatgaaagcagtacacccttgccctcgaatgaaaggaaactacgaagccccgacttgagaactacttgtaagaggcagtgttgagtcactgagccctattactttgcataattatggaacacacatagtcaacattaatatattctctatagcttagtttattaagtatatccactgatggttgacttcctttcttttcttttctttttttctttttagatggagtcgctcgctctgttgcccaggctggagtgcagtggcacaatctcagctcgctgcaatctctgccttccgggttcaagcgattctcctgcctcagcctcctgagtagctgggattataggcatgcactaccacgcccggctaatatttgtatttttagtagagacagggtttcaccatgttggtcaggctggtcccgaactcctgacctcgtgatctgactgcttggcctcccaaagtgtgggattacaggtgtgagccaccgcacccggcctgacttcttttctactggtgtatgggtcaggcctaacttataggcctgaatcaaatgctttagattcttagacttaccaggaaagcatttagatgatcacggaccatttccagctcttgtgggactgtcacagattgctgagtccaaaattctagccggtcttttgcagattgtaaccagtgaattagatctgcagattcactttgatatctgttaagtatattatggagtccattaagtaaacatttcatccctatcttctactcacctacgttactcaccaatgccaacagttttaaaacgagaggtctgaagatttagaagaaaaatgcatgaggttggcactctgaaattttcttcatattgatacctttatcaagcctgtctctctgggtttccgctggcctgtctttaagctgggtataaaaatacctttcccctactctttcacattgatgctacttagaaaatattagatgatggttacaaaaagtcctttgaaataaaggcggcttagacacagactatgtcattatgtaaaaatcaaccctccaccccgctgaatgcttcccattgcccttgagaagcttctgcttctcaatccatgttttctctttctctccctctcaggctttactgtgatatctcagacacagtgattaggcaagggagggtgaaactcaaaggtaaggtgccttatgcatctgcctccctgctcacttctaattatatgtttatatgagtatacaagaatccaagtggggactttctacttttcttttgtttttgagatggagtttcgctcttgttgcccaggctggagtgcaatggcgcaatcttggctcactgcaacctccccttcccgggttcaagcgattctcctgcctcagcctcctgagcagctgggattacaggcatgcaccaccacgcctggctaattttgtatttttagtagaaatggggtttctccatgttggtcaggctggtctcgaactcctgacctcaggggatctgcccgcctcagcctcccaaagtgttgggattacaggcgtgagccactgcacctggcctctgcttatctttattttccaaactatacaatacgtttctagaggagccatgtcactttcaagtgaatatctacttgccttatttatttatttatttttgagacacagtctcactctattgcccaggctggagtacagtagcatgatcatggctcactgcagcctcaacctcccaggctgaagcaatcctcccacttcagcctctccaatagcagggaccacaggcatgtgccaccatacctagtccttttgtaatttttttgtagagattggggtcttactatgttgcccaggctggtcttgaactcctggcctcaagcagtcctcccgtattggccacccaagtaatgagattataggtttgagccatcatcccccacccgcactagccttattaatacaatgcagcacttatctaaaaatatacaaaacagtcattgtattacctggtccagtgtttcaatattgtttccagtctgtgaagttccttagacattttattggtgttacttagccagcactctccaagttgatttagttggctttctagatctgagcagctgatggatatcagaagtcgtttcccatcatctaatacttgatataatttgggctggtattcattaaggctagattttaaatgctaaaatattgaaattattgagttaaaagtttggatatgcaatttttgtctttaagaattataatttctctggtacctacaatgttcccattacctgttattcaaacttaaactatactcactcaagtaacattgaaaactttaagatgtttcatctatatttaagtatagacagtctccttttgttgtttattattttttttttggtaatgactttaggtggatttaaaactgtcaaattattatttcaagaattgtgtggcatcagcataaactacagaaaatgcttggtggaggctgaattttcaaaaagagctctcagtaaaaaaaagaaaaaagaaagacttttaataatgtccaactataaataacagaaacattatctcctttcaatgtcaataacttgaaagaaaagtaaaagtactaataaaataattgatcacaagtttgtttacattctgttaaaactattggtaagtttctaaaggcaatgtggcggcttgtaacaccaacctggtagagtgttatgcggtcaataagcctgtcctcgttctcctccaccagacccacgcttgggatgctgctttccaccacctccagctgtctgctgagctcctgctggtcctcatccagatgggaccacgtctagaaacacaacatgagtctgtgagctaaaaaaaccctcattagcgaaagacattcttccttgggtgcaaaatacgtgcctgacagtctctccttaaagttatatcagagatgtttgcgttgggccttgctttgggaagcaaaagatggctttaaagcaagtaatcaaatggtgacccttgaaagcattgtgaatgggctctggaatctgccactaagcccctttacaactgtgagtaagctactaaactctgtacctcttttccatacgttacaatggggataataatagctatcttctccatcatgaggattaaatggaataatgtatgcagtgtaccttctattgggtatgcacttttttttttttttttttttttagataggctctcactctgttgcccaggctggagtacagtggcacaatcatggatcactgtagactcgaactcctgggctcaagggatcctcctgcttcatcctcccaagtagctgggaccacaggcgcattccaccacaccaggctaacttaaaaaaaatttttttgtagagatgggggtctcactatgttgtccagcctggtctcaaactcctggtatcaaaagatcctcctgcttcagcctcccaaagtgctgggattacaggcatgagccaccacatctagcccaggtatgtatggttttattctttaccacagtaaggatttaagtcaaaaggatggggatgtttgcctttcatgtaacgagtaaacaaatcaattacatttgcatatgaaacatatctataaatatgaatatatagtttatatattctgttaaagaaaaataccacatcacttattcctaagttcagacttttattttatttaaaactggaaaacactttttaaaagatcagttgaagtcttttccagtaatttacgctgtgggtcagcagtttctcagtgtgagtatgctcacttcactgtgcagttggagtggcaacagggcacagtagtagaaacccatgctttttaaatacacttaccaaatatctattgcctggtattttcaatgcctagggatctgggagtaaataaaacagacacaaacccaggccttctagtgaggagagacaggcaatcaataataaacaataaaccaaaaacaaacaataagttgtatggtataatagagttcttgtgctgtggaagaataaaacagaactgggtaggggtgggagggagtgcccaggtgtgtgcctggtggggctacaatttaaatggtgtcatcaggtaagtttcatggagaaacacacatttcaggtcgtgaagtcagacagatgaaggtgtgatctctgactttgccaccaattaaccacgtgtcttggcaaacagttgctcccagactcattgctgaaacagggattcaaaattctatctcaaagggttatgataaagatgagatggattcatgtaaatgtaagaagtcttgccagggacctgacatgtcaataaagtgtaactattattacagagatttcaaacgttaaaggtagatgtctctccaaaatatagggaattccacatcagggaattccacatctgggatttgggggttagctacctatgaaaatgttggcccagggaaaatcccatttagaaaaaatgcaaatacgacctgcaggcaacccagttaagatcagtaatattgtgggagtgggtggggaagtccacaaaggggagagagattataatctctaaaacttccaagggaaagaggaagaatgagaaagcaggaacagtttagggcaactggtacagttactgaagaaagaaaggggactgttccatcaataatgtcctacatttccacggggttctatagcttgccagtagccaccactgagcactactctgttccaagagcaaccgcatttgggacagaaaaaaatatttctacattttactttcatttttttttttttttgagacagagttttactcccgttgcccaggctggagtgcaatggtgtgaccttggctcactgcaaccactgcctcccggttcaagtgattctcctgcctcagcctcccaagtagctgagattacaggcacccacgacgacgtccggctaattttttgtatttttagtagagacggggtttcaacatgttggtttgtttcatcatgttggccaggctggtctcgaactcctgacctcaagtgatccacccgcctcagcctcccaaagtgctgggatgacaggtgtgagccactgcacctggcctatttctacatttttcatactcttaagtaagctatcagtctgaatatcaaaaccccaaatatcttcatgcatagtctgaagtcagtgtgtatctatcttactttcgacatggcacagcagatagcccaatgtacacagaaaacacagggggaataagcaacacagaaccataggaaaagtgcagtcctgagcccgagagcgcagctagttctgaggttatgtgaggcaaactgcatggatagatacatcttgcattaaaggtctattttgcagcaggaagtttgcagcacagaagatatgacatcaatggtctcacctctagaatgtactccagctccacacccctcttgtgagcccgtttcagtacagcagaagcctgagccatcagctctgtatggaactgggtttccttttggactgcaaagctgattatctttctgaagagtgtttcagtcaagatcatatgagattccaggccctgaaagtattcctgcaatttttcaggaagaaagaagtcagcaactcattcatatattatgttagaatcaaaattggtttagggccgggtgcggtggctcacgcctgtaatcccaacagttggggaggctgaagtgggtggattacctgaggtcaagagctcaagaccagcctggccaatgtggtggaatccgtttctactaaaaatacaaaaatcagccgggcatgctggtgtgtgcctgtaatcctagctactcaggaggctgaggcacaagaatcgcttgaacctgggaggccgaggttgcagtgagccaagatcgtgccactgcactccagcctgggtggagaggagttcacaccaacccagcgctggagctgagtagacagctctgcatttctagaggagagtgaggagtgcgcgaggagtccttgaccaggacaagggagggcagagggagcaactaggaccaggtgtacaaaggggcaaaaaggaaacacagggaaaggtagaggtaagaacgaaggtgggctcctttgaagacaggctctgagtttttctttgccaggacagttggagctctggttggagactccatctcaaaacaaacaaacaaacaaacaaacaaaaaacattgctttccttcctccatggctgggcttgggctctactttctgaacttctaggatatttgcgtgctcattccatgttgtcaagcacagctttatatgcactgattgatattataaatttgctttccttgtattatacctacacataacataactgtaggccttgcgccatcctactaatgtttttgaaatgttaccgtttgtgtataatagaccctggagaatggagattgagcttatctcatttcctgttcccagtaccatgataaaatggaagagctggcaactgataatgacagttaacattaattatgtgcttactgtttgctaggcactccataaatactttatctgactcatctcatcctcctaacaactctataactctatgagataggcagttttgtttccagttttacagatgagaacactgagtccccccagtctatgtagcttgcccaaggtcacatagctagtcacggcagagcttggggttcaaacccaagggcagtgtggctttatctgtgcttctcaccagcactgcagaactctccctcagaaaatgggctggtgagtagaagctagaatcattatttttaaccaacaattaccaaatcagagtcctaaagttggaggagactttgaagttcatctagcccaacatgcaatgaaagctgagattccttttacaagcccatctcccctaaaagccttggctggacttctcatggccagaagggctgtctgctcaatggcagcttactccttttatagttctttttctattgaggtttatttccctgttatttatactcattgatcctagtttcccctctggaataactcagaatgatcttttattgctatggtcaacaacgtgagaaacaccagctgtggactttaaagcaatgttttcaaagccaaatgataaggttttaataaatcatgaagctttggacaaaaacgtctgggaaaaaataggaacgacaatttgaaaaagacaaaaaaaacccacctttacaagccaccagagagctacacaatggtagaagattttaaacttctataacccaatgggatttttttagtttccctacaggaaattcccatagtctagaaggctgggtttctggactggcaaaattgctttcgtaatcattgccaataatgcaagagctgtgtgtgtgtgtgtgtgtgtgtgtgtgtgaaatacgcattcttctaccatggagtagtgtccaacctgagcttggctgtggcacacaatgatggagtgatttcgggcctcccaagtttgattacatagtaaacggccttgctgttcccagggagaaagtctgaagtctacagcaactagaggagcatatgtgtaagggtcagaggatctaaacaatgcatgtaaaagacaccaacccaaccctggatctgagtagtcagctctgcatttctagaggagagcaaggagtgagcgaggagtccttgacgaggacaagggagggcaaagagggtaactgggaccaggtggacaaatgggcaaaaaggaaacacagggaaaagtggagttaagaatgaagatgggctcctttgaagagaggctctgagttttcctttgattttagctcatctagggagaaagcctggctaatactagtgaggaactgataggtaaaattacaggtaagttggttttcttttttaatttacaacattatagaaacatatcccctataatttctctgtgctactgaaagccagtgggtttgaatataaattttttggccatttttaaagaataacttatacaagtaagaactcataaaagactgagaatattaggttttactaaatatatatcagggtttgagagcatgctttccaattacattttctctctatcactcttttttgttatgtaccttatgtttgtcaagtagttgctggatttcctctttggaagacacgatgattttctggtctcctgccatcttctcctgaccagtttctagcaggtcagccagatcttgtagggccctctcatactgactcttgagtgtaaggttctgattcagaccactcctccgggagccaatgatcatcatcagctcatcatacatgtcctaagaagcagagaccacaagactcactctcaattcatattctggcaaccctctaaaagcatatgaactatgaacgcaccaagcccgagacccaaccaagaaaatgccttcagggatgtgcctcctggaaacgctctacctgtaggccatctgcttgtctttctatgagccttactttgaaaacatgtttcacaaagaaatgacctttggacctctattctcatgcctatgatattcgttgtgactttactgtgtcttgatacctggtggttcaagttctttcattaatcttatttggtattcttatcttgctgttttaaattttattttatttctaacggacaataaagcacaacggagaaactgaaaaaaaactgaattcataaaaatgtaagtatgaagtcactgaaaggataaaataaatattcaataaataatgtggaaacaactcaactctttgaagaaaaataaagtcttatctcatgccacatatcaaaatgcaatttagattgattacaaaataaaaatttaataagttaaaatatgaaaggaaataaagatatgtctataaaaaataaggttaatattttaagattttaaaggacatgtaaaagtgtttcctagaaatgatacatgaggtagatttgacaactgttttctcaggatatcaatagtttatgataagatgtggggtaaaactgttgaaaaactgtccatgtggctgagggacatgtcatagaaaatgtaattcccatttttatagtattctcaacattcatataatttcagagcaattgaatataatatccttaacattttcctgctaaataacaatcatatttgggactacccctcaaacaaagagctagagaaataggggagtttaatgtgagcagaaagagtttcaaacttaagaaggcaatatttttgccaaatgtggtggagtatataactatttaaactggaaagacattttaggagatgatgacacaccaaacacaaaatttatttgaggcatacggacctgattaacatatcacattaaggtttagcaggccaaaatggttcaatctggaagagttcaattttaatgcctatttacggcaatgacatttgactcttacacctgatgcttaagtgctgtcggaaaactgtctaaaaaagtacaaagtgggggaggtgggcttatgatattatgaaatgttagataaaggacagatacagttaaaataaaaatgttcttttgtttataaggtctattttattttctcaaagaaagaactcacaaccctgtactggactgaggttaccagttctcaatagttctgcacacagagaaaatctaacatgtgtgtctgtgtgactgtacacagttgtacacaattttttcttgatcgaacataactgcttgcctagttgatgctaaattttgttggtctaatatccaaggatcttcttcctaccccaatatcagattcttgcctaaatgtcagatctagcaaaggaaattaacccaaagcattattctctgttcctgaaggatgataggaagtctgtttagatttcaactaccttctagtttaatttttgttgttgttgttctagaattgaaacaatgtctctattccattcaaacatatatggaggataaactatagtgcttgccttagaaaaaaacactttctacaaagtattactttgattatttgctttttaaaatagtatttgaagacatagtgcaatacgagggtagatatcccttttttaaatttttctaggtaggattaaaagttattctattttctacagtagaaaataatatgctacaactaaactatactgtaatgcttaaccatgagaataataataaagtaactgtcagaaaaacatatgaatcttagcagcatgaaaacaactcatttccttgtactaaacatgttaagcttcagaaaattttctaagagttgcttggtagaaaggttaggacctaagtggcgtgaattttataaagaaagccaagaaaaataaagtgattttttctagacttcaagtttgatgtacccctgcagctgaatactactggctgaaggctgcacctggagcttggagagttcttgcatggacggctgctcgacctgtagcttgtcaccacgcctctttaattcaatgattcctgcatcaaattctttgagtccatcttcagcctgttgtattgcctaagtaagatccatgacattttattaaaactcccatgaacaatttccccacggaagatgtgattattgtatctctttctgtgttcctcctctccatgtaaaacattctcaatatatacaaaaggaatcatttcaataaaacaaatcgaaagccatgttcagagggtatatagaaaacagaagaagtcccctcattagtacagagcagttatcttacagataatgaggcaggagaaagtcagggtagagggctgggagaaggatgtcttgcttaaacaaaaaagggagttttgaaaagcaatagttaaaaaaaagagcatcatttaggacatagttaaaaaaaggtatttgcctgagattttctaagggaccatgttctgctgtccttgaaacgtagctgtgagcatctttggagagagattcagcgaggcaacaaaacatatattacagcatggtcaaagaatctgtgctccttgttgtgaagtggaaaatcaatcagtcaacaagtattcaagtggctgctattgctaagccttgtcttcccagtgtgaggtctgtagaagcagaacaagatctcatcctgtccttcaaggagctgatggtctggttaggaagccagagtaaacagagaaaaataaagcaaggctgaatataagtaagtactatactcgataatgcaactcatccccattagcagagatcagagaagggagataccagaccacaaatcctggagcagcctaagcaggcgtttggaaagagggcaacagaggttgcccctgaaggaggacaaaaacaagactccagatggcagctgaaacacatgtgtccaatgttctctttcctgaaaaccccctacagtcagagtgagtattttgtttgcttgttctctggcatattttttccccataaatctaaaaggacaagggaacagaaaagaaaacaatgccaacaatatgttgggagctagaagtcaaaagaatacatgataattgacttaggaaatctggggaagctgaattctaaaccagtggaggatctccaccacccacttcagagcaacagaaatctctggaactctgggtgaagtaagctggggtgctaagtaaggagggttagtgaagagctgcttaaaggacagttaacccacagatgcccctccttattccatactgtccctttttcttcccgggtaaaagactgaaagtgtgttctctggagaaggtaaaacagacagaggggcactggacacagctgtgagcttgagtgcttgactgaaagcaagggatgaaataactggatgctccctgcatgctgaatgtggggcccctgagtcttctctccctggggcaagaagtgctgcagtcagggctctagtctccagagatgagagggaaaaatatctgaacacaccaataagacaggcctgacaatttgacagaaggattctctaacaaataaatggtccatagagaccatcctgcaggaactcttaaaattatcatgttccatccacacacagagttccctttcagctgtttagtcctccatcctaaacctgaataggcaacaaaagatttcaatatgcctttcgatgacatgaaagatggggactaacagaagcaaacaaataaaagcaagctggaggaaaacagattatacaggaaaagtagaactttaaacaacaaaaaaaaaaccattaatatacccagaaagatataaacgataatgtattcattaaaaaaaataaaaaatactacaaaaaggatcattcggagaaccaaagtgagctccgggaaaattaaatacgtgagagcagaaatgccaattcagtacaagagtctggagttgaaattgaggacgtttctcaaaaagcggagcaaaaagacaaagaaaggtctcttggtaagacagttcaagggttgaacccgagtatctgacaaaaaggagttctccagaaaagaagacaggtaaaatgcaggaaagaaatgtattaaataaatcattagaaaattttccagaacagaaagatgagagctgccaaatcagaagagtcccttgagctcccagcccagtggataaaaatagatcctccccaaggcatgtgattgtgaaatttcaggacactggaaacctttgggaattagaatgtttttagattccttaagacaacactgagagctagaaaacaatgaagaaaaagccttgaaactccaaaagaattcatattcaacaaatgaccctgaaggatcacataaaaacagcaaagcgatcaataaagtgtgaacatggtataagaacattttcagacatacatctggaaaaatacacttatcatgtaccctttctaagaaaggacatgcactaacgaaacaaggaagcaatgcagtaaagagaaagacttgggattcagaagagagaagatccaacataggaagaaatgaagggattctcaggatggtggtgaagggaaatccaagaagacaactgtgcaccaggtttatgaggcaagagaactgctctggattggaacagcacaactcaagagatgactatattgagtgaggtgtgtcttccccatgccctctgctgttattgcctttttaatccaagttgggtaggcatggaattagcacgttcattagttgcattccatttattcaaagaaaaaaatctaactggttatttcttcatctgtgacattcagttatattggtcaaaaattagtaaaaattattacttgtgatcatacatatctcataattcatattagaaatccaaagcaagacatcactacagttgctccagtcttttttggaatcacacatacattataagccaagaaaaaaaacaaaaagatttttcatggggagaaatgagaaatctctttaaaaagcagatgaaattatggtcaagaaaaatgcacagccggatgcggtggctcacaccggtaatcccaacactttgggaggctgagatgggagaactgcttgagcccaggagttcaagaccagaccagcctgggcaacaaagtgagaccctatctccatattaaaatatatattttttattatatatatatatatatatatatacacacacacacacacacacacacacacacatatatttttaaaaataaataaaaagaaaaatgcacactcacagttttgcaaactattttgagaggtgttctttaacacacacacacacacacacacacacacacacacatattatatgtcagattattctctatcgtctatccatagattcccgggaagttcgctgaaattaaatcagagaattctattaaaacacatacttctcacaattacttagcttatgaaacaggagatattctaacatccctcccatttcttctatctgcattttcatgccatcatgccagtttgggttctcattctttctctccagtacagctacatgaagcctcatgatggatctcctgtttcctgaccctggtgctgtcatgtaaactaaccagaagcaagatctagaactgccattcatttttacctgcaaacatcccctacaactttccatggccagggatctcccagctgagtctaaacacccaagagtgtgcaagatgatttaccaggatgaaacaccacatctttcatttatattcaaccacattaattttcaattttggttgtagcatgtacacaaacaaaaattgaaaataaatttggctgaatttaattgtgatttataacataaattgcttataatttataaataaataaaaatacatacacttatgctgcatatttatttccttttttttttagctaatgaggcatgcaacaaataaagtgtacaggtaactagtttatagaataaagtccaaagtcacacattcaacaggccctacaaactgccttaaatttacatatccaatcttgtttgtcctcagtcactttcatttatcttaaattcagctaaaatagaattacctgtgtttttccctaagtgctcagaattctctaacaatttgtgccttttttcttgctgtcctctttaccgtgatatctttctttcctgttgttgtgtgtccaaactcttaggttcagttcaaatttccctctacaaagcttccctaatcctacccctgctggaggccagaagggtctgagtacccataatgctttgtcagtaccactcccaggacagtttgactttctgccctatgtcattgaggttcatatctaatctcatcattgggcagaaaactccttcaggtcagcatctgccatggataccttttcccagctcacatttcctagttctgtgcagatgtaagtaacagagtcaatgtcacctggtatgttattcaaacccagtactcaaaaacaaaaatactacaaacaaaagtgccactgtgagccattaatctttcatagaatattcaaaatttcatagtaagtcatatctcctctatgcattttctcttctaggaaaaggcagctataaatacctctatttgttctgctacgggctgttcaaacacatttgccagtttttgcagaatgatgtatttgttgtcagccagtgatgtaaacagcactttcagatcattctaaggaggaaagcaacgggaaaactcaaaatgtgtaacagggaattcaaaatacttgtaaatataacacagattctaagaaataacatagaggcacagaaatttaatttccaggagaaacaatactgtgctatgggaaggtaaaaggaactggtaacaatttacttatgtgctaaaactgactcctgaagaatctgttacccaaagtattttctacataacacaaatgaagttgaaccatacatgtaaaaagcaacgcttgtcaccctaatctcattacatccgaaataaatgagcacagtcaaacattgcacagaaatattatattagtggctcttatctagggaaataacctataggtgttatcctgatttgggaaataatatgatacttaagaatcatatgatttccattttgctctctcctcttcttccctccctccatcagtttcttcttctatttttggaaaatttgcacaagctttaaaaaagccatccagaagtttagaaaataaatattatccatgatggccaaaaacatgtgaagagacaacacaaaaagatcttgttaggtattttgttcaaaaatattactcatttaaatgtccaaatatatttatattgagttagatttgtataaaaaggagacaactatcagaactttggtacttaattccacagggaataataaattagaagaatatttaaattataaaaaattttggccaggtgcagtggttcatctctgtaataccagaattttgggtgcctgaggcagatcacttgaggccaggagttcaagaccagccggggcaacacagtgcacccggtctctacaaaaagtttaaaaaaaaaataagtggacacagtggcatgcctgtagtcctatctacttgggaggctgaagtggaaggatcccttgagttcaggagtttgaggttgaagtgagctatgatcacgccactacatgccagcctgggtgactttatctcaaaaaaaaaaaattaccaaaaaaatgtatttttttctctaaaatatcaacaaataagttctatttcataatagtcagcaaaaatatatttgtcagaggttaaagctcaactcaggacctctttaccagggcctgatcacgcacatcaccaacatgcaaacattctgactgtctaatgagtggaaggataatcgtaccaaggaagaaaaacatctataagaacatgtgaaggctttataatgtaaattcaggtctaaaaagcaaaataatgggtgcattatgcagtaaaaattataaaattgaaaatatagcgctgaacatgagaactagaatagttgccactaaccaaaactcaaagcaatctgcaagtctagtggctaactaaataggaaattataataacagccctggaaaaatcctagaaacaatagttttacatatgagttactaggtctgtatcattcaactgtgttcagagtaaggtcacgtgggccattaaaaccatcacacatttatctgtttttaaacctagtaaaagatgtcctgcattcacttgaacagaagcctacattatctacatatgtgtgtatagtgacattcgtccagttaatctaaatgagtagctaagtatatataacataacatgggttagaaatgaagagtgcatagatagatttcctgtatgccagttttatgctttgttttgttttgttttgagacagagtcttgctctgtcacccaggctggagtgcggtggcgcgatctcggctcactggaacctcagcctcccaggttgaagcaattctcctgcctcagcctcccaagtagctgggactataggcatgcaccaccacgtctggctaattttttgtatttttagtagagacggggtttcaccatcttgcccaggctggtcgcgaactcctgagctcaggtgatccacctgcctcagcctcccaaagtgctgggattacaggcgtgagccaccgcacccggcccatttttatgcttttaatagcatattttctctcttaactatgttctactcaaggtggtaggaaacacagagttcatatttctggaagtcagactgattattgggagagactagtcaagaagatagtaaagcaaagaatatgattgattttaaaattactaaataaaaactttaagaggtgctagtaatcacatggatattgacattttcttaaaaataaaaatgcaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggcaggagaatggcgtgaacctgggaggcggagcttgcagtgagccgagatcccgccactgcactccagcctgggtgacagagcgagactccgtctcaaaaaaaataaaaataaataaaaataaaaatgcaaagaattgaactatttttgtattattacacttgcgatacaacaggataattaaggtatccatatattacaaacataaaatacatcactttttttttcttaatagtcactggaattattggcagggcaaaaaggagcaggattctagccattgagaaacagatttgcagaaagtttcaagctttaaaaccagttgtgtccgggcacagtggttcatgcctgtattcccaggactttgggaggtggaggcaggcagatgacctgaggtcgggagttcgagaccagcttggccaacatacagtgaaagcccatctctacttaaaaatacaaaaattagctgggcatggcgtgcatgcctgtagttctagctacttgggaagctgaggcagaagaattgtttgaacacgggaggcagaggttgcagtgagctgagatctccccattgcactccagcctgggcaacaagagcaaaactctgtctcaataaataaattaaataaataaataaataaataataaaataaataaaatcagttgtgctgcctcactcattcattaaagaattctttcattcattttccaattttcaaaataatttacaatacacaattatatgtttggggaatttgaggttacgtccatgggtaaaatttttgaaatacaaaatagttcataattgactttattgtgattctatatatgtaatgtacatctacataacatctatgcatccttccaaatagtctttttggtatagaataatgttagcagtctggcaaaagctaatcctgaaagattaaatgcagaatgaaggcatacccttccagtaactgctgaggactgacagcataccaaggtgtttggtgcaaagttaaaacaaaaaggaaaatagtttgtgacttgacctttaattatgttaacattggaaagtttctctcaactaaattggaacacaaatattttgaaatgtctttttgttcgtgagctggccaccaacaaatagaaacttgttggcagaagaaaaatagagaacgtgatttaaagagaattccatgattctcttagatccttaaaacaaagtaagttccagagcattcatgcctaattcatattttactgtgactggtgataattaccaataaagtttaaaagtatgaaagtactaaagatactaaatgcaattcacaaaagatatggggaatgagagcaaaagggactgctgaggcactcggggattctgacttgatcatcttgggggcagtaactatcagggaagactgctagatagcagtgccactgactcagggacaagactgagttgctggtggtaccatcaactggcaaaggatattggataaaatttaagagactctaatgaaggcccacattctccatcttccctgagatcaccctaatatgataaaatacaaaaatatatatattctttgagtaaaatcctggctctagttcttaatggttgagtaacactgaagtaatttaatctttctcttggttttagatcctgtatctcttataatactactactaataacaataacaacacttgctgagtgtttactatgtatcaggcactgttcagagtattttaaacacatctcaactcatttcatcctcaccacagtctatgaggcagttaatatgagtatgagtttgatttgacagttgaggataccaaggttcatggaagtcaagccgcaaagttatacagcagtaagtgacaaagccggaatttgaacccagactgttagctttggagactacatgtttaatttttactgttctgactttgcaaaattattatcagaacaacgtctgcaggatgtcgcaaagattaaagacaatgaatatgagaaaatattttgtgaataaaaaaatgaaactcaaatgtttgtgatggttttactctgtggttttaagaatgtagactaccagaaggcagtggtaatttgtgcctcgtgaaaattccatgtttcttggctaatgctacatttatgtgtagtggtttggttttttttttttttttttttttttttttttttttttttttttgcaaatcaaaactccacatgaaactcttggccctaatgacatgtctctattttataaaatctttcatgttggttaaaaataacattcaattaaaacttatgtattctcaaagagtgctttttattaggaatgaaaaatcagcactaaaagtttatcagcagcttttgcatttgttccggtatatattcataggaaaagtttcctaagcacacaataagaattataatatggggctaaaaggcagtaagtctgaggagttaggactggaaagtaacgtaacacattttaacacaggtagaagtaattagaccacagccactttcaaagactcttaggtactacagtctatggccctttctatattccaacactttctgcatactctttttttttttttttttttttttttgagacggagtcttgctctgtcacctaggctggagtgcagtggtgcaatctcagttcactgctacctctgcgtcccgggttcaagcgatcctcctgcctcagcctccaagtagctgggattacaggcctgcaccaccacaccctgctaatttttgtatttttagtagagatgggttgcattatgttggccaagctggtctcaaactcctgacctcaaatgatttgcctgccgtggcctcccaaagtgctgggatcacaggcgtgagccactgtgcccggccattttctgcatattctttcgcaatgtgtttaaactccggtattagtaactaaaaattataattataatgatccataaatttgacttttattgattgaattctattcagtccttagtttgaagtgggtggttttctcaaccttccatttctaggagcaaaaaatctttagcttctaatcctttaattcaacccccttcattttctacaatgctcttgttcttcattacgcatttagaaaaacaacaaccaggtctgtaacacagactcgtgactgactattactgaatacctagagaatggtcacgtatcctttgataatatcttacttacctggaaatttagtatttgctgaagtctttctttcatctgatgacatcgttgattcactactgagtctagcaaggataacctgcccaaaagacaacccaaagtatcttcaataacatctcgattatcaccattctctggaaaagcttgggaaaacaagtttttgttcttatccatttcttcagacatttccttaatgtctttggcaagaatctagaggtgataaaagggcatttttcagtgtttagatacatgaattgatatgcaaatcatgttattttctcatagaaagtcaactagatctctctggctgcttagtaataatcagacctaagacaactggaacctctttcaaatacttctatacatttcaggaagttgctctcagagactttacctcattcactagtaataatgagcaatgtaaagtgctatttaggaatttggtactttttttaagcatgtgtttcgtatttggaagatttgtgatacataacagtgtttctacaaagagtttcccatttttccctcatacttacacaagacaaagaatgaaaatgcgaactataaatattctgcatttaagcaattatgttctgcattattagaattgttttatgtttgactttctttatgcataaaattaattatcccatcaaaatgtcaagtgctttgtaatgttatacacacacaggcaggaactactaaacctacctcttggttgaagagacaagtctctgtttcttctggtaaaagtgctgtggcaacaaataaacgttcttcaacgtcatccaaccaagtagaggtggctgagactccatcatacaacttctgctccaagtgtatactctgcctctttgcccctccactctgggaaacacaaaacagggtcaaataatcaatttcagtgttttgaaaatccaggaaaaatatcaggatggggccggtgcagtgctcacacctgtaatctgagcactttggtagcccaaagcagacagatcacttgaggtcaggagttcaagactggcctggccaatagggcaaaaccccatctgtactaaaaaatacaaaaatttgccagtcgtggtggcatgtgcctgtagtcccagcttcttaggaggctgaagcatgagaattacttgaacccaggaggtggaggctgcagtgagctgagatcgtgccactgcactctagcctgggtgacagtgcaagactctgaaaaaaataaaataaaataaaataaaaaacaggaaacaggatggggccaggcgcggtggctcgcgcctgtaatcccagcactttgggaggctgaggcgggcggatcacgaggtcaggagatcgagaccatcctggctaacatggtgaaaccccgtcttcactaaaaataaaaaaaataaaaaaaaatcagccaggtgtggtggcacacgcctgtagtcccagctattcgggagggtgagacaggagaatcccttgaacccaggaggcggaggttgcaatgagccgagattgcaccactgcactccagcttgggtgacagagtgagactcggtctaaaaaataaataaataaataaataaataaataaataaataggatgggactccagggtccagtgatctttgtttcagcgcttatcactagtgttgggtctcatgctcaggggtggatgcaacagtctcacagaggccaggcaaatcaatacaagcaaaacaagactcttataaaccaagccaaacacactgataacacagccttacctgggatgaaacctcctcgaaggcttggttcagtccatccagcaaagatgtaactgcagatttatcttgggttggcacgtcccctttgtacagtggcacaccagacaagagtcgatttggcctgctataaagctgtaggcaaacaaaggcagcttgttgaagagcatatgcattatgtcccagtattctcatttggaaatgcatactgaaatagatgctgaaaacactgtccatatgaaaatttcttctagagaaatataacttctacaacataccatgtccactgaacacagtggccagatgcatcaatggcaatgtttccatggatggattttttttttttaagcagtggaaaaaaatgtctgacagataggaggaataagttctggtgttctattacacaggaggtcaaacacagttaactataacatattgtatatctcaatagctagaagagaggattctgaatgtctctaccgcaaagaagtgataaatgtttgagatgatgagtctgctaattaccctgacttgaacattacacactgtatacatgtatccaaacatcacactatacaccagaaatatgtacaaatattatatacaaataaaataaagcaggccacccacgatggctcatgcctgtaatcacagcactctgggaggctgaggtgggcagatcatttgaggccaggagttcaagaccggcctggccaacatggtgaaaccccgtctctactaaaaatacaaaaaatagccaggtatggtggcatacgcctataatcccagcaattcaggtgactgaggcacgagaattgcttgaaccagaggcagaaattgcagtgagctgagatcacaccactgcactccagcgtgggcaaaagagcaagaccctgtttcaaaacacacaaaagatgacattataaaaaaagaaaattaaattaaaaggtggcttgcaaattttatgaaataaatgacattaagacataaataaattagaaacagaaaggatgagaacagacattgctgaaaatggaatcactggcatagagaaaactcttgcaataatcagatgaaaagtaaatccaaattttaaaaaaacaaagatcagtacaactaaaaataagtcaataggtatagaaaaaagatgatctaacacaaggataattgatgtccctgaagcagagatataataaatatagcataaaatacatctaaatcatgccaaaaaattccctaaaattaataaaaaagcaaaccttgattcttaaatataaaaaaagtacattgtgttacaggaaaaatatgatagcagaacactcaacatcaaacatagcctagataagctgttgaaacttaaagaaaactaaataattcttctggcatccatacagagaacaatgacaaaaaataaataaggggaaaaatagtagactgatgttagatttttctaaagcgtcattcaatgccagaagagaaaaatagatataaatacaaattctgaagggataaaagtatgacagaaaactgtccatccaatatagaggcaactagctgatattcccaaacatgatagaacctgagttttcttgaaaaaagttatttgacaatgaaattaatacctgagagctggatcaaaattaaaaatttaggaattaaaaagatatgctgaaaggattggttatgagcactgaggaatttaaagattaaattgatttacagaatatgggaattgttacaattgttccttttcattttcatctttgcacttggctgcattatgcgaattattataatgcatatatgtagtttttcaaaataatagagtaatttttcttaaaattgactaaataaagttattagcaatcataaagaaatcttatcacagctttcctctcaacttttcttcttggttttagtagtacctatagtgaaataatccatcctaaatacaagactcctagactgatctctttgctttcattattaaccccatttcccctaaactcttttaggtatacatatggctccccaataagggcaatgatatggtgtagcattcaaacttttgaccatgttttcaatcaaactcagtctcctttttctttttttcttcttctttttttttttttgagatggagtcttgctccatcgcccaggctggagtgtagtggtgcgatcttggcacactgcaacctctgcctcccgggttcaagtgattctcctgtctcagccgcctgaatagcttggattacaggtgtgcaccaccacatgaagctaatttttgtatttttagtagagacaggatttccccatgttggccaggctggtcttgaactcctgacctcatgtgatccgcccgcctcagcctcccaaagtgttgggattacaggtgtgagccactgcacccagccatcagtctcttttgacttttcaaaatacctcctcacctttcaggctgactactcatgatcctgtaaatatgccaagcccattccccattgcagctgggatatcctccacccagcatccccttaaaatctactactttaatttccataccgatcatagcaacttttgactattttttcttaacctttgtttcctttgaattcctgcttatggatcctgtcatagttgcctaattttttttttagaaatgtatgcactatttccttattcgggttataggttctcagaagcaggagctgtatttcaccctgaagccaagtaggttgttgtgcatggaagcattaaatacattggaagtaaacagattaagaaaaattgctctaagaggttagtgccctttgacctagtgaactttaggccaaaatgtgcctgtttttacatatgaaactagtaagtatttctaggatacaaaattgccattaaggtagtatgaaagaggagggacttaggtaacagagatatcggcttcctgattccagattcacctcttcttagtcgcaagaccctctctaagcctcagtttccaggtctacaaagtagagataatattgacctcaccacaacgttgttagcgatgttaacacctagaacttaaaatgtgctcattatatgatcactcctttctgcctggaaactgacagctaaattgcttcttccctctcttttccttcaccttttcacaccacagagaggaaaacaacctatgaggcactttgtacaaatgaccagcgattgctgaaacaaagcactcaaatgcaaaaatgtcattaaaaaaagaacattcaatgcttttatttctaatccaaaggcaagggaggcacaacatgaacctaaatttgaacagtccaggtattgtggaatgtcagtggcagcagggcaaggtttgttcagtaagcacagcatggaggacgctggagtgtcggctccaactgagagcaaaagcagctcttgaagatgaaagcgggtaatggatgagacctccaggaggtctgcagatgccggacgaatcacacaggtgctttatgaatggagaataatacgcaagcacagaatctagaaatatcgtagatttctctaacttaagatagtcagaaaagactgcagtccctgattcagaactgtacatacctctcctattcaaaggattggagggatactagaatatgaagggagagctagcagtcaagtccagaagatccgtatcaggaacaaggaatttgagctatgagtctggaggacattttatcagggatttgaggaaggatgaattaaaatacagggaggaggtccacgcaaaaagtatagggcaccatttgccagggtggatacgattctgggacacctgcttccaggaatacagtgctttaagtttcccagggcagagctggtggctatttctgcagacagaggtaaagaagcctcctggccagagagggaaagtgagggggcagaaaattcacaaaagcatgtgcttttataaaaacagaatagaaagcgtggctctggagagacgtatgtgtggctatccacagatgacaggacaccttatgaccttcagaccagcgatccccaacctttttggcaccaggggttggtttctcgggggtgggagagacggttttagaatgaaactgttccacctcagatcatcaggcattaaattcataatagaagcatgcaacctagatcactcacaagcatagttcacaatagggttcacattcctatgagcatctagtgctgctactgttctaaccaggaagcagagctcaggcagtaatgctcacctgcctgccgctcacctcttgctgtgaggtccagttcctaacaggccacggacccatacctgtctgcagcctgggggttgggaagccctgctttagaccatctccttccatttaactctggcaggttgcgcctgctttctaatgcctactttctcagctccagcgtttccctcctccaattcactacagttattgacaccctttgcttctggtttagcctctcccagcccctaagctagttctggccagagcagagaaacagcagcttccgcagagcaacaggaaaggttttagaattcactccgataatactgctgacttggaatgagcctagatggacgctgctagcccaggacaaaggactagtcttgtatctgaagaattcctctgggccacagctgtggtaggcatcccaggctggcttgtgttcctgactccctcatttgccctctaactttctaagtcctctgacttccagttgttccctggcttctgcttagagtgaagtaatagccattatctggaaccatctgttgctgtcttcaattcccttggatttggcatgcctggtggaaccaagcccgacagcacacagtatccctcccaggaaccagccttgcagatgggtccataactattccagctgaccactggcttcacttccctgccctagacccaccaacgtcccaatatgtttctcattaagatctcctgaaattattaaatactggaagtggcaatggaaaataagatggcctcacaattgagttccagatttgtggaaatccttctgtcctagatgtgcatatccttgatttccatccttactttttcaagtttgcaaaacacacacaaaaagagggcacttaaaatgtaatggtttaggctaataaggaatcagatattaatcatctctgaggaaaaatattgtctataaatcaaataaattttcacatataaatatataattatgaagggaaatgtgaaatagacttgttaagaaaaatgtagagtgaaaaattggtgtcatgtcttagtttgaaattgatcatgaaaattaagttgattgcacagttataatccctcagcataaactctacatcttttatattagttaatatataatgtaaaatatttgataccacttgctcttgttcctgttccagaacattctgtagtagtttctgcttggtactaaattcttgatgtaggctttcccatttcattctcatctggtcttcagcggatgatttctccccttccatccccaactcctgggataacacatcaggtttttcgctattagaagaataaataatctaagtttacaatgtgcacaaaaaagtgataagacaggtaacttattgtgtgtaccagacctggcttctcaaatgaaataagattaccttagttattagcttacactttaaaaataacaaaaatgtttaggccaatcataaagcaactatattcctactcattgataaactgaaccatgtgcagaagggatacttaaaaatgcattgaataaaaataattgtaacatttggaataaaaaattatagcacgattacagactagtatcctttggcaaatagcagaaaagttagttcaaaaccttaaaaatgtgttagtctagggagagttacgattatgagtccagagaaaacacaggacacaggagggcggtgcaggacacaggagggtacaacaggacacagagaaatagtacagggcctggaaaggtagtacaggacagaggaaggatcgtacaggacctgggaaggtagtacagggcatggagggatagtacaggacctgggaaggtagtacaggacacgggaatgatcatacaggaactgcgaaggtagtacagggcatggaggtatagtaacagggcctgggaaggaagtataggacatggagagataggacaggacctgagaaggtagtagaggaccctgaggaggaataatacaggacctgggaacgtagtacagggcacggagggatagtacagggcctgggaaggtagcacaggacacggggagatagtacagggcctgggaaggtgatacaggacatggaggggtaatacagggtctgggaaggtagtacaggacacggaaagatagtacagggcctgggaaggtagtacaggacatggagagatagtacgggacctgggaaggtagtataggacacggaaagatagtacagggcctgggaaggtagtacaggacacaggaatgatcgtacaggatgtgggaaggtagtatagggcatggaggaatagtacagggcgtgggaaggtagtgcaggacataggaaggatcgtatagagcctgggaaggtagtacaggacacagagagacagtacagcacctaggaaggtagtacaggacacggagggatagtgcagagagatatgggaggaaggccctgcagtgtcatccttaaaggtaggcagcaatgtgacatctgagattggtatggctcttatttatttatttatttttgagacagggtttcactctgtcacccaagctggtgtggactcgtgtgatcacagctcactgtacactcaaactgctgggctcatgcaatcctcccacctcagcctcccaagtagcctcccaagtctggtatgcaccaccagacttggctaatttttttttttttaattctttgtagagacagggtctcactatgtttcccaggctggtctggaactcctgaactcagatgatcctcctgcctcagcctcccaaatttgtggatttcaggagtgagccaccatggctagccaagtttaacttttagagtgagacagacctggattatgaccctccctctagcacattatctgtgacactggggtaatttgtttcacttctctgtgcctcaatcttctcatctttaaaatgaagatagtatctaccttgcatgattatgagaatgaaagagaatacatgcataaggcctataaccctatctgggaaataatggccactcaataaatgggggttaataatgacgaaaatgggctgggtgtggtggctcatgcccagcactttgggaggccaaggcaggtggatcacctgagatcaggagttcaagaccagcctgggcaacatgatgaaacctcatttctactaaaaatacaaaaattagccaggcatggtggcgcacacctgttgtcccagctactcgggaggctgaggcaggagaatcacttgaacccaggaagcagatgttgtggtgagctgagattgcaccactgtactcttcttggtgacagagcaagactccatctcaaaaaaaaaaaaaaaaaaaaaaaaaagatgaaaacaggaacaacctagggtggctgaatttccacggatcttcattcttcaggacctttgaagtcctaactaaaaccgtgtcatctaaaaggaatactagatattaattaatattttgatgcagggcgttttgctcaagtgaaaaaaaaagaataacaagtgtgttggcaggataatactctgtggtaccccaaagccaattattcttagaataaatgtaaacacaacagtgtctttagataagtctctagaaataagacttaaaatttctgtaaactggccaggcacagtggctcacacctgtaatcccaacactttgggaatctgaggcaagaggatcacttgagcccaggagtttgagcccagcctggacaacatagccagaccctgtctctacaaaaaaaaattcaaaaattagccaggcatggtggtacatgccggtagtcccagctactttggaggctaaggcaagaaaatcatttgagcctgggagttcaaggctgcagtaagctataatcacaccactgcactccagcctgggtgacagagtgagaccctgtctcaagaaaaataaaactcttaaaatgtgtgatgcagggattccactcctaggatataatgcagagaatctttcccatctgagagacatgtaggaagttaatttaaacaatgctaaaagcagcaatcttagggctgggcgtggtggctcacacctgtaaacacagcattttgggaggccaaggtgggtggatcacttaggtccggagttcaagaccagcctggccaacatggtgaaaccccatctctactgaaaacacaattagccaagcatagtggtgggcacctgtaatcccagctactcgagaggctaaggcaggagaatcacttgtacccgggaggcagaggttgcagtgagctgagatcgcatcactgcactccagcctgggcaacgcagcaagactctgtctcagaaaaaaaaaaaaaaaaaaagcaatagtaacaataataataatggcaatggcaatagtgcaaatatccagcaataagaaaatgggtgaataaattatgttcacaaaataaaatactattaaacagttaaaatgaagaactagatctatatctcaacatgcatatatctcaaaaaataatggcgagtgaaaaaaatgccaaaacataattgataccttcagttgagtgtctataatattagtatctgaatttttctattttctaaaaattatttttaaaaagctttgaagttcctatgaggttaaatttctttattgcttttttcttttgtggtaatagcctatagtatagcacttttaattcatttgtatttacataaaaatttgtaataaaaccagaggaatatttaatatttatagtcttacatttaatcattgacacacgtacaacaccagtagcaaaccttttaaaacatagccttttgttccccatgaaaattattcttctttccttttatattgacatcaacaaatttccagttgtttttccttagtaatcttggaaggcaccctccatcaaccctcgacaagtaacatagtacttattccttacacggcaaatgtgtgactctataaagtaggtcatgcccttcccacagaggtttcctcacacaaaccaagtcacatttatagtcttagaaaagcagctggcaagttaagggctgaatatcaggctttttcctagcaaggtttatatatatatacatatatatttactttggaatgtagatatcattaattcatggttaattgtttgcctggtacccaaaggcttgaaaacaggctgagctgttatcaactgcatataaaggtgaagtttcttaaaaatttgtgtaaaagttaaagaatttataagtagtctttaaagtggatcttatatagaaagccagtactgcactgcaaatttatttttaaaatattttttatatttgaaagagtaacttacagttgtttgtatttcatttaggtcctttccaaagctaaaggccaaggaaagaaaaaaatatatatggtaataaagttgcagaagatcccttctgctcctttagtgatgatacatacagagaggaagcaatgctggatgggttctttgtcaaaatatttgtttggcaaaaatattcagaaaactatgcaagataagtaaacattttagaggacctggaatgtaacgtgaaggcaagtcttggctcaatcaacatgaaagaaacagtctcacttcgggtttattacagacacatattcatggtctaatcagcatctttaagcatgatacacaacagacagtttttaaactcctttatatttttaaggcaatttttacagttttagggttatttaaagtcagtccctgcttatagatgccataatactattcattcctattcttttacattgatatttattagccatgtcaaaactttcacagatttttgttttgttttccttttcttgaatgccttcctatttcctacattttttgtcacaatatatctgctgcaattgcattttagtttgtttattctcctatcacttgccctcagaattcgtatatatgtatatatgtgtgtgtatatgtaacagactgtacgtagtcagcattgacgtcatatgtcagcactgattaaactgcaaaaaaaaagtttaattcctatgtcgtccatctctaaaatgttttttttattattgacggtctattctagttcttatctacacacatactctactttcaactttatatcacatttttacttagcatcatacatttattttttgatacggttacatcacttttggttaagattatatatgtataaaattttcttcaacttttttatagtagtgagcatttatgtctttttaattatttggtattacaaataatatttccaaaaccaccttcataatacatatttcctcctttatgttacttcccctaaaaaatgactattcagaaatgggaaatggagtcaaagttatttgccaaaggatactaccaaattacaacttttagtaatacataaacacagaggttgcatgaaaacttttttttttatgttttagatttcaaagaaagttttcctgtatatcctctcagttgacattcataattatcacaaaacttctgtgatgaccttagtggattattattctaaattctacagaggaggctcacagtcgagtgacttttccaaagtgaccttcgtggaactagaataaaactcagacctgcctcaaaatatagtggtgcttccacactgctgcaattcctctatgaccttttaaataaaagtcttcaacttgaaaattctccaacttccttaatttttcttgactcttctgtgtagaagactttgaaagtcttcactccagaccaagatttcaaaatatttaacgggcccctgcatttattttttagaatgttgttagggcaagataagctcttacagagagaatgctctccagtgagatacaatcattcagttagaaacatcatgcatctcatttataatgcatttcttattcgattaaaaagatgaactcatgagcatctttggacagataggctgcgcaggctggaaggagggcaaacaagtaagcttactacaggcgctatgctcaggcaatgcaacagaatgttcaaaatgcaggtacatttactaccctaaagtaaaaataagatgactaaattttgcagaagatgtttaaaataaaattttgagtgagatgtttacttttcttcaaatgtcagggaaacacaatgaagagaaaatggaagcattttgaaacatacccagcatcaccagaggtctctgccgccgaatgttgaattagaatctcctctccacgactggctactgagcgaaggagactcttctgctcggctaattcctgttctaactcctgctcaagggaaaggacaaacgcaaacacatttgctactttatgattattgcctacaatcatagttctagctataaaattctcagagaacttcggtagtgagcttttaagtttgcatattgcataaagcatgaggtttatgtaaatattcaaatgtgtctccaaagtactctgtagtgttcttttgctttgatacaggatacctctgaaaaatctgggggttaaaaaaaaaaaaaaaaccaccaatgggaaaagaaaattttgccgggcaatagtgccctcaagtggtacaaaatgtactctcatttttcaaaatcaatattgtcatgctaaaaggatagatccttgggaaaagtggctttttaagttctccacttaattgataaattaggttatcaatagatttggctttaattcttcattatttataataaatcctcttgttatttgagaaaataaaatatttgaatatgctttttacatacagttaaggtaccaatgagaaatcattcttattcatcaaagttcatttgtttcactaggcaacaattagcaatcctattttgtaacgacatctacttgaaagtaaaaatacaaactgcattcattaaaaaaaataacaaacatgcaacttacactttcaccaaacctcaaaaggctttcctgagatttatattaaaattaaatagattcagagggcaaatctgaaaacagaataggtatctctggtaaagaagatgagagccatgttacactatttgtaaacctaaacacaagcttttcttaaagactggattttcaaatgaccaatcatcccagtggtcatgagtcaatacactgaaacaccaacatcttgcttcattcaaagagaagataaagagacactctgtctttagtacagaagcaacttgtctgtccttctgaaatatgcctctcaggttcttctctgggcagatctgcaagctagagagaggtaggaaacactttactttttgttgctggagactgctctgccgctgctgggtccatgtggtgcgagcttgggccagccattcctggacgccggggctctgcgtggctgttaggtcaacatcgctctcctccttctcctgtgctgttccctgcttttaacgaggcagaaatcaagtcatgctacacaccggaaaaccttaaccaaaggggagagaaggctactttggtgtgatctatgtaatgataccaaagtggctccactgggatgtgaaaccacattttttaaaaaaaacagtaacacaaaacccatctaagttatggcatttgcaggagcaagaacaacatacagataatcacacatagaactgtttgaggggaaaacccatatatttagaggttagtcttttagctgaccaatgtggtcatcagatattccagattttttttccacaaaaacataactcaagatcctttgatgagtttgttttttaagtcacacaaaggtaaactgtttctcaaatgatcattacccacaataattgtgtctctcccgtgaaagcattaccctgccttatgtcactttctctaatccaggtccagacaatgaaagatttttagaataatcttcctaaaaatttttctaaaagattattaatcaaagacattttaatgtctttgagaagcaaaaagttcactgttctgtaaggcatcatactctctggaattcagtaagaacttaaatttgattctcagttcatatgggagaaaatgtactgcagcatagaggcaaggagtctaaacaagggtttcccaggccggctggacatcctctgttccacctttcacagaccaggtcttgacctctatgtcacagagcctcacctccaccacagtaactcaagtcccaagacactgaactaggcaggaagcctcatccctgatactggtctgtgtaaaccttctgtgtctaccctactagggcgatagatttaaattattcctagaattctctatctttgagagtctgctgtttatataataatatttatagactgacctacataattaatagactgtactcaaagatgaaaactctttaagagtctttctttcagaaccatcaattagcacattaaaaaaagtcatttactgtgggcacgtgtggttaccattttacaaattcaaagcttaattgagccttgagaggtcagtggtgtgattattaaaggtgagatctctgaaaaagtacccttcactccctccatcaccatcaccagaaactggcccattgctaagctggcttggagaaagtctgactaaaggagaaagaccaaagtaatgactcagcacctaggcaagagttgatccttcctgcctgattattctaatggaatttgaaaggccctaaaatgttgcacatcaaatgggattagttctgaatgagagcttttctactcacatagattcatctgtcaaaggataaattataatttcaatataactcattcactacttaataagcactcactagacactgttctagaagctgggagtgttttggaagccagatgagggccctggtggggagttagactataaacaaacagataactgagctgaagataaggcctacagagactgataatgggatagaaagttttagggaggcctaaggaagcatctttagaagagacaattgcactctgcatgacgagagaccaccagccttgcaaagatctagagtgagggcattcagacccagggaacagttggcacaaagaccctaaggtgaaagaaatttgccatttcagagagaacagagcagtgaagaggacagcagggctggcgtaccatggggcagaggaaggatattttacaggttgcttccacggaggagcctcctgccatctatttctggagctgctgctcgcctgcccctggttgttctttgcaatgtctgagcacaacatgggacccagccattccagctcatccaacctaactgcccacagagacccttctctcgctctcctattttcagagttttatactcaccattttagggaaatagatgggatctgtttacctttctgtttcttctttttttcattagaatctcatgattaaattgtctaatagactttatctttatctttgcaaggcggtgtcggtgcttgaagctaaatgaacagtaaaaacctgtaggtaatagtatataaaactttctcccagattctgagcccacccgagctcagaggtacttcctttcctttcagatgatccagccagagattgcagtttaggtagaacaacgggggtgcaatggtctaatatatgctagttgcattttgcaagaccttcagaatgggtgactagtgacactaaattctccaccttctgcggaatttctcaaagataagcagtgattttcctagagatgggaagtttgggtggatgggcattctcccagaactggaacccatgattttctgcatgaaaacagattctctctcatctaagactccaccaccttctaagaataagctctaaaagatcctggttcttccaagcaaagttgaaacagcagttcaaaaggaacccatagaaaatggcctcaagaaatcagtggacgagactgaaagttgtccccatcagagctgctccagctgccaaagtagtggccctggccatgacctgctgacttgcttttgtgggatccaggccacttcctctctgcttttctcttcagcaaaaatttgtttttcagagcccggcctgaagactcccttggaaaattctccgagccctgagcccaacacgctcttctacaccagttactatggtctgattgagagaggttggctcaagttccttacaccaaatttggatttggaacactgacaatcgaaatgttaggtcttaacaacttcctcacttttatatgcacagatatatattcagattctatgcggttagactcagtttttcagtgagtgaatttttctctgaatgatttagtcattgtgaaacataagacttggaccacaggaagcaaaccatgattaagaatccagttcaaatttcattctctttcccctggggataagaaggtgcagccagaaggaatgtaattatggtaattactttctctgaggtgtgataacagttttctgccatgcctagggaatgcagaggttaggcggtttctgtcaccagtccccactgggtggggctacataaactttattttggaaatactagaacagtaaccacttttgccaggaacattccttggaagatgaatgaggactgggcagtgctaaacattacataaaacatttctttataaagctttttattattttatggggcaatctctctgttcttttaatgaatgataatgtgtgaaaaagacccagcttcatgaagataccacgtaattcaggagatcttactacatgcccttaagatcttcacatagagaagcagtctatttgataggaaacaaaaaagcatagtcattcactgatacccatgcaagtcaaattagttaaaaggaatggaggtaagaggtattaccatctcccagcttcagtagcactaagtaatggtgtgcttacagacttaggaaggtattccaaccctcctgaatcatccaagccccaattaaagagcattaacattgctgagggctgcatttaatggatgatttgttttctgcaattaactttagttaatttcagattaactccaaattatttttagttttctacataaagggacatgatccttttcatggcaataataatgtaaacagggctccttttcttcccacagatggaaaaacaatcttccaggaagctctaattattttaaaagatctagtaatattttatatgctgggaacttcattagatgaaagatgatggaatttatagatagtttaaaaataaacagtaaccaatttccatgtagtaaaacactaccacatttttctgtatttacacttcacccaatgtgggcagggtcaggacttgactcagtttaaagaattcccgtggacctgggcaggatctgctgggtgtggacaccacagtggtgtgtacatgctcagtccagcccgctaagtctcaagcctggcctttcagcatagcagaagcttcttcgtctcaaagaatgtgatttggaaacagttggttattgttattaattattttaactgctgcaatttgagcatttattgtattacttgcatttaaatcctcactgttttttttctttttgattattttttccacatgttctaaagaatttttttaagttaaatattattatccatattttacagatgagaaaactgatccgtaagaaagttgtggaaaatttaaggctcttgccccaggtcacctcgttaataatgaatgggaaaaagataaacagatttcaatcctggcttgtggatatgctttctttggcacacaaattattttaaaattttagatttaaatgtcaacgtttaaaagttgggaggctttagaaataaatccacattccctatctcttgaaaaactagaagatccagcaatgccacttgtaaattcttgtgtgataatagctagagcttagtaacagctgcttcttagacaggagaccagcttgccaagggccaggctgggcctgctcccctcattggttttgcccttcccaggccacgagaccttggaatttgtggttcctgccttgtttaatccctcttgtgcttgtgagtgaggatcaggccgccccttcccttactacctgcctctagcggtagggtggggcaagggagtaataagagctttataaatgattgctatcctacctaggaaactttcaaggctttccctttattttagcttctttagaaattaagttcattcagagatcaccactgaaaatagaagaaagcattatatattagacctataatagctgtttacaaaactaggtgaattgctgtctacttttacagctagaaaatcattctacttctgttcagttttagtatgtgtaaccttttcttttgactttaattacaaagtcacattgcatgtgcattttcaagtgtgtaaatccaagtgaaaagttatattttttatttgcatctatttacccaacacagagttcaaacgtcttttcatatgttcattgtccatttatatttcttttcctgtgaattatctcttcatatcttttgtccatattctattatttgatctttccttattgttttacaaaagatttgtgaattgcatagtttcttccctgtttgtctatgtcttttgttttattttgtgttactcattcctccctgtctatgtctttcaatttggttacttttttgggggtggggaaggggggtcatacagaacttttttatttttgtgtagtagtttcatttttatttgtttatttatttatttacttattcatttttgagatggagtttcactcctgttgcccaggctggagtgcaatggcgtgatctcggctcactgcaacctctgcctcctcggttcaagtgattctcctgcctcagcctcctgagtagctgggattacaggttcccaccaccacacctggctaattttgtatttttagtatagacggagtttcactatgttggctaggctggtctcgaactcctgacctcaggtgatccacctgcctcagcctcccaaagtgctgggattacaggtgggagccatggcccatttgtttatttttttagttggcgtctcacactgtcacccaggctgcagtgcagtggcacaatcatagctcgctgcagcctcaaccacctgggcttaagggattctcccacctcctcccagcttctcccatcccagcttccttagtagctgggaccacaggcgtgtgccaccacgcccggctaatgtttttattatttgtagagatggggttttgctatgatacccaggctggtcttgaacttctgggctcaagcaattctcccttcttagcctcccaaactgctaagattacaggcataagccaccaagccctgccaatgtattagtttaaaagaagctataaaattatgggtttggggtatactggcaaaggttttccctatcctaagattaaaaaaaaaaaatcatacattgagtaccttgcagacttaagttttatattgaaatctttgatccacctgtgatacatttttctgtaaaatatggggtagaaaatacagtttatcacgtttcaagtgattatttacagagtgagtcatattttgtccactgatttgtaatgccacctaaaatatttatcaaattcctttacataccaaatctctttctggaatagttattgtttaattttctgttcacatatttattgcgccaacaccaaactattttaattattgtaatattgtattttaatatgtgattagactggccgggcatggtagctcacgcctataatctcagcactttgggaggctgaggtgggtggattgcctgtgctcaggagttgaagaccagcctgggcaacattgagagacctccatctctacaaaaaattaaaaaaattagctaggcaggtggtgcgcgcctatagtcccagctactcaggaggctgaggtgggagcattacttgagactgggaggcagaggttgcaatgagctgagattgcgtccctgcactccagcctgggtgacagagcaagaccctgtctcaaaaaaaaaaaaacaaaaaaaaatccacacacatatatgataagactaataatccctcaaaactcttcattttcaaaattttatatgggatattacattattcctctaacttgttttttgtctatgtaaaaactataaattctcgacttcttttttttttttttttttttttgagacaggatttcactctgttgcccaagctagagcacagtggcacaatctcggctcactgcaacctctgcctcccaggttcaagcagttctcatgcctcagcctcccaagcagctgggattacaggcatgccccaccacacccggctaatttttgtatttttagtagagatggggtttcaccatgttggccaggctggtctcaaactcccgacctcaggtgatccacctgccttggcctcccaaattgctggggatacaggcgtgagccactgtgctcggctgacttcattttttaatttttattttttgttggattcttttatgcttttcaatgacctaacttcatatttttaataagccagtcatcttcctaaatttctccattgcttctaaatagtttttagttgattaagtttggttttccatatcatataatcatatcatcagcaaaaagccgaaaaaaaaaatacataggttagtcctaacaatcatcctcacactgagaaaacagaagcaatcacagtgaacttccatgaagtttccgttaacaatatttatgtcctacttcctaccagtatttgtattccaacatagatgctttccctccctcctcattttacttggagaacagattggcctggtctcaaccattattgcaggagaaaggtgtaaatggtaaaggaaggcacagtttggattaggccacaagaaggagcagatgataccatcagatgcttatagggttggggcagctaatgggcttctaaactatttggtccctggcttacttagcaagaagggtagggaagaccaaactctgcactcttttttttttttttttttttttttgagacggcgtctccctctgtctcccaggctggagtgcagtggtgcgatctcagctcactgtaacctctgcttcccaggttcaggttcaggagattctcctgcctcagcttcccaagtagctgggactacaggcgcccaccactatgcccggctaatttttggtatttttattagaaacggggtttcaccgtgttagccaggatggtctccatctcctgacttcatgatctgccagccttggcttcccaaagtgctgggattacaggtgtgagccaccgcacctggcctgtgtactttttatcctatccgtttcctccccaacaagaagattgttcttgcaatcacactcctttttctttttcttttttttttttttttttttttttttgttatgagacagagtcttgctctgtcgcccagactggagtgcagtgatataatctcggctcactgaaatctccacctcccaggttcaagcaattctcctgcctcagcctcccgagtaactgagattacaggtgtccaccacaaggcccagctaatttttttttttttttgtatttttagcagagatggggtttcaccatgttagccagtctggtctcgaactcctgacctcaagtgatctgcttgtctcggcctcccaaagtgctgggattacaggcgtgagccacggcgccctgcccacattcctttttcaccaacttttcctctattgagttatttccatcaacgtgtaaacttattatttttctgatcttaaaatgaaatactcaaattgtgatgaatgtaaaagaaaaaaagagataaaattttctttgacccacttctccttatagcttatctcattcctctatataccactttacagcaacactcctggagtagcctttactttccctctccagttcctctcctctcattgttactttcatgtcagagtgctttttgcctccaccactccgctgaacagctgttgttagtagtcctaacaaaatctatttgcaaatgtttgccaaagtccaagagtgtaaacttaaagctgcatgctaaaatgtcagcgtaaagcaggtacacacacaagtacgcgtcaccgccaacctgttcctttacctggcaaaccttagaaggagcacgtgaacagtgtgccaactttcagctgtgggccagcggctggaaccctcacctgcatgttgagctgcttatcatgcagggctctctgcagctccagcaggctccccttgagccttctcagctttccagccagctgctcggcctcgtccttggtgtgagctttgccctccagcagcaggttctcattgtggactgacagttctgataaagccaccaccttctgctctatttccaccagcatattctgcagcaacagaaataagaatgaaactcacacatctccccagcctctgcaaagactgtttcccacagtgaaatacagccctttggagtcttttacgaaacggacaggctttcatgattttttgtagttttcccacggccttgacgagtaagtagtctgtaggctttttttttatattttttaatttatttttatttttttagacagaatctcactctgtcgcccaggctggagtttagtggagcgatcttgactcactgcaagctccgcctcccaggttcacgccattctcctgcctcagcctcccgagcagctgggactacaggcgcccaccactatgcccggctactgttttgttttttagtagagacggggtttcaccgtgttagctaggatggtctagatctcctgacctcatgatccgcccacctcggcctcccaaagtgctgggattacaggagtgagagccactgcacctggcccttttttgtttttgtttttttttgagggagggtcttgttctgttgcccaggctggagtgctttggcatgaacatggctcactgcggcctccatctactgggttcaagggatccccttgcctgagcctcccatgtagctgggatcacagacatgtgacaccacacctggctaaattttttattttttcaacagaaacaaggtctcactttgttgcctgggctggtctcaaactcctgggctcaaacaatgctcccacctcagccttccaaaagtgttgggattacaggtgtgagccactgtgtctggtgacttttaattgtctgttatggtattagaggggtccataaaaaatttgcctgagcctctcaatttttcttttcttttctttttttttttttttttttgagacaaggtctcctctaaaatggagactaaattagagaaaaagaaaaatagcctttcttcttcctagataagacttaaaacaaaaaacaaaaaagactaaaaaaaaaaacaaaaaaaagttttactttccttataaatcattgtttttatgttaattctgcaccctttgaaatgtactttcttctttatattaaataaagtaatttgttaatgagaaaagatacttcatttccctatacaaaatcaaaattaagaatataaagtcaggctgggtgtggtggctctcacctgtaatcccagcactttgggaggccgaggcaggcagatcgcttgagctcaggagtttgagaccagcctgggcaacatagtgaaaccccgtctctccaaaaaatacaaaaaaataagccaggcgtggtggcacgtgcctgtactccccgcacttgcggggctgaggtgggagaattgcttgaacccaggaagtcaaggctgcagtgggctgaggttgcaccactgctctccagcctgggtgacaaagtgagaccttgtctcaaaaaaaaaaaaaaaaaaaagaatataacatcaaaccaaaaaactagaactaagtagaagagtaatacttttattaaaataggaattaaaagatgatttcctgaggattattgttaagaaattaacataattctgtgcagggttgattttaccattaggcacagcaagtacagtgctgagggtctgtgatgcttttagagccccaagaaaatgtttgattttaatttcttttaaaatcaaaagaaaaaaactgaatataataatatggaatacatcacaacaaatctattccgaatcatgtaagtctttgtaccacagcaattgtaaaactgaaaacataatttttagcacttccatgggggaaacagcctacaaaaatgaagtgcccagacccacaaaggacatcacgtggttccaattctgtgtaatagtcaccgttataattagtgtgcaactgaattcatattagattttaactgacaagattttagctggcttatatgtaagattttaattgaatctaattaaaatttgaattaatttaatgtagtaatttaatattagatttttaaaaactattttctggtgtgatttaatatgtttccagtttcttaaagtaagcttgtccaacccacggaccatgggccgcatgtggcccaggacagccttgaatgtagccaacacaaattcagaaactttcttaaaatgttattttttttttgtaatttttttttaagctcatcatctagtgctagtgtattttatgtgtggaccaagacaattcttcttcttccaatgtggcccagggaagccaaaagattgaacacccctgtcttaaagtatggtcaaaacactattttaatactttggaaaagtattgaaatacattacctggtttatggactttatgtgttacaataaaaacagatatcttcacaagagagaggtggcagtatgataaaacataactttgaaatgttagtttgggtggtaacttcaagtgccaaaaggcaatgggctaatagatgtttcttctcaaaaaataaacattagaaagaagatataaagagcagaaaaacttgcatatggctaattaatctctatcatcatggcaaagaataacagtgctttggatacacatagataagtttcctaaagcattaaaaaatccgaatgataatgatcaatattatgaatctcaaatcacaaataagaatagccaaaatggtgtaccgtaaattaagaaaaaagttagtgtgcactaagtaatgattttcacatatttcctctgagtccaaaaaaaaggaatataaagttgtatatattgatacttaaccctgaagactagacagggttttctagatatttcctagttaataaaatgaaaaagcttttaaggtatacttcacccatgtgcgaagtcaaatatgaagatcatcattgaagtttgatgacaagcatatgggacttcattatctattctttatacttatatgcatttttgaaaaattccataataaagaggtaagaaaatagcattagaataaagactttaatgcaattactcctcacagtaattcctagagccctaacataggtggaaaacacattctctgctccaaaagacagccttcccatcttcagtctccctgtttgcctaaaactgacacttggaaaagttttccgaataatatatcaggattagaaccaaaattgtaacagagcacctagagatacttcctgttgtgtttatttccagtctgactcactgctactgattctccccattggctttgtattccttaataagtactaaatacagatattatggtattttggtatctacagtttttaaacatgacctttaggaagccggagacactgtggtcaatgtttttcaaaaagtgagtccaagtttggatttcatttaagcttttataatgtattacttttctattctttaaatgtataaagtctatgggttgggaaaaatcatatatccacaccaagcctttttatagtatgttttctgtagtttaaaaaaatgtgcttcatgatgttgacatattcctttgagaccattttggtacctggcagtccataagctgggcctccatgtccatgggctccttgggtggactcagcgcagtgtccagagtggccttggtactcaagagccagctgtccagctcatcggcttcacagcgatacctctgcagggcctgttcctgcctttgttcctccagctgatcattcaacttctcctgttgaattcagtagaaggtaatatagatcacgctaaggtaaaatcttgagaatttaacacagtaaagcaatggttccaggccctggctgtacataagaatcactggtaaaacttttaaaaatttcctttgcttaggccacatcccagaacaacaatcagaatttctaggggtgagtctcaaaattggtatttttaaaaagactccctagtgattttaatgtgtacctagagttgaacaaggtattctcaaataacatacctataggaccaggcagtaatagaaatgatggaaatcagtcaaggattagaacaaaacaatggcataaagcggttggtaaatggcagtagacaccggacctctatttctgggaagagtagggagtgatggagactgtggcaaactgaaaaacatgcggcctgtctaaaacagcagccacatacagtttcaggcaattgatccctgtgggaagcggtggcccagtgttaactttcatctccagtaaagggagaaatccaaatttctaggttagctctctgagtttttcaatgattgcaaataattcatgttgaaaaaaaaatcgacgtcaatcgcttcattttgaaacccccacaagtttttcatagagttactggggacaatataaatgaattaaaagttaacttttaaaatactctaaatactttattttaaaaattattttatgaataattcattattttaaaattaattttattaaaccatttaaaatagaaattaagaagtagggcagacacatcggctttaaatttctctaatacaagaagtattaggttggtgcagaagtaattgtgatttttgccgttacttttgcacaaatctaatatatgaatatattatttgactaatcatataataggtaaaactagagagagactacacacccagcaacagggtcatggttaattgcattatggtgtaattagcagctaaataaaataatattcagttcatataataagaaatgtattgagaacccattatgtgccagagaagctgctaagagatacaagatgatagatactgtaaaggtctttagggagcctccagtctaaccaaactacaggagcaacaatatgagtagcctagaagcttagggccaagaatttacgagagaacaaataaaaaaggaagatagctgatttttaacacagatattactgctgcccaaatttgtctctatattaaataatatttaaattaagtaacgtgggaaccagaatagcaagagtattttcatgaattactatgtctgaattggctaacagtgactaagtaggatttattctttatagtgttagtaatatcatccatcaaatgctgtcgtgtaaacatagcaaaccattatgcaaatcctctacaattattcttcacaaggctcatgtctaccaagaatttgctttccacattctcaatatttcacgcctgaaatgagtcagaaaggagtcaaaggacatattcatggctacacactgactgtactctattcgggagactgttttgttttgtttgtttgtttgtttgtttgcttttttgagacagagtctcgctctgttgcccaggctggagtgcagtggtgcaatcttggctcaccacaacctctgcctcccgggctcaagtgattctcctgtctcagcctcccaagtagctgggactacaggcacacaccaccatgtctggctcatttttatatttttagtagagacagggtttcactatgttagccaggctggtttcaaactcctgacctcgtgattcacctgcctcagcctcccaaagtgctgggattacaggtgtgaaccacccctcccggccgtggagaccattcttgaaacacaatcccagcttaggagagggaagcaatgaaaatgtaaatacgtaagtaacccacatacttggtaacacaacgttaaaagttaactcagaagtgaggaggccactttacagttattggttacctccaaaagctgccgtttccccgaggctttcatcctgatggtggacattcgctcggctaagacagtgagcgtggactgcaaggccagctgctccgcagggtcggcctcacaagactcggataccagctcctctgcgagagaggactggagctcattgatttcatcctggagcatgagaatctcatccatcaatgcctggaggaaagactgtggaatcacactcatgtattcatttcttcactgagggatcattagcactagctgagtctcacatccattgggattagcggaagagatttcacctgggaatcattaatcaatcaacaaatagcagcctactcacctacatttctaaatgaaaggccaggacttttctgattttatgtatgtatcactaaccaaagtgagtttgaacaacttaattaatctttctagttttcaataggatcatctgtaatacaaggatcatctgtaataccaacttattttttattttttagagacagagtctcactctgtcactcaggctggagtgcagtggtatgatcacagctcactgtaatcttgaactcctgggctcaagcggccctcctgcttgaagctgggactggtgtgtgctaccacacctggtaatttttttttttttttttttttttttttactttttgtaaagacaggatcatgctatgttgcccaggctggtctcaaactcctggcctcagggaatcctccagcctggatcacaggcatgagccaccacatttctcaatcatttctaagagtctccaatacaacgttgaaaataaaatgtattactttcttcctcaacatgattttcccacattaacctgttgctttccccaaatctgaaacagcattgaactctagtccaaaactcacatggtttctcacaggatgggagaaacctgtaacctatttctatgtcgtcacactactcatttttctcatttaccaaactctaaaaaataagggtctctcccgggtgatgtcttccattcccaagatttcaaatgctttctaatcctgagcacttccaaaggtacatccctaacccagacacctgccctaagtttcaggctgtgtattcaacttacctagttcacgggtgtctgcatagtgttaagtctaatcctgcttccccgcctgtcttccaccacctctcattatggctcaagctggagacttgggaatcactcttcacaccttcctctccttcactcaccagatccaaaccatcacccagtccaatggcttttatctcaaaaatatatcttgtatatctgaatatccccactgcccccacctgaagccaaagtcaacttcctctctcgactgagttgctatataatggtctactaatgagtctatctgcttacactcttgttgctccagtccagtctatatgaagcaattacagcaaccttttgaaaatatcaattaggtcctctcactcccctgctttgaaatatgtactggattcttgctgtgaaataaatcaaacttgttactacactcgtgtagtctcactcttcctgcctcgtgtgccacactcccttcttgctcaccatactccagccttcttcagccactccagggccccacttcagtcacttcctggcttcagggcctttgaacatgctgttccctcaacacgaaaaactcttcccgctctgtgtgagatggctctattcatcctttgctcttaggttaattgtcatatcttcagagaggcctttcatgaccacccaatcctaagaaaatctccatcattctctctcatagcaccctgttttcctgtctatcataattatacttgattttatttctcttttttggagtattttatgacttgctctttagatggaatcttcacaggagaaattgttatttaggatttcaatgaagttggaaaaacaggctctatcaccagagcggcaactatgatttcaagtaaagtaacataggctttatatttgccagcatttcatagtttccaatgtgcccttatttgcataattcctatcttttccacaggactggaggcttcactgtaagtgcagtgcctcctcagagtgggctctcacaatgttaaacagcaaaaaccccttatcttttcctaatatcaaatatcatcatgacaattaatttttaaataaactattaatattatatacatctagaaaagtgaacagattataagcacaccaactatatatatccatgctgctgctacccagatcaagaaatggaatatttccaggattctataagctcttttgacctcctccttcttgctactgctgtcctcaaaaatcaccactgtgttaacttgtaaatatcaggggactttggcccttatttgagctttatagaaatggagtcatacacgatgcactgctctgtgtctggctcctttcatgattgtgagagtcgttcattttgttgcacggagaaagagttaacccatttttatcattataccatattccactgtcgcctggttgtgaattgttttcactttaagtttttctagtgggtttaatagtggaatctcattgtaattttaatttccatttccccgatgactaatgagattgagtgtcttttgtgactgcctgctaaaaatcttttgcccattttccactagagttgttccttttcttattgatgtatggagttgtttgtatattctggataggagtgcctgtgtttcttttggttctgcatatagcaaataatctgttcccactttgaggcatggttttcccttaacgggaagagacttccttaataatatctgttgatggaaagaagttcttaattttatcatggtctaatagaatcaatatttccctttattgttagggcttttggtatactatataggaaatcttttgcctaatccaaggtcataaatagaatacattcgcatacgttatcttctgtaagaatgctactcaaagcgtggtccacagaataataacagtctgcacaatgtttgttactggcttatgatgagataaacatattgagagcaagtgctaagaaacttttatagtaatttgacagttatgacatccaagcagcatttgatttaattttactaaagtatccgtctgtgatggattagaatgttttttaaaaagatcattcaccatagatattttaaagtattattttcaaacttttttttttggtaataacttcacatttagatctacaaaccacataaacttaattttcatgtccagtgtagaaagaggtgaaaattcttctttttttcacccattgttttgcagtgtaatctttgccacaagtcaagtgtctgtataaatgtgattctgctctgggctcgaattctgttccatcaacccatttggctgtttgtgcaaataccacacaatcttaattattgtagctttataaatctccctatctggtaggatatatctttcaactttattaatctttttcaagactgtcctggttattctttacttctggcatttttaatatatattttcccacacatttgcagcatactttattattattattactatttttgagacagagtctcaccctgttgctcgtgctggagtcagtggcaagatcttggctcactgcaacctctgcctcccaggttcaagtgattctcctgcctcagcctccagagtagctgggattataggcatgcaccaccacacccagctaatttttgtatttttagtagagatgtggtttcaccatgttggccaggctggtcttgaattcctaggctcaagtgatctgcccgcttcagcctcccaaagtgctgggattacaggcatgagccaccgcacccagcctgcagtatactttagaattagcttgtcaacctccaccaaaaaacttgctgcaatttttaaaacgtgattgcaatgaatttacagactgatattgtttattatatatgcaaagtattttttatacattcaaagtattatacattcaaaaacttccattcagtaaattattttccattatttcataataatgttttgtgcctgaatgctaaaagtataaaatctatatttggtttgattttaaatgctcctccataattagatggatcttattatgtctttgtttttttttttttacactgatccttctgtacaagcaagaagagcctcctaacaatttcacactgtgttcattctcatcctctcttctgtgcctttccacacacatttacatttatagtgcctcctacccactcctgttgccattccaaattttcaaactctgtctcctcaaagtccttgttagatctcatttaacctactttccactaactgtagcccacaagcagatttctgttttctgtttgatgtgttggtaactctcaccagcactacctcattaaatctcattggctttgaccaaccaggtgtgcactgaaggtatcagctgccatttaaaactcacaatgttcttaaatagctctctgaatgttctgcagtcagtaataaaggaattaggaaaatctggaactgttcacttaaatctttttttaatttttttgggagacagtctcgctctgtcacccaggctggagtgcagtggcacgatctcagctcactgcaacctccgccccctgagttcaagcaattcttctgccttagcctctcaagtagctgggactacaggctgcaccaccacgcccagctaatttttgtattttcagtagagacaaggtttcaccatgttggccaggctggtcttgaactcctgacctcaagtgatccacctgccttggcctcccaaagtgctgggattacaggtgtgagccactgtgcccagcctcacttaaatcttgttagaagcagtcctctccactcatgcttgagtttactcttaaagatgagtggacatttttggaaggtagctagagtttttaacttcaagatctagcagccaggctcagggggggcgtgagattttcttttggggtcataaaaatgttttggaaccagagagagacagtggttgtacagcattgtgaatgtactaataccactaaattgtacaatttaaaatggttaattttatgctatgtgaatttcacctcaattaaaaaaaatttagccatcaaatatgtcttcagtcccataactctgagtataagagctggtggccagcagctacccgacaatatatgattcaagataaggagaaagagatgaaatgcatgcttttgggtttctgatttgtaattgcaaacttggcatgtgtatgacacttacatagcttagagaagttccatgagcttctctaacataaaaactctttaatagtaagggtgaaaagaaacacggaccttatgtgaccttcagaactgtctacatgaacacaagtttttgtttgtttgtttgttttagggggatggaagcttgctctgtcacctagctgccatctctgctcactgtaacctccaccttccaggttcaagcaattctgctgtctcagcctcctgagtagctgggactacaggtgtgcaccaccatgcccagctaatttttgtagttttagtagagatggggtttcagcatgttggccaggctgaaatgtttcctattttatttatttatttatttattttttgagacggagtctcgctctgtcgctcaggctggagtgcggtggcgcaatctcggttcactgcaagctccgcctcccaggttcacgtcattctcctgcctcagcctcccaagtagctgggactacaagcgcccaccaccatgcctggctaagtttttgtatttttagtagagacggggtttcaccatgttagccaggatggtcgcgatctcctgacctcgtgatccgcccgccttggcctcccaaagtgctgggattacaggcatgagctaccgcgcccagccttttttttttttttttttttaagcctacagtacctggtattcctgggcagtctcccatccaagtactaaccaggcccaaccctgcttaacttccaagatcagatgagagaccacagttcttctcacattctattttagttgttacatatatgaaaaaacaaaacaaaacaaaataaccacagacctctgtgcgctatatatcactgagctttgtgtggcaacacatgtccctaaagcatcagatgcccatgataataaggtcgcaatgacagagggcttaacagtcagtacaacagccacaagtcagctcatgaactgcattcaaaccttaaaatgaaatctgtaagacagccaagcatggtggctcacacctgtaatcccagcactttgggaggccgaggtaagtggatcacctgaggtcaggagttcgagaccagcctggccaacatggtgaaacctcatctctactaaaaatacaaaaattagtccagcgtggtggcaagcacctgtaattccagctactcgggaggctgaggcaggagaatcacttgaacctgggaggtgaggttgcagtgagccaagatcacgtcactacattccagcctgggcaacagactgagactctgtctcaaaaaaaagaaatctataagacaatttagagaggataaccagaaaggcacagcattccacacaaattcagtagtttagacaagtgtttaaaggaaaaatgtaggaattaggttacctccttaaaaaaacatgaatacttccaagagagtgttgggaaagaaataaaaactaaagtatttctattactttttaggaaatataaaaaaccatactggacttcctcacacccattcagttgaaatttagaaatagtaattctataacagtgcttgacatttttaaagtaccattcctgaagctaagaacaaatttagatactgtgataccaccagcttttcatgtgggcagctgtgttccagaacttgtagaacttctggcacagacagcaaaaggtagcaaaaatagctcagatgaaatatgtgatgatacatgaaattatatactaaattctacattattgctattttctttccctctcattagaacattaatatgttctaattatattaatatgatatattaatatatacaattatattaatatgatatattaatatatgcaattatattaatatgatatattaatatatgcaattatattaatatgatatattaatatatgcaattatattaatatgatatattaatatatgcaattatattaatatgatatattaatatatgcaattatattaatatgatatattaatatatgcaattatattaatatgatatattaatatattttctctcttaataaaccattaagccccaatgactggtaatcttcactaaattagctgtacctccttactgctgtgatggctagtacgactactaccaacttagaaagggaaaaaaagtcatgtggttggccttaatgacaagaaaagtcacagattcacttctaatttataattatcagaattaatgtgcaattttgagttgtctccattaaatcccttgaacagaatcatcattttgctccacattcagtttatgtgtgtttccatcctaatgcctgagcaacagggtggtggtgctgattggaagctaacttgcattttcatgtacgaactctggaagggcagagcaggccaccagtatcctgttttcatgcagctcctaactattgtgggagccagtgatgggtctttggcaattgtgggcagcctcctgggccacaagaatgggggcttgaacaaaggtggagatgtcctgaagctggagagagggtcaaactacttaaactttctgcaacatcgtcatctgataatctgagtgagtgactctcaaatgcactctaatccagcccttgcataatttacactatattccttctgaatgcttaaagaacggggcctcctacagaacagccatcgaggttggcctgaggagcacatactcaacctgaaggaagctctctggctccttccagtacagtgaagcagaggtgcagggaacagctggacagacagaaccgcaggagcaaggaagacctaggagccacagggagcacactggagcaacagggacaccccttcagatcagaaagaggtggccgctggcaacagaaaactgaagtagcagctaaagagaactgggagacactgaggcccctttagaaaggagaggggtttgggagactagcagtctagtgataaaatgggggaagctcagaagtaaatggcattggaatagtcccccaagcccctgaccatcctcctgattggtctggtcttggataacaagggttaattctcatttcgtgctttcatagcatcctctgcaaatgtggctaagggtgggtgactgtgggatagcagaaagacctacagaaggtagttttttaccaaaataaggcctaaaaatggacgctatgcacttcgatctctatcttcagaagtcacaagagtgtaaaaaacctgaaaccactatttctcaatatgctgtctctagatgaaatgttctcatttttatgttatactgaaagatatatactgcaaaagaatgcaactttatctgactacacatatgaacaggcagtctattccaaggttatcctgcttccaaaactagaaagatgtaaagtagaagaaagacaaagtacaacgtttcactcctaaagctgttaagttaccctgtgttgataaacatgcttaccatgccatgctttcatagctcttaattaacatctaaaaatatctttctttcctcctgccttctgaaggattgtcacatgctcctgggttcttgtcccagccaggcagcattttcctacctcacggtgatgaatatgtaggagaatgtgtgcctcagtatccttagaccccagttatacaaaataaatataattttaacagcgtacctcattagactgctaaagtattaaccagactttaatttctgaacatttcttagcatgcattttaacttgacacatttttaacattatctttctgcattagattaatgtaatgatctctgtttttcatgtaaagctaatattttgcctagtttaaccttttaaaaaatgatttaagtcagggacaatcacaagatgagacttagaacttatgaagtctgagatgtattttctgaagtgataatggaggggcaccccctggctaagtttcttaaaacaacaatatcgagaaaaggtagatttggagtatattttattcttacaacaatggctcacaacaaaatcaaaataacttggcaactctaaggaaacacattttgtgtaatcaaagttaaaaagcaacataaatgcatgtagctttctttaattagattcaaggtctgcatgtctctctctctctccctctctctctttttctcagatccctccctgaatcagtagtagaaatgaccaccattaggacccttgtttactctggaagaactgataaggttaaaaaatttttaaaaagtcacctggctgtctcaaacacatgcctgacaggccaaccagtcacaacagtgccttattcaatcaagtaggaaactgaagtcatggctatttgtacctgatgttcagccatctggctttctggactcctgccaggctctgggctctcactgagtttcagctcaatggcctccatcttcgtagagatggactggagggagtcctggtacttctgctggcgttccaaagcttcatagagtgtgcgctgcttctcactgatctacaccagaaaagggatattaccaaatgcttcccagccccttatctttcagattacaacatttctttcttcagtgctttacctctgtggcccaacatagggtactcaactgtggactggatatgtaaactctctgcatgtatttcataagacaatcgctaaggttactggtgtctggtgggcataaactagtccaccttgaagacttaccacattctttaaggtttcccaagaacgctgcaaatcacccagtttggcagtagcggatggctccaatcccggttcatagaactcctgggatgcggatgtgctggggtgaatttttgcagcatctgtctgcaacctctcagcagacaaggcttggtaatatgcaatgtcctgtgagtgcaaagcacagtattgaattaaacaaaaagacaaagtctagattaatatgctctgggtactgttggtcatgtcaaggaaaggtttcagatctacacctttcatggggcactacaaactagtaaattagtaaactcttgtgacaagaaaaatgtaaagactgtatcaaagcacactgtaattgtttcagaattttggtttatatatatcaaaaaacaactttaccaatatttcaagttgccaaaactcaatcttattctatgtttgttaaatggaaatacaaaggatttaagcagtacacatgtatttaaaggttgattagaatagcaaaaaaagagaatcttaatgatctagttcctaaaatgttgtcgaatgtattcattaaagttttaaataatttaaaaactacttgacttaaataaaattaaatctacagatgcagccagatcttcactatctgtgggttcatcatttgctgaattaatttaaatattttgatattaaataagaaaaatgtaatggggaagttaccactactctaagaaacaaataatataaaggttttctatgcatttcctaaaagtatacacacaaaaaaaacaaagtgaatgatgaaatatcatgctttcaaattttttaaacctattataacattacatattttatttgtactgataaaatttactatatcaagagatatagtaaagatatatcaagagatatagtaaagatggtttttaactgtttctatggttatttatctgtatttcagtagaaatttaattgggggagtaattgctattataaagttcattgcttttgcagttgtactgttgaagggaattatgtcagcttaaaatacctgagtcttattgagaatcatgtattggtaaaaagtattgaagaaggctccagccgtctgagaaacaaatgtagcagtgtcatgcggtagaatgaattcagactgggacagctgagattctagcgaaattctcctcttgtgtagctatataattggagcaaataacttatatcttgcacactggttcactcattggtccaatcttgggtgggattgaggattatatgaaataatatttgagtgactatgacagcttctacccattttgttgttgttcctgaggtctccagatgagtccccaacatttattgatgatattggaacatggagactgcttcctctttattcctaaccctgtcactgtcttgagtggattactcttcatgtccttaatagctttagatccattgatcctcactcactcccaccccacttcagtcctccacacccttgtatgctgtcatcgctcagctggacttgtagttatgtctgaagttacttaaacccctttcttgccaagactcttgtttctcttgctcttttaacctttacttcatccacttggaaacccgcaaacatgactcaatccagagtcatttatgcatgtgtgtgtgttactgacacacacacacacacatacacacacaaacacgcacacacacacatacacatgcaatccaagctgtcaaggagatactgcaacttctcaaattttcaaaagtctatgtatattcacactcacccttatcttatgctttccagtttcactgcttaaacctgactctcccacagactctgagaatcccataaactgctttttcaaggatcttggtctattaacatcctctctggctttgttgactttctctcttccatccaaaaacacctgcacgcactgtttcttttatttgttttcttgaaggatatcacattttctaaaaagtccacagttcacaatgtgacggatcgtcacacgtgaatgcacttgcacacacaggctccatcctaatttctttgttttctccctttcatttcataatccaacttctgaaagggtgattttcatgggactttctcaccctcgatccacttctaaattccagtttggactttgatcctgatgactgcagagcttgctctcaccagcttcttctctttgacaaaaaatgatgaattttcatcccttcccttgccagacctctagcattcaatagcactgacaaaccctttccggaaacactttctaaaaaatctctctgttctcctcccagctttctagtcattcactctttctcttttatagtttgttttccactcactcgccaatattggtgaattgataagctccagactcacatatccagatgttcatgcatatcctgtaggctcttcaaagtcaacatttccaaaaggaaccaatttaggaaaaaacaatgaagtattatccatcttgcaataaatggaatgtcttctcacctaagctataaacttgggatttattcctgatttctcctcccccttaacatccactgcttatgggaggatggagtgctaacgatgcatatcctggccacagccttggttcaagttctcattacagtaacagcttcctaactcaaaggttgcaaactggcagcctgtgggctgcctctgacctgcacatatttagtgtggcttatacaatgttttaaattgtttaaaatctctcttcatgaagatagagagatttcattaaaattcacattcgtagcttgttttgcaaaccacaaggtatggtaacactgggccctgtgtctttgttaaagtaatgctaacagaggagacattgcctcatttatgtggagcaggagctgtccaggcctctgtagtccctcctggcctctgtagtccctcctggcctgtttctctcatttttatcaccagggtggaccaagcatgagactgtgtaacttctgtttctaacagctcccctggctctgaatttgcacacttctattctcctgtccacattgatccagaagtatcagttctgtacacagcttctcattaaattccctcagtggttaaatattagcttctggaggaagctgaaattccttcctgtggcattcagggcctccatgatgtggttcccatatccctctcagtctcatttccccctctcctcctcctccaatgtttctccaattacactgaaactatttgcagttgcctggatgggccattttgcttcccgcctccacagcttccaacaggtggtttcttctgcctgaaaatcttcatctcacacgacccaactgcactccaactgcctaactgtgctcctcccttaaaactaaagggggccatccttgacctctgcctgactccagccagtttaggtgccttctctaggccctcccacaacactgtactgccctcggccacactacctgccaccttctcttgtaagcatttgcctgtcctcacacacactgtaagctccctaagggctgtctgggtcactgcttttcgtcttcatcctgagcacattgtggagtgtttggcaaataacaggcaggcctatatgttcataataaatcatgcttgtaaatgcacttatataaattctattattttatatacatgtaaagtaatactattactgtccataaggaaaagcaggaatgcctttaaatggtgtaaacattttacattagatactctattataaatacagaaggctcccaaaagagctagaataaaataaatttattacaaataatttttttctggcagtctcactctgtgtgtgtgtgtgtgtgtgtgtgtgtgtgtgtgtgtgtgtgcgcgcgcacgtggctcatgcctacagatatgaatgacaactcctggtttcttaaaaggatttgaaaatatgtcaccttttatagatgaataatttctatttatttgaggtacatacataaattgaattaaaataaatcactcagtactataaataactactaaagtcaatacttgatgtagtgaggagtcactgttacaaatacgtttctcattgcttatgtgcctaagttataagacttatgagtagattcctaaggaaataaatttggacaactgtagctactatttgatcagtattttctagtttaaaaagcactttcacgattcatgtcacatttcattttcacaatgctgtgaattaagtagtattgcttctcacttacaaatgagggtatcaagggacttcccaggtgcactcagcttagaggagaaagagctgcaactcagtgtgagcttttaacttgaaggccaatgattttcccattacactcttgctccctcttttcaaatgtattcctccctcaactcttctgcagagtctaagccttggcttgcttctaaggggaatcaagaagcctacagcaaaatctaggaatgcctcggtatttctaccttcaagtaagctaaactgttattacattttagctaatagctactgtcagagacagaatacactgtgagtgggaccaggtagttatataacggagatctacttgcaggaacagcaggcacaaaaccttttttttttttaacaactgtgattttataaagcagttctatttggctgctccctgaaacagctgtacacattctgtgcacaaaactcagggtttttaatctgaaaactgaaacttaaggggatcctacatgtcctcctcagtttcaagagacaattttataaatccagtgcatcaccggtcatggtgtcatattttttcattgtcttctaactgacattactatacaaaaataacatgtggccgtaatgatggggttgatttgtttgatgaacaccaagcataatacatttcctttttaacagctccctcagagtaaagctgtgtgtcttaatctaagtaaaggcattttcccctactttgcagcatcacatgtaagtattttagattaacaatgcaatttaattgatgttttcctgtgactaggggagaggggaagaattaaaacaaagcctaatctcactgagttttaggacctgatgaagctttgtggttaatgtcaagaaataataatagaaatatttgcatgtttcatcatttttagggcactttcatgtatcctttgacactttacaagaagtagcatggagatttacagttttagaaaaggtatattttttccacaaagtctcaaataagtatttattattcagtttgaaaaatttgagaacctaaaccatattaaatagaacaattttttctatataataatcagccgactatagcttaatttctgtaataacatctgtaaccatagggaaggacaaatcatcaaagaatgagtaatacatattttaaaatgagaatttgaaaaacactttcccaaattccccacggctccctgaacttctccttttatgttgctgtttttagtttcctctgatcacattgttattatctgtcccatgtctgcctttctctctagactgtcagggccttgcaggtagggccatgctgactccttctcagctgcatcctcaggaaccaacacaaggtttcacgctgagcaggtgtcagaatgtacttgacaaatggatgagttgataatttccctagagctatcctgatttttaccaagagaacagtgtaagtgtattaactaaaggtttcatcaccttgatgttcctttttttttttaatgaggggggattctctttatcacagaaatcctatgacagtctgaatgcttctgctttaaaataaaagtaatataattgaattataatacaggttataaaacatttgctctgtttaatgcttctcccttaataatacatatcaacttctttgaaaaaatgtaatttcatagaatagtttacattttttagttgtcttcactaaaaaataaagtattacttaacatgcattaaaagtctttggttactataaaggcatatttttgatttctatctaacatttgacataaaagctttttgacatttaatttagtattatctacatttaatacatggtaaaaggcttcttataactaaatggttattttattttccccattttatagaaaataaaatttaagattattgaaagataagttaaacactcaaatctagtaggcattctagtataaatatggcagacattccttacattggtacacaagttgcaaataaagaagaagtctgacataataaatggaagtttcctgtcttcaaaatctgagctggtaaatgccagcactattttcaatgcatgttataaagccatcgaatcacgttattttacaatggtgacacacatcttttattttctgttggatgcagaaccccattccagatgattgctggaaactaaggccataatgtcttaaaacagagccttctgggctatcattcccatgacctaatttttgttcatcccactttctgtagcccaggagaggagatgacatactgagacacatgacaatcatagtttgtgcaactataacacctaatagtgtgtccctggaaccaaatgcaacaaagtctgagattcatacccacgatctaatggaaacagagaatggagtcctgcatctgcccagagattattgctagaggaatgccaactgggaggtacctggttaacagaagcatctgtattagccacaggtgaaggggagcgacaggcaggtggagaggaaatctcactgttggttccctcctccccagactcctcagtgaccggtgacagcaaagtgtgacagcgacctgcagtcatctgccacgtaaaatgtagcccaaaggacatgaaaatcaattagctatgttaacataagtcctgttcaggcacaggccaaaacagagttaattataaaacgaaggttaaaattactgggacccgaattcacatattaatcctgtgttagtatttaaaagttctgtcttcaagagaatatgatgctagtaatcatttgtaaaacaatcagggatgggggtgcatatgacattgaagttttgttgttgattaaatacttcattattttcctttctttggagagtttgtggctttataaataactggaaaaatcacgaatcatacaaatgagaaaaggtctgtgaaataaagcttggtcttttgtggacatctcaagtttcaaatatggtaggaagataaatgcacccaaagtactgttattgccaaatgggctcaggtatggttactcattacctgaggcacagcacatataagggaaaacacacagcactgggaaacattatagtcaccaaaatactcaatgcattttagatggcaagtgtataggaaaatagtggtgcagaatagaaaataacaaagttgatttattttaatccaaagccaagctttagacggtctgttttcatatttttctaacaatagctgttcttctaaattgtattacacatttatacagtagagtacatgcacatatgtagttagctagttagcgtggagaccacaactaaatatatatgccatgaatttcccatcccccagacaactaaaacactgtgcaagtaaattattgtttaaagctcagagcctctcagtattattgcgaaattataaacaaatacagggtagacctctgacatgttaagtaattcagctgtctcgagcacatagtttcattttaactgtcattgtttacagtgtcaaagattggcccggcccaacggtagtcaaagagacttaaggaatctgttcctccctctgaatctgcaagatcgaaggctggtccctgaaatcagccacggagagggaacatggagccactcgccaggctccagtcaaagagcaaagccgcggggacccactggatccttaccatgaccacagaggggtgggccgaaggcgtggggaggagctccccatccaggtcctctgtcccttccgccagcccctcgacctcggtcaccgtcagcagcatggtggcgtgcttggctttcatcgtcagcatcttgcacttggaattcaaagaagcgatctgctcctggtagcccttaattttctgcgccagctcctgaggaaacatttcccccaccggggtgtcagagcagcatcaaaaggaaacagaagtagtagcgttcatcttcctgcagggcgagccaatgagcgcgcagagccgcgcgggcccgggaggcaggatgtgtaggcggcgagtcctcctgcatctcgctaccgagccagaccgcaggctgcgcggcgcggcgcaggcacagccaaagtgcccgagcccgcgtccccgcgtcggtacaaaaggagaaatgaggggatgaggccgaatgagtggtttctaatcgcgagaggccccatatggaatcatgaacttccgcaacattaggaactgacaactctctttaaaagcagaaagcatctgaaatttaccagatggttcctgccatggaaattaggtcatgtgatggctaaaaccacaccaaaaaaaatgcaaggctcagctcttaccctactgagtacattcaacagagatgacagtcatttattttacatagggtcacatactcaatagcctgtctgttcctatgtctctaagaattttttttagataggctagatattgcatatggaaatcccaatttttaatgcagattgaccccccaaaaaaattttgtatattcatcaaattttttcttgctcacttcatcatgtctcaaatgttgctgaggctttaactagaactttaaacttgaaatgcaattcggatttagtgtcttttaatttcacttgcttttgaaaaaataattgtttttttgtttttgtttttgagcagacaagaatgaaaaaatatattatgagagatagaggttttaaatattttattaagagcttattggaaatataatctggatagcacataacccttaaaaaggtaactatagattcattttaggagtatggtaattctaaaatattaaagttttactttcttgcttaaatattttaagtatcaaatattaaaattatactttattgcatctttaaaaaacgaaaatacatatttcaaaacatgattcctaaaagtacaaaactattattctttttttttttttttttttggcttctttgtttcagaggctgtcatttattgtgcacatagaacacattttgtgggccgggtgcagtggctcatgcctgtaatcctagcactttgtgaggctgagacgaggggatcacttgagatcaggagttcaagaccagcctggccaacatggtgaaaccctgtctctactaaaaatacaaaaattagccagaaattgcttgaacccgggagatggaggttgcagtgagccaagattgtgccactgtactccagcctgggcaacagagtgagactctgtctcaaaaaaaaaaaaaagaacacattttgtgacaaaaatattaaattgtaatgtctttaaaataattgtgtacatacatacacatacattcatatatatacacacacatatacacatgcacacacacatatgtacacatagtcatccctcagtaactgaggggcgttggttctaggaaccctcttagatacaaaattcacagatattccagtttctgatgtaaaatggcatagtatttgcatataacctatgcacatcttcccaaatactttaaatcatctctagattactaataatacctaatacaatgtagatgctatgcattataaataggtgttatactgtacaatttagggaataatgacaagaaaagaagatcaacatgcagagatgcaaccatcctttttgctcctcaaatattttccatccatgattggttgaattcatggatgcagaacttatggatatggagggctgactgtatgcaaaacacgtgtgcacatgcacacacacacacacacacacacattttgttattattgttgttttgtttgtttcttcctgcccaactgaagccgagtggagcaaaaaacagtccagcagaactcagccagcaggcagtcagtcttcttgactcctaatagtataggaatttttaaaacaaggatttaaaaagtagacatcattgcttctttacctctggggatgcagttaattaaacctaataggatttttaaaaacagtgattgaatagctatttactatatcttgtctagtggctagcacgtgggtactcaataaatgacatttactgcaactagttaatactagaaaagagctctagcagattactggactccttgaatttcaagtcaccaagctttcgcacaatggtttgccattatacaaaaattgaaggaatcttttttattattttattttattttatttttgagatggagtctcgctctgtcacccaggctggagtgcagtggcgcaatctcggctcactgcaacctccatctccggggttcaagccattctcttgcctcagcctcccaagtagctggaattataggcacgcgccaccatgcccagctaatttttgtatttttagtagggacatgttggccaagctggtctcgaactcctgatctcaagtgatttgcctgccttggcctcccaaagtgctgagattacaggcgtgagccaccatgcccggcaatttgaggaatctttatgaagtagacagagttagtattaggccttccaccctttgtaatcacatggctgggcacagctccctgctacagtatcctgcaaagatgtgcccacactgacagcaagtgaccatttcttaagctgcaattctcaaccttattgtgtacaaaactcatttggattgtttctttaaaaaatgcaactctggtcaccacttccaaaggttctgatttaccaggtgtatgacagtctgcacttcataattagcccatgtgactccaatgcacgtgacttccactgagaaatagtactctacgacttgcttctgtaagtgtaaacctcttgtaatctcattacctttgagggttggttattcaagctgtggtcaaatccactaaaataaaatggaacacttggtttaatgttacccattctctttataaaatttctgaaaatgtttataaaggtaggaatttcaggtagagtggccgctagaagacaagcagccctctgtggccagtctctggtattcatgagcaggctttccgcatcaggcggaaagaaaagaggtgtgagtatcctctcctatgatttaaaagtggcaggatgatttttttcaaattaaatgcaacttttgaaaaagtattattattattattttttgagacagagtctctctctgttgcccaggctggagtgcagtgacacaatcttggctcactgcaacctccacctcccaggttcaagcgattctcctgtctcagcctcccgagtagctgagactacagacacccgtcaccacccaggctaatttttgtatttttagtagagacggggtttcaccatattggccaggctggtctcaaactcctgaccttgtgatctgcccgccttggcctccgaaaagtactgggattacaagtgtgagccaccacacctggccgaaaaattatttttaaaagtttgaattccttaggcataaataaatgatcagttatttttaaagttatttgtaagaaaactagattcaccataagattgagattcaattaaaacaagacagaaaatacaggcagaaaccctcttcccaatttgtatgttatcatcagttaagctttctccactcagcactttccttcctgtgtttgttttatacatacaatgaagctcacacaggactgcatcattttttacatgaaaatgtgttctaagtcacagttggtttaaaactaacaaacataacatggatgttcagaactgtggaagaaaatgtgacaaaataaacagctcactggaccaagagtcaggaagacatagtccactgctgactgagctgagttcactctgtgaccttgggggactcatttattttcctgggacttcattattctcttttgtttaattaagtagcccagatagtttctgttacagtggaagaaaaatcacggaatttggacacaaagatactgagactgagtccaatttcaatcagttactagatttaggagctcaggaagtcattttttctaagttcagtttttttgtcagtaaaataaagatgattttaaaaaaatccttaccccggccagtcgtggtggctcactcctgcaatcccaacactttgggaggccaaggtagatggatcacttgaggtcaggagttcaataccagcctggccaacgtggtgaaaccccgtctctactaaaaatacaaaaattatcagggcatggtgatgtgcgcctgtaatcccagctactcgggagcctgaggcaggagaatcgcctgaacccaggaggtggaagttgcagtgggccaagattgcaccactgcactccagcctgggcaacagagcgagactccatctaaaaaataaataaataaataaataaataaataaataaataaatacctcatagagttggtataaaaaagtgatgtaaaattttgtaagttactttaaaaaacataaagctggctgggcatggtgactcatatcttttattctagcactttgggaggctgaggcaggcatatcacttgagcccaggagtttgagaccaacctggataacatggcgaaactctgtctctactctacaaaaaaaaaaaatgcaaaaactagcctgaggtagtggtacatgctcgtagtcccaaatacttggaggctgaggtgggaggactgcctgaacccagtaggtacagactgcaataagccatgatcccactgtgagccatgatcttgccactgcactctagcttggatgatacagcaagactgtgtctcaaaaaaaaaaaaaaaaaaaaagcacaagtttcttggggaagaaaaaccgtacaacaaaaaagtttagtagtaataacaattattactccagaaaagattttaaaaatatctgtaccatgatagaagagttgttacaacaaaattttggatcttcctagatgggattaaaaatcgtttcaaaataaatatgtaatatatagtctaacatatagacctacataaacagtggtttcaaaaatctacataacactttcatttaaccattgtgtaagaaaaatcattaacatagatgatgtctacagttgttggagtaaatgtagatgggatatttaaatgattttgtaagtcatatataaatgaaaattattaatgtttgtagatgtcaagaaattaaataattaattgcatttggagaagagggtgagatttttcatccttacaaagcaataccttgaatcttttgagaatctcaatgtgagtggtttggaaaaattgttcatttttctcatgacaaagttaaaatagagcatatggaaggatatattccatatactctatccttagtacagaaaaaataagacaaccttctcccagttatttaccaaaattcacagtgctatgaaccagcccccaagggaaagagtgaatttgacctatatggaattgacaggtcaggaaaggaaattccctgctaagctcaatcactcaaggactatgatgtctgggacagggactgcacaaggagtggtcaagtcctaaggtcataatgatgccaaaggaacaaggaaagaacatttgaaaacgaggcacatgttagctggcccaatctgaaaattagcaaagtaaacaacctggaccatcctctgattttggggagaggaactgaaatgactaatatgtcaaagaagaaaatgtttaaaatattaagtcttgtttgtttgtttgtttgagactgagtctcactctgtcgccaggttggagtgcagtggcgcgatcttggctcactgcaacctctgcatcctgggttcaagtgcttctcctgcctcaacctccgaagtagctgggattacaggcgcatgccaccacacccagctaatttttgtatttttagtagagacggggtttcaccatgttgtccaggatggtctccatctcctgacctcatgatccacccatcttggcctcccaaagtgctgggattacaggagtgagccaccaagacagagatcaatgcagcaaagctttaagcgttgctgtttctcgtaggcattaaaaacagggtatggactgtgttttagtgtattaactgtgagaattctgggtgcaggagatgataatcagtgggtcccaaaggatataatacgaacaacgtgtagagaggttatggaatcaaggggaacgcacgtgttactgaatcaacaaaaacggcactcacaatgcttagatagccaaagaggcctctcaagagttgaacacattaagtgcaggacaggggaaactgttctcttccattctctagaaaccaaacatatactctaatcaagccagtttcctgccctcggtatttcgcctacattcctctcacctcatgccgagaaatctgagcctgcagctcctgtatgttactggtggcaacaggtttatcctcaatctctctgtgagctccttctatcagttgctggagatgtttcatttcttgctcatattgttcatattgtaccacagcttcctttgaaaaaaaaaaaaaacagaaagatagacagttttttttctctaccaataactaggtaagtgattctgtagtttaactcctatttacctgtacaggtagggaataaagaaatgatgggtaaaattcctagatggtttgaattcctcactttatgtagatatttcagaactttctctctaaaatgttgtagcaaaattattgatggaatcaaaatagttaagtggttaggattctttctctctcttttccctactgatatcgtcctgaagatggaacatgacggtcagaaagggtgaagcagtgtgggaaacattatttcatttttccatctaacaaatactgaatatataggtaagacacttatctaagtgctacggtagggaataaaaatacgaattatgggctgggcgcagtggctcaagcctgtaatctcagcacttttggaggccaaggtggctggatcatgtgagcccaggagttcaatacagcctgggcaacatggtgacacccccatctctaccaaacaaaagtatatacacatatgaagtatgaatgacttttagcctcaggaattttctgtccaacaaattacaagataacagggaggaaagggtagttgaccaaatgagccactagtgattttagtgagatgctattgatacaatttttggataaagcaagaattattagttgaagggagacataaggtaaacactgtcatttcttcctggtaaatgattttctcttactaggcaaagagactaagaattatacttgagtgcatttttttaggcactcaaaagaaaatggatttaatgctttaataagctgaaatatgaaaaaaactctgtaacacaagataacagtaaacctgtattatcagtttgtagatgattctcaggtgaataataagagataaaaacatgtaattgcatagaaaattaatctttacaagttatttatttaaaaatatcactaaaagataattttcaccaaggatattttttatatagcattccccaggcttttgtgggtgatccaaatgacagcattttaatctccttattttataaaaccacaacagcctgtcagattcaacaccctggatgtgttttgatggctgagcccacacaatgctaagaaaagaagcccatgattcatcagcaattgctctactggtgtgggtaccctgcacctgcctgcatgatgttacactgctggatggcggtgtgctgcagccggctggcctcttcctgcagccgcagagcagcatgacagagaggtaagctggcaaccacatcctcggggatccggagggcactctggcagagctgcactgcttgcaccttcggcttcagtgactccatctcagacaacaaatgctgaaaatgcaatttcatagttcaaaaatttaatatttaaatcatttatttcataagcaaaaggcactaaattatagttacgttgcaagttataaacattttgcaaaaaaaaaaaaatgtttaaaacagtgttgagtttaggggctggacacagtggttcacgtctgtaaccccagcactttgagaggctgaggtgggtggaccacatgagttcaggagttcgagaccagcctggccaacatagggataccctgtctctatttaaaaataaattaaaaaaaataaaacagtgttgagtttaggaggcatttttccttactatcctcttttaaaaatataggtccctgtccctatttactccaagttagtttggcttacctgccgatgagagagctgctccttgagactgagacgtccaacttctggagaagtcagtgttgcctgggcttgctccaaggcagcttgtaactttttcaactctgcttcaaattttttcatatcctagagagtcaatatcaatgtattgtacttgaagttcaaagccataggggaagaataacatcacagtcaagaaaccacatcacaggtgagcactatttccatagtggcattgccattttctttcaatgatagacatttttttctgtttcttttttttttctttttttaccttagctgcatcttggaggttctgcaaacgaattttgatcatctgtcgcaactcctcagtctcccgtcccagttctgccacttgctgagacattttttctgtacagtacacgctagtgaggtactgtaatttctcagtcattgcttccagctcactgtcaatttctttggattcttctagcagggtctagagtgaattgtcaatattcatgacattgacgggcaggtagagggatatagatattcaatatagcttggcataaaatgccctgtgtaagttctgtgtgtccgttattgtgtttaaccttcaccccccatgaccactttctacttggtagccacttactattataactatttcacagaaaaagaaatcacagtttaggaactgtaaacaatgtgcagaggtcacatgtcatactacgtgtgggaccatgaagctcctgctcggtcaagcccaagctgccccctcgtgagaacaggacataggaattctagcagtgaaaaacccaaacatactaggtgtcttatttgtatctctgggtctccattttctcatatttaaactaaagaatcacttttcagctctcatattctatacgactgaagttcatatttgtctaagaaatgaaaataagaacaagagcattacaagcaaaaaccttggctcacttgctttaagtgagacaaaggggtagaagatacgtgcaataactatcaagagaagcaaaaacatccctgatcattcagagtggtatcatctactgggtctatcagaaatacaatggataagtaaccattcaatgtacagtctatgaaaagtagaacgaaagagaagccagtgtgaagagatgactgcaacttggggaagattgggagaaggtctccgggaagaatcacatctgagcccagtcagaaggacttttgggatctgacagatgagggggaagaggaaagacatttcagacagagagaacagcatatgcataggtacaaagatgcgtgaatctagaacacacagttagtggggtgtgtaatgtgtaaagaggagaaatgaggaataggatattattcttaggcaatagactatttatttatttcttttttgagacggagtctcgctctttcgcccaggctggagtgcagtggcgcaatctcagctctctgcaagctccgcctcccgggttcacaccattctcctgcctcagccccccgagcagctgggactacacgcacccaggtgcccgccaccacgcctggctaattttttgtattttttagcagagacggggtttcatcgtgttagccaggatggtctcgatctcctgacctcgtgatccgcaggccttggcctcccaaaatgctgggattacaggcgtgagccactgcgcacagccggcgatagactttttttaatgaagtactttcttttctcacaataaatgtttataaatatatatttaacagataaatatttatctgtatatgatatatgatatgtatttatacaagatatatttatctttttttttttttttctgagacggagttttgctcctgttgcccaggctggagtgcaatggcgtgatctcggctcactgcaacctgcatctcctgggttcaagcgattctcctgcctcagcttcccgagtagctgggattacaggcatgagccgccacgcccagctaattttgtatttttagtagagacggggtttctccatgttggtcaggctggtctcaaactcctgaccttgtgatccgccagcctcggtcccccaaagtgctgggattacagatgtgactcactgcacccagcccctatacaagatatatttatttttaacacataaatatatatagtaaggatatatatatataatctgttaaatatatatttaatgtaaatgtataatttaagtatatttattaataatttaattattttaaatgatttaaatatatatttactatataaatatatcaaatagaaaatatatgacttggaaaatattgaaaatataaagaagaaaacaaaatatctcatcactttataacccagaaataactttaagagttaactgctgatacatttgggcacatttttaggtattaataattgaggtcataacatgactatagttttccatctttctttttcacccgaccttagcgttaccggaaaaaggtcccaatccagacctcaaaagcgggttcttgaatcttgtgcaagaaataatgtggggcaaatccagagtaaaatgaaagcaagtttattaagaaagtaaagggatgaaagaacggctactccattgacaaagcagggtgtccccaaaagcaggaaaagaaatgcatccaccttaggtacaatgtctgcttatatataagacaacaaagcaaaaaatcacggcggagatatgctctgcaagggcctgtgacaaaagattgttgatctttgtgtaactgctgtcttctataagaatctatgttaaaattattttttaaatatagatccaagaatgcttttgttcttaagataccaggatatcaggacattgcctgagtctgttatttcccagatctattaaggcctgggtatcttcagttagcattatcaacctgtctaaccataattattctgtgactaagaatgcctgacgtgggaatgctacccaataggtgtcatcctcatttacccagcccctattcaggcccctacgaagtcactctggttctcacatctctgacattagaaaaaacacaatggattttcttttctttttttttttttttttgaaatggagtcttgctctgtggccaggctggagtgcaatggcgcgatctaagctcactgcaacggctgcctcccaggttcaagcgattctcctgcctcagccatccgagcagctggaattacaggcactcccaaccacgtccagctaacttttgtatttttagtagagaatggggtttcactatgttggccaggctggtctcgaactcttgacctcaagtgatccacccctcttggcctctcaaagaacacaatggcttttctcacagtgcactctttttaaataaacacaggctgctttacttcctaaagggggcacgtgagaactcaccaaaagagtctacagtctgcgttctctcttcagcttctgagccagatcatctcaggacctggtgtctttttcactgtgccccatgatgcagtcaacccaccctactgctcgagtcatagaaacctgggaatcatccttgactcctccctgtctttcatcgttgactcctccctctctttcacccaattcagtctccaaattggagaattccagctgcttagtatctcttgactttgtcttctcctcctaatctccaaagagaggccttgtcatcttctactgaaatactgaaaccatcttttatattgtcttactgtcctcaatgtgttttccaaaggctgctaaatttgctttctgaaaatacaagtctgaacttgtcctttgcaggcagaatatcagtttcagaggcttcagagtgacttcaggataaagtccaaattcccaacagacttttaggatctttttcttatctctctattcttatctcttatcccttgtaccagcaccagaaaacactcctcacatttactgctaggatttcagcatacatttttatctaaacacattccacaagtaggctgtcatgtttttcaggactcagcccatcatcaccttttcctgagaagcctttctgcactttcctcttaaacccctggtgggcggttgggttgagcacactcctgtgggctccttcagcacctgggccctctgtctttgcacaaatcacactatattgtactgtttccttctatctgtcccctcccctaaataatcaactccctggggtggggacagggaatatcctttgtaccctaaatgcctaaccaaagtcctagtttgggaaaggactgtatgtttgttgaataaataaacaaacgcttgtattcccagaatttggggatgccaaggcgagtagatcgcttgaggccaggagtttgagaccagtctggccagcatggcgaaaccccatctctactaaaaatgcaacaattagccaggtgtgatggcacgtgcctgtagttccagctattcaggaggctgagggacaagattcacttgaacctgcccaggctgtagctcagtggcgtgatctcggctcactgcaatgatgacgaggttgcagtgagctgagatcacgccactgagctacagcctgggcgatagagcgaaatgctgtctcaaaaaagaaaaaaaaagtcatgataaccttaaggacttcattatattttattatatgcaaatatttacttggaaaaaaattatttcacatttaagttttctttaaactttcactacagttattaatactgtggaaaatattttctatattttggattgtagccataaaaaggagtccaaaaggagccaacaggccagagtagtaacttttttttttttttttttttttttgagatggagtctcactgtcacccaggctggagtgcagtggcatgatcttggctcactgcaacctccacctcccgagttcaagcgattctcctgcctcagattcctgagtagctgggactacaggtgcccaccaccatgcccagctaacttttgtatttttagtagagatggggtttcaccatattggccaagctggtcttgaactcctgaccttgtgatccacccacctcggcctcccaaagtgctgggattacaggtgtgagccaccgcacgtggcccagagtagcaacatttttgacaatcaccatacattttgccaattatttttcaaagagattttaccaggataccagcaatgtttgagagctctcacttccttaaatatgaacttgaaagaaacagtatgaatgtgacagttaagtttgtctttcttcctctctttttttgctgaaatttgcatttctagacttctaaggatgttggctttttttcattgttttcaaatcagtggtaacttaagtcctgtctgttcatatctaagcatatcttaaagcaaaagattggagttgcttaagaaagacattgtgggaagaatacgcaagattgatcagagaagaaagactgtgaatatagggaaaaattagaagctgttaaagcattccaaaaatggaaaaatgaggctttgatctagaaccctgtaaacaagaatggaaacagggattcatttaaaggccacaaggatacataaataatataagagacaaaaatctagaatactcgatacccatgtaactcctataaaagtcaccctatattttattatatgataactagcctattaactatctgtgtctaatttaagcttaagttacaaaaggatgaaataatttcctggatgacgtgactgacagaaaaggaacatttttctcatgtaacttcagaggaaatgaactaacatagccagcatgtgatgtggactcatggcttgctctgggctgcccgacctcctgtggaaggccagatgacaggcctgggtgagggctgagggaggaggcgggagatctcccactgagcacctgcatgtgccaggcagacgtttgcacgtgtgtaccttaaaccacttgatctcataagtctgaaatacgaatattatttacgtcttcatacaaatgatgagaagacagaattcagagaggcaaagcattctgctccaaatcacacagccctgcatggcggagcttggttttcccaccagtctgagtgtggagtctagaatctttccacacttcattgcatctcttcacaggaaagaatttcccaccagatccctgcagataattatttcaaagaagctacagaaaatgagttctacaaggctgattggtttgggtcttggtgtaaggtaggtttagggaagatcaaggatatttatttattcaatttcatgaaatttcatgagaagctcctttctgtccaactactgaacaacttaggggtaccttagcattctttttatctggtagctccaaaaattttacatcacagccctctaagtgttgtgtcagtctacccagttaaatcaaattgcccttggttactttttaaagattatttttcctaaggttacctgatgcaaaatatattgttcccgaagctggcttgcagaattccatgcaatagttccatgagccaagactttagctttttcaatccacttcaaaattaattcaagcatttcattgtattcttctaaatgtgatgctgcctgaaaaaccagtaacattaatgtaacaaatgtaaactcctcagtttcttgagctataaatcagtcttctctctctttggacacaacagtcttaggggttgatcattataatacctatgatattcaatggtatcaaaagatcgtttccctgttaaaatctgtcaaagctttctcagtgaccttaggataaagctcaagttcttaatatgattgaattattcctctttttctttcttttttcttttttcttttttttttttttccaaggtcttactgtcaccccggctggaatgcagcagctggatcatggttaattacagcctcaatcttacgggctcagcctcccacctcagcctcccacgtagctgggaccacaggcacgtgccaaccatgccctgttaaatttttgaatcttttgtaggtttcaccatgttgcccaggctggtctcaaactcctaggctcaagtgatccttctgcctcagcctcccaaagtactaggattataggtatgagccaccatgccaggccttcctctatcccttccttcaccctcccctgggtaaggaggtggcaagtggggattctagcaggcaaagtttcaaactataattaatgggttaccaactcctggttttaacttgtccctgattatattaatcgatttcaaaagtctagtctatatgcaacaattattacagacgtgcaatctgaatctattaagtcaacgtaagctgatatatatgtagcttacttaaaggtacttgaattcaccccaaactgatttcataaaacacgttaatgggtgaatattcattctacaaaatacttctccattttacaaaatattcactccaaagtccatttgtaggaccacctttgtcagtgactttatcatatggctggatataaagtaagtgctggtttatacctaagtcttaggatcacaagtgtagcatgaaataagctacacctaaactactctctcattgtccattttatctttttatttatgttaatttattttcaaaagagaaaagcagaacatggaagtttctgccttacacgatttggatttctggcccggaacacatacctgattgagcttggagagccgattctcagcttgtctaatggtctgctggtgaagttcagtcagttttcctatcttcttggccagtggcttacccagttggccattctgttccaagaatttctgtactgctgcatctaattccattaactttgaattacagccatctaattcctctcccagcaccttgatggtcaccaaaatgaaagaacattagagtacagaaaataaatttctccaggtttcccgagatcagactgatttttgtcaaagccaaatattataatgaataattctactataattctactatgatcaggtcatttttgtttcttcggttggaaaggcagggcaggatatgttgtaatgctggtgtttatttcctatgaggctgagtgagaaggctaacattttccttctgccccacccaaaaaggattagagtccctgaactcatcaacagaggaagaacacagatttagctaccaaggacacaattcagtttggaatttatatacttgtattcctaaatcatcacttagtcctttgacgctcttctttcgtacacactcatgcatgtatatttattaatactgttcaattataatgatcaattatgtaagaggatctgtgttgcttcagttacaaaatttctttaccacctgctgttactatttggttttaaaaaaggttcctaaaaggtttttatcctatatccccaagtaaaactgactccaaaaactatttaattcattcagtagtaccctttaaaattctacttcttaccttttggtcagttttagcttgaactacattatctgtcttcgctttcagcttagttagaatagttgtgaggtctttagctaacttctgaatttgccggctgagttcctggctcgtggccttgctctgctcaacttcttttattttgtcttggatctaaaaaaatcagtaagaacagcaaaacaagccatggttaaaagtgaataatagatactaaaaatctcaaatgatgttgacaagacacattttaactgctttggcattgaaacacctggtcacaccagcgatgtgcgattagttacaagccctcctggctttccctgacttcactatctttaagtatttactgcactccttgtgttccagcaaagatacaagcaatgtgtgtagagaaattcacttattaaatatttacagaatactcattatagatggttgtgtagacagctgagtttgaatcctatcttctccattaactaacgtaatgaccttgagcacacaaactcctctaagcctttttcttcataagatggaaaatcctcccaaacagttggaagcacactgatttgtttccaagcaccttttaataaatgactcttaatgatctgttaactctttttgtaactttccgactacagctctatagtatgccaaccaagcattaagtacatccaatggaaaggaaggtgaaaaaagacagttcgcatttacaaatttccagtgactttggtttgatttgataacaaacattcacactgttgcttagaataaaatgccgaagaaaagacattaaagagaagaaacatttctttatgtagttaaaggtctttaaaaaaacctctttagtagggagaaaacacaccattaaaagagagttaatggtgtgttttggccttcattattttgagtgtcaaagtaaatgaaatacatatgaataaggctatgataggaaaattaatccagagaaaagcttaaattttaactaaaaaaacaaacaaacaaacaaagaaaaaccatggctgtgcacagaggtgcacacctgtaatcccagcactttgggaggctgaggcaggcagctcacttgaggccaggagtttgagaccaggctggccaacatggcaaaaccttgtctctttttactaaaaatacaaaaaattagccgggtatggtggtgcatgcctggaatcccagctacttgggaggctgaggcacgagaactgcttaaacccaggaggttgcagtaagctgagattgtttcactgcactccagcctgggggacagagcgagactctgtctcaaaaatataaaaagaccatgaacttgccaagtcatccttcccagtagatcttccaatgtctaagaagaaaagccaaatatatcaattaaatacttaaaatagtaaagagcatttatcagtagtttaggtcaaagtcatgatgcagtaggatcagattttgatgagatttttaaaacactttgcatcatacattgaagattccaaaagtagagcacaactgtatgagttttacagtttgtacaatgggatattactttctatttcatgtagcaatttagaattgtagtatgtcttctctttgtctcatatagaagggttttcattaaactttaatagctttagcattaagccaccaagagagtccgaaaaatctattatatttccatacagatgatatttgagcctattttcactacatgaaattgtgctcttcatgagaccagagacagaaatctcactctggtctcaacaccaaaaaggactatgcatttcttctcaaagaaacaaaaatatttgttttttagagttatagacaggattatgtttctatttactcttttccttgggtgtttagaagctagggttaaaatgatggctcttctctagcaacattaggggacccacccgcatgcattttaggaaataacttcatccctgccttgatcttatttttatttctttgatttttccctttcctccaacatcttcacctacttaactgacattttgttgcactgctgaaataaaataacagctggaagagtccctggcacactctgggcattcactaaatatttgttgaacacatgaaacatatcttactttttgtttctttaagtctttttttaaaggtgaggggaagcacaaaaattatctttaattgtatggcattattggtcatatctatgatcatcttgcctatgaaaaagacttctaatttaatattattgttttatagccatctattttttttaactctgtctccaagaagacattattgtgaaaatcaagaactctcacacaagaggactgaccctataaacaaaatggaaagacactctttcttgatcataggtttacctgatctcggatctttagatctaacgccacttcagccaactgaagggagagttcagaaggtaatatggtataaagacctaagtacttctccttctgttcttctgccattttttcaatgttctgtcggtgatttgtggcttctgttaggagaatctgaagaaaagatcaaaataagaaatttctgggaaccttctaaggggactgttatagacaaggctgtatatttttcatcaacatataattaagtgtggaattagaaaaatatcttaatacaacattgttcttttgtctctgaatataaagtatgttcactttaaaaaacaaaggaaaatcccatgaagtaatactaaatatcttttatataacacacttctgaaattttttaattcaatattcaataaatacaaacaagtatgttcaactaaaatcagggcaattgtttttgaaatgatgggtaaagagaatgaggagacttttttgtacctgaagttcttcaagttgagcatctatttctattgttggattccctaaatattctttcgtttcctgaacccaacatttcacagaattgatctgagtctccaccatttctcggtccttcagctcttgcttcaccaactttccattagtcttcactttctcctgcatgcttcagaaacattacagggataaaacagaagtgaagtgaaaggaaccccctaatacttggcaacattttatccaatacatatatagaaatgggaaacctagtatcttttttgaaagaaaagacacttcctcaacactgttaaataacactgcagttcatgtataaatgtcatataaagtaaataatttatccttgaaaaactgagagttgactgtctcacatgccactaaattgcaatcaatttcctatttaaagtagcctggagattatttcattatttacttcctctttggaaatctcctaaaatggtacatttaaaagtaatgtgtaattggaatatatatagctatctaatagaaagtagtctttaaagaaaaaaatcaagctttggaaatgtcataattaatcacgttaataatgtacaaatttcaagtctttatttgaattaatgtaaatttggtaagaagattttaaaaagtgttaggttaccttgacatcacctataagggaaagaggtgaaatgcaaggacatgaatgaggtaatatttgtaaatgtagaaattaaattatcaatgaatatttttttctctggcccaagaagtgagtcagggctggttatacatcaggattaacttgctctttctactaaattcactgctagtcgatggctattatttacctggactgcgctcctatatccctgtcaccccagatggccaatgagttctcaagcttcatcaaatctaagttcttaatagctctcaatggtttccatctcatgcttcatttctcttgaatcacccttcccctccccgcatcacccaaggagctccttgaaagtgacacgtttattcctttcttacatgtcatttccctgtttgcaaaactcaatgcctagctccagcccgctcaggcttctgcttcaattccccttctgaagggatgccttctttgacccctctcctcggctgcttgtctctgcttcggattccctcagctcccttttcacacttgactacaaaggctgccttagttgcctagctctctgcggcttgactgtaaacggcatgaaggtagacactgagtctgtatggttcaccatcgtatctctaagtactatcagatatgtatttgtcagacaaacgattgaagagttaaggaaacggaaaagcaagagtgatgggaacggatccccacattttcaaggtggtgtgaaggagcaccttcatacttcataacctacttatcccaaggccaagttcagtaacagaatgaaagtaggggccgggcgcggtggctcacgcttgtaatcccagcactctgggaggccgaggcgggcggatcacgaggtcaggagatcaagaccacggtgaaaccccgtctctactaaaaatacaaaaaattagccgggcgtggtggcgggcgcctgtagtcccagctactcagagaggctgaggcaggagaatggcgtgaacccgggaggcggagcttgcagtgagccgagatcacacatttgcactccagcctgggcgacagagcgagactccaaacaaacaaacaaacaaaagaatgaaagtaggtgcttaattacttcaggcaccgatcttgcatggcggtgatttcctgcatgagcggaggctcttccccaggggttggggcggctccatcctggagcatgctcagggtttgctgccgcagcatgcccaaggccgactgctgctgctccagctccagaacgaacgtgtcgtggtattcaagaagagttaagagctctgctttcgatgctttctctgctgaacttccaggtaacttatcttgcagctgatcaatcatttcagtggcctttttaacctgatgacaaatgtacatactatgaagttcaataataaataaactgaaaaaaatagggtaactcccataaaagccacacactagtgtatgaagccaattaaagatgatgatataaattccacatgttaggaaactggaacctgagcaaccttcttaacatgaaaggagatatcacctctatacctctgggtttaaagctttaatctcaaaataatattaggacaatcagagactatacttaatacagaaaaagctttaaaaaaaaactaagcaaacaaaatactctttccaatatttaagttaacataaatgagtgcctttaaatcataaaggaaaataatggcttaaaacattaaacctttaaagatggaaaaagctgccaggcatgtggtggctcgtgcctgtaatcccagcactttcggaggccgagacaggcagatcacctgaggtcaggagcttgagacaagcctgacaaacatggagaaaccccgtctctactaaaaatacaaaaattaaccaggtgtggtggcgggtgcctgtaatcccagctactcatgagggtgaggcaggagaattgcttgaacccagggggtggaggttgcagtgagctgagatcacaccactgcactctagcctgggcgacagagcaagactccaaaaaggaaaaagttgaatatacaatttgggtaatgagtcaaatttctgctcattttcaggtttcatggtaaagaaaaagtatctcattctttttcaaggccgttaagaaagcaaatgggccgggcgcggtggctcacgcctgtaatcccagcacttggcgggggctgaggcgggcggatcacgaggtcaggagattgagaacatcctggctaacgaggtgaaacctcgtctctaataaaaatacaaaaaattggccaggcgtggtggcgggcgcctgtagtcccagctactcgctactcgggaggctgaggcaggagaatggcgtgaacccgggaggcggagcttgcagtgagccgagatggcgccactgcactccagcctgggcgacagagggagactccgtcaaaaaaaagaaagaaagcaaatggggcaaaatgggcttgttctcctttcacaatttaattgcttggtttttctcattgaaataatttgactgtgacttgggactaaactgcacattgcattttgtactttgtttcataacttaatttttatgtcactgaaacagattttaaaaagcctttattactttcataaggctgacttcaaaaaggggcaaaatactgtgtttcaaaatacattataattagtgaggaaagaaaggtgagcccatggacagtggaaactaccttgttgttaaagcccgtccactcatccactgcatcttccaggatcttctcctggtcctgggccacagctcgaaggcgtgtccagcgctgccagacggtggtcattgacctgctcagggtggctttgctggcatcatttccggttttctccagttgtgaagctttttcctcaagggccacaattttctcatggaaagagttaaccactgacactaaagcctagggttgggggtggaggacggaagagaggagacaagggagagatcaatttaattttataaagttctatggatcttggtaaagcccaaaattcctgcaaaaggaaatgtttctacatacgtttattctcctctaggtactcttacttttatgtttattttttaaccagagtgagtcttaaagctttttaaagaggtaaggtgaatattatttatttattaaaaacaaaagtgtattttgctacttgagatgacatttttttcatttttaaaaagcagcacaaatgcaagtgaaccaaatgcaatattttagtatgttacattttttccttatattgctctgataaagggagactcagttattaacgttttagttttatttaatctgttatcaacaaaaagtattcactgacatttattaagtgccacatcttatcggaagcaaattgctctgaacatcttagctatgcatttccaatgggaatcctaaaaggtaatagcatttaataaacttaaaacttctataaaatgttgttaaatgcatccttatcacattgaaaaaagtccaggtagaaatgaagatttattgatcatgttgcaaagactcattataattatagaaaaaggattttttttaaatggcccaaaactctgaccttgtgttctgacaatttttcttccgcttcatgactagacgaagtcttcaacaaagaaaactcagacaatttcttttctgtatcattcatcaattcaataacctcttcccttgctttctggtaatcgtgccattgagctgtgcatcttgaaagagtccaacagaaactgataagtagcacgaaatcacgtatttctacacgaagctctggtgtcagtatgtctaatgatactcagggaaaaatgaatttacgtgctaatgtatatcattcgtgtattactactttcagtgtggaaattcatttcactaaaacataaaacacaaaacatcctgaaatacctctgcaagagatccacttgggcaccagagtcccggctcatcctctggctcctgagttccagagaagccactttctgttctaggtcttctttgccggttggcttgatgagtgggtccagggtggctaccaggctgtggagctcctccaggttactatggaactgatcctctgtactgaaaaattccatgtggcttttgagattttcctctgcgctctccacgtctaggccattgcctgccagctgtaacaattcttgggcatcctcaagccagtcattggctgcttgaaatacctgataatacctttgacactggctatatatttcagtcaaggtagcctgaaaaacagcaattgcaaacataatcaactctcctttgcaatgtgtttgcaggaaagagttttattcactcatttgttttccagtccttagtctcatgggcgtatgtgtgtaagtgcattgataagttagtggaatatttttgtggtgccatcatcattatccttgatttttccttctgctattcttgttataattttattactgccattaaattaaataataaggacagaaatgggatagaaatttatgtcagtatcttgactagttctgaaacttccctctctaagaaataatatgatgcttagtaatatgtggcagactggatgtttatcaaagtgcagtaatgtctccgttggttagaagtataacaacacggccaggcgtgctggctcatgactgtaatctcagcactttgggaggctgagggaggcagatcacttgaggccaggagtttgagaccagcctggctaacatggtgaaaccgtgtctctactaaaaatacgaaaattagctgagtgtggtggcacatgcctgtaacagctacttgggaggttgaggcacaagaattgcttgaacctgagaggcagaggttgcagtgagctgagatcgtttcactgcaccccagactctgtctctcaaaaaacaaacaaacaaacaaacatggaaaggaaaagaaaagaaaaaaaaaagaaatatagcaacatcaaacttccaaactggcatttaccagaccacagagccacagagtaatttctggaagcgaaatagtaacctgtgagtcttgtatacagactaaaatagaaaagttgaaaagtttaagtctggatggctggtccattcaattccagaaggaaaagaaacactctaaccagccatcaatgactagacaagataagccgcaactgtgcaagcgaagatgcatagaaaaggtagagaaagtacccataagatgagcaccaattagggaaagaacagggacagcaaagcatagaatcagcggagggaataagaaatgccccaggaaccatgacctttagttatttggaccaagataatcaataagacaagatggcacaagcagagacatcttagtagatttaagagtttggttcaaaactcaccaaaagaagcaagcttacctgacaaatgtttttcaagaatgaaaatttctgctaacttctgttcttactctacattctagattctatatctctatttatactaatagcgctagaaaaatagtttaaaatttgtataagcaatagccttgaatcaacatgaaaaggttaaagtgtactagtttttagtttaaaaagtcagaattttaagaagtttattatgattttatccaatattaaaatttttactatttaaagtgttaaccttaacctctgcagaaaatatagttaaatgagagctaagattcatctgaggttacttcgtgtcagacccaatgctaagaagataaacctaataaaagaatcattaatatctctcttctacaaagagggacagagccttataggatgtcattttcctgagatcaaatagctgccattaaaactcagatgtgccctcctcccaggctatagctgctgtattatcctgacgaaagctatcctttacctaaagggttggttgacatctcctagaatcacagggactaaagacagacatggagaaaatgggccaagaagttaaaggaagtaatcctctaggcactatttttctcttcttattttattttatttatttatttatttatttatttatttatttatttatttagacagagtttcactcttgttgcctaggctggagtgcaatgtcatgatctcggctcactgcaacctctgcctcctgggtttaagcgattttactgcctcagcctcccaaatagttaggattacaggtatgcaccaccaaacccagctaatttttttttttttgtatttagtagagacagggtttcaccatgttggtcaggctggtgtcaaactcctgacctcaggtgatccacccacctcaccctcccaaagtgctgggattaaaggcgtgagccaccgcgcccagccctcttcttatttttgaatgcacagaacttgcaagccccagagcaagctgcaattaggccaatctgggaagttttgtacatgctcccatttctttttgttatccccaagtcaagtaattacgagtattctagtctttcttctgctgtgctacagggaagcaggagaaggacagcactcatccccacagagggggtgaagagatggggcaactaatgggataccccacaaaaatgtggcttattggcaaggtcagggctgcattgtctgcctctctccatttagactcttcatctagcaggtgattttagaaataccagccttcacattgtttacaaagggcatcactaattattcatggttaatcagttgtactatccatgtactaatatataatattaattatgttactaataccatttatcatctcttttaaggtgagaaatcactgaggcatcactgttataagcaaagtgaagtcaagatggaaaccacacaaaatgaatatcatgcacataaacaattaaaatcacctggccaggcacggtggctcccgcctataattccagcactttgggaggccaaggcaggcagatcgtttgacgtcaggagtttgagaccggcttggccaacataatgaaaccctgtctctactaaaaaatacaaaaattagctggatgtgatggcgggtgcctgtaatcccagctactcgggaggctgaggcacaagaatcacttgaacccaggaggcggaggttgcagtaagccgagattgcaccactgcactccagcctgggcaacagagcgagacttcgtctcaaaaaaacccaaaaaacaaaacaaaacaaaacaaaacgaaaaacaattaaaataaccatttaagtcactgctgaagatgcttctgtgtagtatttcgaaagaaatatttaaagaagcaattataaccaagcaaacgaatttcttgtacctgtttacaaataagcagagtggaaaaaagagaagtgaagtcctattatacccacctgtctggtgcgtaaggcttcctggatgtctccatccagctctgagagctcagcgaggctgtgttctaaatccgcagaaatcagctccttggcctttgtgaacttctccttttccttgtgactcagcgcattcatgattctcaagctggactggacctcttcctgatgaatttggatttttctgatttcctcttggatgtcctgcaggttgaggtctaggtacaccggcccactgagctctgccttcactctcctcagccagtccagggagcgactcatctcagtctggaagtctatactctgcaccattcggctctcacattctgtcaccgtctcaccaatggcagaagtcaacagttttaactccccttgccaggactggatctgatgcctggctttctcataagccaaggggtcaaggtgtggggcaagatcttcaagatgtatggttactcgtttcagtacaatccctgagtcctggagacttcctgccagggagtgatacattttgagcttctcctctgcaggcagcgtttcctcattcactttggactgctcctcttttacagacttcagttgtctctccagctgttggcacatcttctcgtgttcttggtaagcactggtggtgtcttctaataagctaaccctctgttctgtttgtcgcttcagcctgtgatataaggtgacaaggtgcagcatcttgtctggctgccaaggctgacctgtgctgcgaaaaccttcttttttctggttcagttcatccaccgcctccccaaggcccgccacctcgtccagaatggctctgcaaccatcttgcagagaaagagcctcctcaacggccaggtcggtgggaactttgctcatcctcaagaattgggcttcaagttcactcagagactgggttgtcaactcaatcaaggaagcatattccttccgagcaagaattgcttcctggactttatagaacttgtctttagccaaggcaacaattacattaaattgtcgaggcaaagcatttagcttttcactgaggtaggaatgatcgacttcattcagcgatggtaatatggtctgcccagttctctgcagcgtaagtagaagattttcatattctggagattgttcaagaatgttttggtatttagccagttgtgtatgaagctcagaactctcattcattaggttgatttcaggaaatgtaacaatatctgcttgttttagccagtggcaagctttatcaaaatcttccttaaaatgcttcctagaaaccaaattcttctctagttcttgtaaccggtgactgcacttttgtaaaacactgtcatagacactctgcaattcctgaagcttccccagcacttcactcttttcctgctctgtgacttccttcattagttcgcgaccctgggcccaaagtccagtgacttcattttggtaagtcttgaggctggcttgtgcactcttacatgttttgacttgtttgctcacatcatctggtaacagacagatgtgttcacggaacattatctttcgctcatgttgctgaatttggctggtggcctggaacactgccatgagaaactgggttttctcggacaaggctttgtttaagtactttcttcgctggcccactaagtcactgagacaattcacgtggctttgtgcatcagagagagccttctggatgacctgtcgctcattgagaccaagatctgccatgaccctgtctgcgtcctttataagcgatttcaggagcatctgcttggcctccagttcactgcagatggccaggtgatccatgagaaggttctgagccatatctggaggagggctctgcttaagggcctcggcgatgttgggttgttgctcttctgcccactccattagctcctgaaatctggactgcaccacatttaactcctccaagttggtgactgacacttggattttccttttaatgaggtcctcaagctgaaaccaacgttgctctaaatgactcgtctgttctttgactaactccttgtcatctaaattcagatgctctatcattttctgcttttgatctttcagatcttcaatagcatactttctctcctgcaatgccaatgctaactttttcaaagcttccaggtggacagctgtactctctgcatcagatctgaaaatacatggaaaggtataagagcaaattagctgtagtcaatatcgatgtttgttcatactatgctaaattacacttcaccattttctttttggagactgagttttgctcttgtttcccaggctggagtgcaatgaatgctctgatctcagctcacggcaacctccgcctcccaggttcaagcgattctcctgcctcagcctcccaagtagctgagattacaggcatgtgccaccatgctcggctaattttctatttttagtagagacagggtttcaccatgttggtcaggctggtctctaactcctgacctcaggtgatccacctgcctcagcctcccaaagtgctaggattacaggcatgagccactactcctggctgacacttcaccatttctttaagtggatcttctgagcttagaacaattgagagtagttcaattcatggtttgttgacagaagtgctataattatggaatacaagtctcatcagaagtcaatactagaagttgaatcaaaccaagttgcctacttctttctggctgataatgccttccaatcaaatcagaatatgcttttatcttcctctggctcttatcaactgagcagaatctatatggtaacaggatccttggatgttttgtgtaatgttaaacagtgagaagcactgatctagtgtactctagaaaatgatactgaaagaaattaataagtgatgcatgatttatgtgctttcttttgtgaagagggtccaacaaacaatatagttctaggtagtacaatctgtaaggtataaccaacagatctaatggctacttaattgtgtacttggatattttttgcttatcattagtaatctttagtaataagtgtgaaatgtaaagaattctcatccctttgactatgaagcacacataaaaaatggaatattgtagtcttttttactaaatgatcagttctgaagtatgaaaagcagggttgggaggcagtatgaggagttctgttttggacctgttaagtctcaggtgtctgtggggcctactgtgagccagaaatatgagttgttaatatttactggactaatcccaaagacgagtaaatgttaagtatcaaagaaaagcaaacaaaccagaaaatggtataccaaaaaaaccccaaatccccactatgatttcatgatatctagaacaatatttgcagttttctttgctgtaaactagtaaatcggtgcagaagaagtgtagattttaacaattatagtgatcaaaagtatggaatggtttcatataatgatccagtatgtgtgtgtgtgttcttatttttcaaagaagaaagctaagaggggttcaataactacaaaatcacaaaagacacaaattaactgaatttctagactcttgtaagaaaaaaacctgactgaattacacagaatgcattcattaccttatagacttgataagaaactagggagcatataggttcaagaaggattcatttcatgaattcatagatgatatcccataacttgtaattaaacaaaattagaaatatttttagaatattctttgaggtcacagagaaaatggtaccattttcaaacatttctcttttacccactggttaaatcaatatcgagctaggaaaaccatgactctatatccatttgaaaacgttaggttcataatgatgttctacttaccaatattaataataataaacaatagatgttatacctaagacattttattttatttttttgagacagggtcttgctctgtcacccaggctggagtacagtggtgcaatcttggctcactgcagcctcctcctcccaggttcaattgattctcctgcctcagcctccgaagtagctgggattacaagcatgcaccaccacgcccggctaatttttgtatttttagtagagatgaggtttcaccatgttgtccaggctggtctcgaactcctgacctcaactaatccacccgcctcagcctcctaaagtgctgggattacaggcatcagccactgcacctgggcacattttaaatttttatagatattaagaaatgtctggcttagcattttggtgacccatgggagaatttctgttacctggccaagttatcccattctgtagtaaatttttctaggaacacttcaacaacattcatacagtcatggtaatctcttgttctctgaagatcctcttccctttgcaagcacaggttgttagactgacggcacaaatcgagccactgatcatttaaatgatttatttccttgtgttcaggcgattcctccttctttgttaacttattcaccttttctattatggtgttcacggatgcctgtttgctctgtagtttcttaacaaaatcctaaaggataacagcaacaaaaaatatgtaatgtgttaagaaatgcccaaataaatatagagagcaacacagacataagacctttaaacactctaagttccttaatatgaaaaaaactgaagaatgtataataagttatgggaaacaaagagaaaatctaaaaatcaccatacctctttatgaacgttaattcccacgtgtgcaagattcagggtagctgtggtatattcttttattgtactattccaagaggcataaagaaaaactaatacatgtgaaacattacagtcattaatgaaaaaagtcattatcttaccttgaagtgcggcctttgttttctaagaatttttaaggagttcatgtttttcaaaatttattcttaaactaagggtgcttttattctcaagacatcaggacattaggacatttcctaggtctgctaagtcctggatctgtcaagttctggatctgttcagtaaacattattaacctgttcccttaactaaatatcctgtgactaagaatgcctaactttctgggaatgcagcccagcaggtctcagcctcattttacccagcccctattcaagatggagtcgctctggtttgaacgcctctgacggaaaccttccaaatgtcagagacaaggcaaagtagcttgggtcaccaggtgggcagtggtgttatgtacagagttggggaaggctggagtacattcgcaaagtggaaaggcaatggtttagattcatctactccctgcatacacagcaaaaagaaacctctaagataccatctctgccagcccaatatgtggccagaggatcatttctttggatagtgtttcctccaaggggttggttcatggacttccatacttccccactgctcactcccattgccatttactcccactacccaaaaaacacctcttaaatcccctgactgatatatgaaattttgtccttaaagctaggttcaatcacaattaaaatgttaacaagagtatcatcttgaatgtttttattatgtgtatatctaaaacaaatacagcaaaatattggcattgtttattatctctgaatggtagtatcataagtgattgtgatttaaatttgcttattaagacatttctgtattttctaagccttttataataaacaaaacttttcttataaaatacattttaaaaaattaaatttctaggatggttcacaaatttttttaaaaaagagttcatgcttctgagaaaaaataaatcttattatcccgatccctattctcttttttctctgtacttgcaaacagcactccagtagacaatatattattattgactcataatcacagagaaaaaacatctttaagtttatttaaaatctgacccaacttccaattaagttaatacacttataattttcttttttcccttttttttgagacagagtctcactctgtggcccaggctggagtgcagtggcatgatcatggctcactgcaacctccgcctcccaagttcaaatgattctcgtgcctcagcctcccaagtagctgagattataggcatgtgccacgcaaggctaatttttgtatttttaatagagatgtggtctcaccatgttggccagcctggtctcaaactcctggcctcaagtgatctgcccacctcagcttcccaaagtgctgggattacaggcatgagccaccacacccggccacaatttcctatatattttaaattatttaaattatatataaatatgtaatacaaactgcatttatattatactttaaattaattacatatagctcaaatatataactaatgaattgataagcttacagtcctacagttttagcataatatggtgatgaaaatctaaaaaaagaataatgttccatgtttgcttagtcacagagttttctgactaagcagtctactctgtagactaaatcacacctgcttttctcaggaataatgtagagtatgaatgtcttctgatgaaagtggccatctgaagcttcagtaatatatttgaatgtctactttataatctgttttccctggcaccaaatgatgtttgttcagatttgctattccttaaagcagcggtccccaaactttttggcacctgggatgggttttgtggaaaacaatttttccgtgaatggggctggagggggatggtttcaggatgaagctgttccacctcaaatcatcagatattagttagattatcataaggagcatgcaacctagatcccttgcatgcgcagttcacagtagggtttgcactcctatgagaatctgatgtggcctctgatctgacaggaggtggagttcaggcattaatgcttgctcgcctcccactgtgcggccaggttcctaacaggacatggacttgtgcttgtccataacctggggcttggggacctctgccttaaagagttgtattaatgtctaaggattgacagacactcaggcatattgaagtgaatacactgaacacatttcaggttttctactctgttggcctcttttatctcccttgggggcaaattaattcccaccttaacttgtgaaaccatgttctgtgcaatgttcagctccagctcagagtgcctcctcttcatgttctgcagttgctgatcagcatcttgcaggtaaatccagagctcagacttcaggtgcttgatctcttcccagccctgagttaagttctgggcctggacaagcttttgttcaatcttgagaaaacacagagataaaagttagcaaccatacatggaaacatttatggttaatgaatcagagatggaactttccagctggcctgtgcactcatttgacacacacatacacacgcaaactcacacacacaaatacataaatttaaaaagtacttctttatttgcttcaggaaaagcagattttttttaaaaaaatgtagggttcctaaagactttaaatgtctacaagttatgctatatggttttaatcagtgttgtgaaactctaataatttttttttttttttgagacagagtttcgctcttgttgcccaggctggagtgcaatggcacgatctcggctcacagcaatctctgcctcccgggttcaagtgattctcctgcctcagcctcctgagtagctgggattacaggcttgcgccgtcacacccaactaattttgtatttttagtagagacagggtttctctacgttggtcaggctggtctcgaactcccaacctcagataatacgcccgccttggcctcccaaagtgctgggattacaggagtgagccactgcgcccagcgaaactctaataagttttatcaatgtattaggtctaaagctgctctgatggtttttcccattgggcatttcagtagattcatctgtatgactcatgaatttggtgttaaggttaactagaaaagacttctgttattctctgttgcacatttgttcatctgtcttacaacatgctgaattattaatgttttggatatgtctttgatctgcttcactggtttttgaagctgtgtaatttgtttcaataaatcatttctgtaaaaataaatgggttacattggctgggaatggtggctcgtgtctgtaatcctagcactttgggaggccaagtcaggtggattgcctgagctcaggaattcgagacccacctgggcaacacagtgaaaccctttctctactaaaataccaaaaagtagccaggcatggtggtgtgtgcctgtagtcccagctactcgggaggttgaggcacaagaattgcttgaatgtgggaggcggaggttgcagtgagccaaaattgcgccactgtgctccggcctgggaaacagagtgagactctttctccaaaataaaataaaataaaataaatgggttacatcgtcttttgtaaggatttaaaaacagatttgataatattaaagagaaaaaccttattattttgacatttttttcctgtgaatcattttactgttctgtgaatatttaataaattaaataccaaaactaagtcttatttttcttttaaactcaagtgtgggccaggcgtggtggctcatgcctgtaatcccagcactttggtaggccaaggagggaggattgcttgagcccaggagttcgagaccagcctgggaaacacagcgaagccctgtctctacaaaaagtataaaaattagctgggtgtgatggtgtgtgcctatagtcccagctattgggaggcggaggtgggaggatcacctgagcccaggaggttgaggcttcagtcagtgatgataacgccactgcactccagactggttggcagagtgtctcaaaataaagaaacaaacaaacaaacaaacgagcaaacaaacccaaatgtgtttcatggaagagtttaaggctgcagtggcagcagccgggaaaatacgcctccagtgctgccatctgtctgtgtgggccggtactgctagctcatcatagcccagacagtttcaaaatccttctgaacaccacactttaccaatgaactagaaggattgtgacagatggcatgctctttgacatccttgatataataaagaaagggtcaagagcccctttcatattaagtattgcctaaagaaaaaggtggaaaaggagaaaagaacaaaaaaaggtgtggcaagataggaaaattgagagaatggtcattaaggaggagaaaaaagaaaggttctaatgggcagcgaatgaatgggactaagtgattcagtcccaatctgatgtcatcaatgtcaggatgtgcttaattttctatgagttagctgaaattcaaatatctatttattataatggctgtagaaccattacatacagcaagaacaagccaagagctattttctttcaatctcacatgaaacattcaagcaagagaatataataaaacaaacaaattcaatgtgatttttcattttcttaccgtttgctctgtttgttgaatgtcttttgctgtggttttcaccgaagcatttgacaggtcacacatggagcaaaggagatctaggtaggtccttgcctgctcttgcaaagctctgaagtgtttgacctggaaaaggcagttatcagagtgaaagagatgcatcagctatttagatagcaaatacttgtatcatttggaatattctgttgacatttcaaaaatagtcttgctatgctcagtgttttcaccattgtgttcaagtgacatatattagtgactcacaggaaaaaatttaaatcaccaatggggatttatttgtccaccatttgcttctccttgtaagtaaagtattctgtatggtctgggaaaggggaaaacgcaagaaacttctataatctttccagattatttgctcacatgccagcttattttccattccagagaaagaatttgtagcctacgctgtcctgcctcttaacatgcttttgcatatcttagagacagaaggcaaaggtccgtgagttggtaggtttcattggagtgaggttaaaacacagatgtctgggcttctttactttgcaggagattcatcttgtattattctctttccacaagcccaagaaaggcttctccaggtggatctttaatctatttatagaaacaaagaaatgtgtttctttgcagatgcgcagattctactcaggctccattttagatactgggcatagagcagcccataaagcaaaacccttgctcccagggagttgacattcttaggaaggagataaataatatataaataaacaaacttgcactgggatgtttagtagttttaaatatcatgtgggaaaatcaaggtgctaagcagatagcgtatgaggaagaaggactgccacttcagggacagtgtatctcccaggcccctctgaggaaacgacctgaatgcatggcatggcataaggtaagaacattccaggcaggtggatgtggtgggtagagagacagcaaatgcaaagccctgaggctggagcagagtgaatcaggtgtgagcagaggtcggagggtgggcgggggcaagtcatggagccccttacaaggagagctgaccatacatcccaatttgctgggttttgtctctagtctagagtttctcaactcagaactattgacagttgactccaaataattctttgttgtggggctgacttatagcttgctagaacgtcagcagcatccttcgcgtctacccacttaatgccagcagtgtccccaccactcccagttgtaacaaccaacaacgtgttcagacagtgccaaatgtcccttgtaggagcaaagtcaccatctcctccaccccagttgtgaaccactgcgctagtcccattggattatgtaaagcagactctgtcttatcaagaaggttccatttgagaaaacaaattctataatcagcctgttcataagccgtggtaagaaagttggaatttaagtgtgatgggaaaatatcgggagcatcatgatctgaaacaggctttcaaagactccctccgaacatcacgtggagaacggcttgccacaggggtggcaggcagctatggtgtccaggtgttaggctactgcagggatcagatgaaccatgaagatggcctgacagggggtggtggctgaggtagtaagaagtggttcttgattactacataaatagggataaataaggaaggcagtattgactacaagttgcagggataaagttgacttccaggattttcccaaatcatagagtcaatcatggtgcctgattttgtgactccaatctgagtatttttcctctgcactgtgtggattacctagacatgctgtgttcctgtggatataataaacacagatcaatttcccattaagtcaggagtagcaccttttcaattgaatgtacaagcgaactatggtattgtgagtcatcagccactgtgcacaagtaccacatcatgcacctatgacccagagaaagttatttgtctcaaacaacttttggatatgagaagagaataagttgtcagaatttgtattttatgaacatatttaattgaaaggaatgatggtatgatttatatagttgatctgattccgaaagcactggaagcagcatatagagtgttagtgaccacacagctgcaaacgatgtttgctaaaatcaactttacagaaaaatcttatagtactttttcccattccctaaagttcacattttatgccttctaaaaacatatagcactctgaacggaatcgaatccatgtgccattttcttgtggcagcggggagtgtattatcttcacatatgtattgagggtttattgggtttactagacgggtggtgttggggatacacactgcatcttggtaccatgcccattgtaagcggattctccagtcacatatccaagctcaccagccactaagggcctggtcaattttacatgaacacagtaagtcctcatttaatgtcgtcagcagattcttggaaaccgtgacttctttaagcaggaagttgtataatgaaacaacttttgttctcatcaatgctataacaaagctgcatattgaaggacatgacattatttgaggacctgctgtacatggttttgcttacagtttcagtttctaagacctaccgatggaattaagtgaggacttattgcacttgccaagggaaaaactaaaacaaaagaaataacaacaaaaaataaaaaataaaaaaagggaacaaaataaaaaacctttcctcctcagagtgactgtagtccaagtgtctccaccacctcgaactcccttctctggctacttccaaagaccattttgagagacatgtgaaagaggcagaaacaaggaaccatacagtcacgtaatctggaagaaggatcagtatcctcctgtgaccacggcttactctggtatgtgtaggaaatctcttcctgctctagcaaaacatcactgccattaatactttcttctccctttatctcttttatttcttttttggtaacagaggagaaagattaagtgttggtctgaattgttctgaataaagtgcattggaaacaaacagccacaagacaaggtggcttgtgggtcaaggaaactcacagtctaataaaaaagtagaatataggcagtctttaattcatttttcttgattcaaggagaactatgtttcatttgtcctgattctattcttataaagtaaaatatgaacacttttgtgaaccattgaatgacaatgtaaatcattttagcctttagaaagtatacttcgggggacaaattaactagacacattctttatgtggactcagtgatcaaatacattatgctattctaatttgtgctaaaaaattaaattattaaatactgttaattcgtatctggcagcaataacctttataactaaattcctctaaaatattttcccacggagtcaacactgcatacaaaagctgcttagtacaaaagtttaaaaaaaatatttcccacatattctgattaagtctcagcaataacattttcagcatgtggatgtcaaattaatatggaatagaattcccttcacatgataaaaactaacatttcattcatcatccattcaataattatctatgaagcaccttgtttttgccccaaaactatgcaagaagctagtattacttttctgtttataaatcacgtttatctgtagtgtgatatttgcatttcattataacttttagaagtaagtatacttataaatgtcacttttgatagtaggaaactatctcgaaggcttggagaaattaagcgacttacccatggtcccccaacagaataaatattagaattaatctttggttacagtgcccattctctttctttcgttttcttttcttttttttttttttgagacagagtctcactctggtgcccaggctggagtgcagtggcgcaatcttggctcactgcaacctccgcctccacctcccaggttcaagcaattttcgtgcttcagcttcctgaatagctaggattacaggcgcctgccaccatgcccagctaatttgtgtatttttagtagagatgaggtttcaccatgttggccaggatggtcttgcactcttgaaactgtgtggtcggcccgccttggcctctcaaagtgttgggattacaggcatgagccactatgcccggccccattctctttcttttttttttttctttttaatagtttattttcattattcttttattttattttttatttttattttttaatttttcaagacagagtcttgttctgtcaccaaagctggagtgcagtggcatgatctcggctcactgcaacctctgcctcccaggttcaagcgattctcctgcctcagcctcctcagcctcaggcgggtaggtaccctgctacctcaatcccagggtagctgggattacaggtgcacgtcaccatgcccagctaatgtttatatttttagtagagatggggtttcaccatgttggccaggctggtctcgagctcctggcctcaagtgattcgcccgttttggcctcccaaagtgctgggattgcaggcatgagccactacgcctggccccattctctttctagtctaccaagttggcccctcagtatcatgtccatcttctggctggcacatgaactccactagagccaacctcagaccttcttcctacttttagattcccaggagtcaatacagtttggcacatcataggtacttcacacattttcactgacgctctgaatgattcacaagaataacacaaactttcaggagtttactacctgcttaatggcttctgccctactaagaggtggttgaggacttggctctaaatccggctggactgcagaaagccaggcctggcactgctgcagggtgtcttgtcggctgacgtgcttctgaagttcgtgttccaaactctggtacatctgagacaatacaatcatgctgagattatgagaactgctttctacctctataaagatcattcaaattcaatgaaacatgaccagtacatctaaatggattttccccccaagattctgcaatttcatctaatatctaaggcagttgtatgtctccccagatgttgcaaaatgcaatgcctataccccagttgataacttctcggaccacacatcacagtgtaatatccggattaggggaagagaacatgagcagggtaaatataaccgtagaggcatgctagaatacataaaatcattgaagttaattgtcataaacataagtcagaggtttttgcagcttctcttcctatggtataaatattgcactttttgtttaagctagcaactaaaagtaaaaataaaaaatgatctcaaaaaaagataaccaatgtttctctaactgagatgcttctgcaatagagatagggtaaaatttgaactaaattataacatgaggagtggagaggtggatgtcctcacttcatcttagaagttatgttccagggcaaaaataatccagaataattcatacattttctgatatgtctatttaattaattaatccttaacaagccaaccaattttcattttatccataagacatattaagaaaaattatgtgtctatttgagatcaagagaaaatatatctgggatgtttccatttaggaaaaaggaaaaaagaaggaaattagtttaacctggcatttctttcattattgagacaatagaagcaatcattgaattctgcttttctctgtcatcttttaaattcatcactttcgtctgacattgggtttatcccttatttattcttattccaagcagaatttttaaaagaatggtgttttgttctctttatcacttttgcaaactttaattatgaagttctgattatgttcttagaatttcatccactttttaaattttaaaaattatgttggcttttccaacatccaccaattaaaacaaattaaactgtatccctaatacaaagaaaatgtccactgtgaaggaagacagtgtgcaagaaatctctgttgaatgagtgaacgaatgaactcaccagaaagttctatgtgtagcctcattttctctcttcactcccccttttctccccttgtcatcattttcaattatttattagattcttgtagtcctcttttgttaacctttgaaggtgatttttttttaagtctaggaagttgactaatgtcacccagaattttttttattattatggtgaacacggaccattctaaccacatcactgatgtatcaccagttctttttgttaacctttgaaggtgaatttttttttttaagtctaggaagttactaatgtcactcagaattttttttattattatggtgaacatggaccactctaaccacgtcactggtatatcatcagttcttactggctagtccagtaaacaaaaatacacagaatactaagtttaaaggcttataaaaactctttttagtgtcatttaaaaattctagaataatagaaagcaatttacctattttagtaagtttttgttaaaatagccattcttacccctcttacacttatttctaaaacattaagaattctgttttagtggaagtacacccacttaagtgtaagtcatatttgtcagttactcgtttctcaaattctatatgaatgcaaacaaatattgatttagattagaacccaggctgcatacagttaaaaagaaaataattattgtgaaaaatatgaaataaatttacttttgtgctacaaaataaatggaaaattagaaagtattgatcgtgtgcaaagaaaaacacatcctctattcaaacacatcaactatttttttcttttttaaatttcctcaaattccttttaccaacaaacaaattaactttatttatttatttttatttagacggagtctcactttgtcccccaggctggagtgcagtggcgcgatctcggctcactgcaatctctgcctcccacgttcaagcgattctgctgcctcagcctccggagtagcggggattacaggtgcttgccaccacgcccaggtaatttttgtatttttagtgaagacggggtttcaccatgttggccaggctggtctcaagctcctgacctcaagtgattcacctgctttggcctcccaaagtgctgggattataggcttgagccaccatgcccggcccaaatcaacttttaacaaaccttttcacaatcaactcatggaataaacaaattggataaaacaatatctgaaattcgctcacacctgtaatcccagcacgttgggaggcagaggtgggcggatcacgaggtcaggagatcgaaaccatcctggctaacacggtgaaaccccgtctctactaaaaatacaaaaaattagccaggcgtggtggcgggcgcctgtagtcccagctactcgggaggctgaagtaggagaatggcgtgaacctgggaggcggagcttgcagtgagccgagatcgcgccactgcactccagcctgtgcgacagagtgagactccgtctcaaacaaaacaaaacaaaacaaaaaaaccaatatctgaaattcactgcttagtcacatcaatcaaatacaaaatatgttagttttgtgttcacatagcaactgtgaaatttatcctcgtatttcctgtctggcaacacaccaaaacgaatccaaagatttgagcatcgattctatttgtaaaaagtctctagactgcacagcctctccccataattccttgtcactgtggaatgttctgggggcactcaccctctgagctgtgctgcagatcgctgagtagctgtcctttgtgccctgcagatgagcatgcacgttttgtttaagtttcgcttgcaggtggtctgcacattggccaatcaaagtatcacctttcatttgaagattgttcaaacggtcttcaaaaccagcaatttcttccatcattgcctgcaaaagtgaaaccaatacagagttttcagaattctacttttaagtaacttatccatcaaagtttaagatagattatttcactgtttaatattgtttttgaaagaatcttgcaatttaccttagttatatattaaatgaaaacaaaagcacatgtatgttttcagggatactccaagaggaagagtcaatgagtttaagagattagttacataaggaatgatgaagtaacctttaacactagaatgtgttcatggctggtctcagagagataatactccatggtattattaccagacaaaaagatgtccctatatttttcaggttaataagttataattctggcataatttttatctaaaacaatctaattactatttcatcaactttatataatatcttatttctataaggttggtgcaaaagtagttgtgttttttgtcattcttttttttttttttttaagacagagtgtcactctgctgcccaggctggagtgcagtggcgcaatttcagcttactgcaacctccacctcccaggttctagcaattctcctgcctcagcctcctgagtaggtgggatcacaggtgcccaccaccacacctggctaatttttttttttttttgtatttttagtagagatggagttttaccatgttggccagctggtcttgaactcctgacctcaagtgatctgctggcctcggcctcccaaagtgcttggattacaagtgtgagccaccacgcccggcctgttattacttttaatggcaaaaactgcaattacttttgcacgaatataataatctaattctagtttctgtaataatgtaatatctaatttttaattcttgtaatatctaacttacatctactactgtttataataatgaaaatagcatttaaacttatcatttattaagtacctgctatagtccaggaattatatataagcctgacgaatgtgtattatcattgttttatagatgaggaaactgaatcacagtgaggttgtacaacacagtcaaggtatggcacagcccccaggctttagacacagctcggcctgatttcacctcacaccaccatgtccacttgcattctttagtgagcattcttatagatgactcagggaagaataacttattttttaaaaatcacgttctggccagacgcggtggctcacgcctgtaatcccagcattttgggaggctgagactggtggatcacctgaggtcaggagttagagaccagcctggccaacatggtgtaaccctgtctctactaaaaatacaaaagttagtcgggcatggtggagggcacctataatctcagctacttgggaggctgaggcagaagaatcgcttgaacccaggaggcagaggttacagtgagctgaggttgcaccattgcactccagcctgggcaacaagagcaaaactctgtctcaaaaaaataaaataaaataaaaataaataaatacataaataaataaaatcaagttctagtgttttttttttttcctgttatatgatgctaatgacaagtgacacaatccaacatagggtagcctgggtaacccatcattatatctataggaaacctgggtggcccttcagcagtccagggtctacaaacagcgctgggctagcagttatcatatatgctcagttgaaaagaaccactctgtctctgagttggaacagaaccactccatcatgaggccattcatggggtagactaccttctggattgtcatctcctcagtgcctaccagaaggtattgtgtagctacttttttattcatatttgttaaataaaatcctttcttatagacagaaatgttgcagcccagaggggctaactggctttcctaagacgcactgtcagacactgaccacatgatgagtaaacttgttttccattaagatcacaaatcagttgctccatgaaattgtgaccataacgtctatcacgtggtaaacacgattactaaaaatacatattattaagttcttatcttgatagatttaaatagtgcttttagcctatcacctatatcaaagataagaactcctcatattagttttgtactttgtgatttacaaaatgtcttcacaaatattatctcctgtgattagcacaacaattatgagatgggctggtattgttatcatcctaaaggagaaaggacagactcagataggctaagttgtctctccaggaaggggaagagtccagcctagaatccagactttctgatgcctttggctgcattttctaaaatagattccataaagactaaattctgagataaaaattattagctgggggaaatgcagcaatgtgttcagaagttcaacgcgaggattcaactcttcttgattcacttgaatatcaagttcaattgttgtcaattgtcagaagtgcttgagactcagaccttcatatggtttggctgtctccccacccaaatctcatcttgaattcctacgtgttgtagaagggacctggtaggagataactgaatcatggggacagctctttcctgtgctgttctcatgatagcaaataagtctcatgagatctgatggttttaaaaaggggagtttccctggaaatgctctcttctgttgtctgctgccatgtgagatgtgccttaacctttcactgtgattttgaggcctccccagccacaaggaactgtaagtccaacaaacctctttcttttgtaaattgcccagtctcaggtatgtctttttcagccatgtgaaaacggactaatacagacctgattctctcagtacaatcattataaaccagagatgcacctgtgtgtgcacccccacacatgcacacacatgcacagacacatgcgtacacacactggtgaagccatcccaaaggcagccctttaaaggtcaggggtaccttgtggtgggccaattgctgggtgattgtctccaggctgcttgtctccaggaggtcaggtgccaccagtctgccagacatctgcagcagccacttttcgacctcttggagctcactgttgtagtcttcatggtctttgactttcgcctccagactgaagacatgctcctgcaaaaccaggtgtccatcagagatgactttcaagtgaaaaacctactcaaaactgttttgtattacaaaaacccagtgcaactcacagggtagttagagctacttagaaaactaccaggaatggaaaacaacatagtcattatgccaattaaatatccatctgaataaaaaaaaatactaacccgtaccaggccttaaaattacatgacagagagaaaggagtcagggcccacattttggaaaataaacccttttacggagtctttcatctctccttacctttcctatgctgcacaggtcctggtaatcactttgaagttgatctattttgtcctttaaagtgacgtcctgcaccagttccaaaagagcttcacccttctctctcactgactttactgatggttcatgggacagcaccgtttgttgaagtgacttgaattacaaagaaaaaaaaatgagcctgctcatctccgtggacaagatgaatacatacatattcccatggtatgcaagagatgatctacctcaaagaaagattgttcatatttatgaagcaataggtgcaagacattaaagagagagtgatttattaagacgaatacagtttctaaatacaacagcagagtcacacatcaaatggcccttcctatgtggagataaaaggatgggaaatagttatatttgtctaaattaaatatagtttatatttctggcttctaccttattcctttcatcagagaaaaaaaatctcaacataaaaaggccactatcttttgattttgagttcatgaagttagttccagtttgagctatttatggagttagaaagaacaattccagttgtgaccttgctgagataggctaaaggcactatttaaatctatcaagaactcagtggccaggaggaagaggttgtgattcttatatggcctcttcaaagacaagttgtcgggcttggcagagaagccaaggatagaaatagacattggctggaagaggccgtcacagaagcttccaacagggaaagctttggggtaagccagcacactgtaatccttaaaaggtatcactcaatcatccagatcaaatttataacacaaattattccacatataagcttgcataattgcttcaaaaatttgagtgggtgaagtacctgtgtctatgtcatgtatagctatagccacatcactatttattctttcaaaaatcagtttctaaggaacttagctcgagtttgttaactagaacttattttcttataaatatgatatgtcattttcaatttaccataggtcagtttctagccttaggtaccagaagatgaagggaagcctcaatatgggaaagatatgggatcctgatgccagcaagattttacctggaggatccaaatacctggctcacgcatcagaaaaggtcttcattgattgacagatacgtacaatcaataaatatattgatacaatctttgagtatcagatctctgaatgcaaaaataactctgaggtagtggatttaacccaataaatctccataggtcatggcatcactggtcagctgcagaacggacacatgcgggatgcattccagcagctgttacgggtgacacccagcaagaatcacctccctcccatttggtctctgtgtgacctctgcatgcatctgtcaatgagtaaacacactaccttgtatttagataactgagcttttttctcatataattccattttgggttcttcaggaacatgtagaatttcctggtattctgctatccactgtgtcagtgctttgcatttatctgagaattcctttgctaaatgaagacctttttccagcgtcatgtgttctttccggacagtgctggtcagttccttcaactgctccatgtgatcatgaatctcctttcttaacctctctgcctcgccttcctccaagtatttaacagccctctctcctttctcccgggctgatttcagcaaactgtgacctttctccatgtctttgagcaaaacctgaaaaagagagtgagtaggagcaaaggtagtcttgtttcttttcttttctttcttttttttttttgagatggagtttcactttgtcacccaggctagagtgcagtggcacaatcttggctcactgcaacttccgcctcctgggttccagcgattctcctgcctcagcctccaaagtagctgggactacaggtgcgtgccaccatgcccagctaatttttgtattttttagtagagacagggtttcaccatgtgggtcaggctggtcttgaacttctgacctcaagcaatccacccacctcagcctcccaaagtgctgggattacaggtgtgagccactgtgcctggccatttcttttccttttaaagaaaggtttctcaaggcctgtttttaagtccacctatttccctttaaaataagttgttgacattcataaccagatttgacgtgccaggaatcaggaaccttggcttctttatttcaatataggttctaaaagtcttgatcaatatatcatttccaaatcagagacttgaaaaagaacttgatgtttctctcatccttagcaatctccttctaaagacctgagtttaaactctttacaagcactgggccattaatttgagagagaaagttttctcttaatattgaagtgtcacactggaattcagtgaagactttcatgggtgtccatgtgtaagtcattctgataacaacacatcatcaataagtgaaagctagcttttggccttaaggagccaacttagtatttcaagtaaaatgatgagctcaggatcaccaatcataatggttgggatgatcacctgtgtttccagtatctatgcaggagaatggggcagcttggtgaacggaaaggttggatacaaatctgaagtatgcgtgcctacctccaacgtcttcaatttcttccccatcattactgtatctactttgtcaatcttggtagccacattcttgaagtttttatgagtagagccataccaatcagaataggaactgagggatgattctgattcctccaaactctgaatctcctcctccaggaattttatttgttcctatgaaagaaaagagaaaattgaatggtgaagtaaaggcctgtgccagggcctttgttgatgaatatgtatcttcactggatgttagtgaaaggaaggctattttggctggcgaagtttgctggtctatgctgagcacctggtgacccactcaccagcacttggagaagcagggcctggtatctggaagtcagctgggtggcctggcaacccattctgctgttcacgtggctctcgtccagtatctcctgagctctagctcccacttcctcaacttcatctctgtatgcagtcacttcttcgtgccacttctgaaatgacaaagtatcgaagggaaagattcaatcttagccattcgaataagccaaatgtatatcttcttataggaaatggtttcagtgtaggtttagaagatgtttattttgagatttaattttgaaaatgccatatgttatcttcataaatattatattacaacaatgtgatacaaactgtacacttgagttggatagttttctgtatctattacacttcaattcaaaaattaaaaatgaaaacaggccaggtgcggtggctcacgcctgtagtcccagctgcttgggaggctgaggcaggagaatcgcttgaacccaggctacagaggttacagtgagctgagaccgcaccactgcactccagcttgggcgacagagcaagactctgtctccaaaaaaattaaataaaataaataaacatgaaaacaaagtggcataattttttagacctcctattgtacctagatcaattttaaaatgggtggataatgaaaataaattcctaaggctcaagcattattttagatgtgtgcactaaaattgcataaaacttagaataaaactaattctcaagtactatttcaatgaactatattggagcaatttcatatcagaaccataaacttaaattattgtaatacaagcattcatgtatcttcacaaaacaaggtaatagggtatggaaagaaaatataaaatggttacattaaactaccttgtatcaaagactaatttatgaaataattgctgtaagaggaatgctccattgtgatttattttaactttctaggtaatcaaaaagattttgcaaagcctaagctttggataaaagttactaaatatcttaatgaaacaaactatgcaaggtaactgtagctttgacaaagatcaggaatctacatgagttgtaccttcatctgatgtaattgtatctccttggttgccctgttagactgacgtctggtcctgggactaactttctcctctgctgttttgagccattcatctacttgctgaaacttttgctccattagcctcaatttgttcaccacgttattgaactgagttcgagtctcggacagcctgtgctggtaagcctgccagtcttgccggagagactctaaagcccggtcctctgcctgtgggatacctgatgggatcacatcctctctggtgtgcagcactgagttcaacagggcctgcccctctgcacagtgtacctgtagctcctgcagagaaaaaggtatggctgtcactctcaatcatatttcacacttgcatgggttagcatgtcttgcccaagccaactgtgcccacttgaacttctcattagaaaaaaatgattttattattatgccctatacaaaaatatgtccctaaccatattttctccgaagtcagaaggattcctaaaactttttcaattaaaataatcaacatacacacacacacaccccaatatttttctcaatcaacagtttcccaaatttgactttttagctaacaggcaaaaacacttgtgaataaagggctattgtttaaaagaatgacctaggcttattatagctcataatctgcttaaagtgacttaagcttcttgctttgacattgaatagctcagtgctacatttgtgactgagaaagaaacaatgaaccttctgcttcctaaggaggaatcttttgccaaagctgtactctaggcattgtggtggccaagaaaatttgaaactggagagtgcagggcacacaaacttgggaaattggttcatcacacctgcccaccaggtgctctgaggtgcaaataaatttcctccaccaaagcctaaaccccaaagatttaccctacaaatttagtataaatcaagttttgaagagcatatgctattttttataggacaaaaagaatcttatatccttaaagatattggtaaaacaacatggcacacttatatttctggtgataaacataaatctatactgtcacttgatctgatcacccaaagtaaaataaatcaagtcaaatcccatcaacaatgttaaaaatatcagtatatgtagttaaaacatagtatttctcaatactatattttaaaaaccacttaagattgctaaaatatttttcttacaaaaataacattctcacatggtttcaactaatagaaaatttttcttcaaatatgatgtcacttcaagcacagtataatgtaaagacatatgcacatggaaggagaagaactatagatatacatggtaaaatattaatcaaattggcaacaaatacataaactttattctaaaattcttagactttttttcaagataattttttataattattttcctaattcaaggttggcaaactttttctatgaaaggcctgatagtaaataatttggatcttgtgggccataggtctctgttgcaatgacttaactctgccattgtagtatgaaaaaaaccacagacgatacataaataaatgggtgtggctgcattccaataatattttatttaaaaatacagacactgtggccctggacagtagttgactaatctattaatcttctcaacatcttttccatagttcataagtaaccactttatctattatccaagttaatattctattaaataaattctcatatatcccaaatttcaagtctgtattctgaaggaaaaaatagttcaatatttaaataaatatatatataatattgttaaatatataaaatctataagtaacataaatgtgtgtatataatatattaatatatattaatatattaaagatattatattaaaaatatataaactatatatatgttctatgacccaaactaggccttcaggttatacaaaataatttctgaatatgttccacattactggccaatccctacaccatgtacatgctacagaacatcaggatcctgaagaaattctgctttgtggttgcagcatcacaattctccaccactgcttcctgccactagcatcttccttcttttttaacctttgtggtggctcacaatagaaaatgtaagaattaatgcatggtgaaatcagggggaggttaggtttgcaccacacgaataccggcttaagtgaaatattttcttttgaccagagcaacagcaacatctgctggtgatgggtaactattgacttagttctacacaaaagcacagggagctcagcatttgcttaccagtgatgttggtagtgtagaactaagaagggttatgtaaagaaaatagtcaattctagtcaaataaattacaacagctaaacctgtggatcctactctttggaggcaggatggatgagacccttaagtaagctaaggaaattgtgacccttctaacttttagtatttacttacttcatgagtagaccgtatatttaaataagattttcttccatttcggttaatccttacaactctgtggatgaaattgggtcagagaagttgtctcttgcctgaagtcacctagtgttgggtcccatcaaggattagagtcccaacttcccaatcccaaccccattctcttgccattatacaatttccaagaactagtagaaaaagccagaaattttatatgtgactgataatcatgatggtccctgattttcccaccttgttcaagctgtaggtaaaacttacccaatcctgaaccaactctgatcaggactgatggcacatttgtaagttccaacacatcactggtgggacataaagtggtctcattggccttcctccatcttctgctgtttgttttgtacatggtggccccttcttggtgaacttccttgattcctacctattccttaaggtaagtttatgggcccttctttgatgctaccataagaccccttacattagtctactaatgtcctcgccatattatttataatcatctttctatgggtttgtgttcctcatcagatttcaagtttcttgaagacagaaatcatatcttaatcatctttgcctgaagtagctagcaaagtatctgtactgtattaagtatccagtaaatactgaatgagtaaataagtatatagattgtgaccactttctccaccatgtctggcatctcaccgtgaattatggcccgctggcctgggcactaacacttatttttttttacttctgtaattccttcttctagaactctgagcccgaaccggtaccatcagcaatgtggcaggttttgcttaaaactacatggttcaagatattgccactagtttgactttgtgtcaccttctaatgacttctgccgctgtcccccagatctgatgtgatcccttagggagaaacaggcaggtaagccagaaaaccccatcaattagatctccagccatttgtcagggccaccctagcagctccatgaatcccccaagtgctagtcctgtcctacctaaattgcctacaaaatgatgtcaactagcgcatactgctgaggtctcagaatgttcttgatcaaaccttatggggattgcacttaatgtgtatcaactagccactggactcaaggtttctattaacttcctattgcctaaaataataattccatattcagaatgaagattcctttgttttaggataaaggaggccttacctgaagatcacgcaatgttgtctcatgagtgtgggcatcaccttcaagaactgaatactggtcgagcttttcttgttcttgccccaaccaaacttcaaatgcctttaggtctctctgatactcttggtgcaggcggacaagtttttcagacttggttacggcttcctataattagcatttaaaataatgaagttaggaacacattactttataaagcatcagtgtgctgtaattcacttttgtaattttagaaaagtataattattgagacattagaatatgagttatttcctagaatcatgaatcttcaatatttatgtaaaaatataaaaacctaatatttcaggaataaaagtgtcattaattattttgttgaattaactacatgatctctgaacaccttataaaatgtaacaggctaagaaatgaattcactttactaatttcataaaaattcacttttgctaatgaagaaaattgaaattcttatattgtgccttaaatgaagatttggacgtactgtggattaaattttccatagtagaatgcgctctgaaaaagcatatttattttctttgtgaggactaaatgaagaatgattaatactatcagtgattatttcccaccttagaaaactctcatcatcagacataataaggcatttatgagtcttcaattgaaggtgtccagaattttttttaagttggtacctttctaggaatttttagttgaaaattatcttactttcatagctttcataatactaacaatatttgaaggtttttgattttgccagtaattcctttaaaatattaaaaattcattttgcttttgttctgttttcccaagcctgtcattcttgaacataaatgagtctttaaaggagcacagctccaaacactccccttttggtgagtctacaaggaaagtgctttgccgtaccttggccctctcttggatggctctgtatcgttcctgtagatcctggagttctagctgggtgacatagtgttctgtcatgccagcccctttgacttcgatggtctccagcaagctgctgtaactcagcacttcttcatttaataactagagagcatttaagaaaaataaagtggccattcatgcaccatcacatcaacgacactgctaaaatcaagatattttaattgtacagttgacaagtgacctcaggttatttattcgtccactcctccatcattttatctatttgacacagatatgtgtgtgaatgcatgggtgtgtgtgtgtgtgtgtgtgtgtattttatgtctggtccagaactttctctaacatatgaattaccaattaactactttatatttctactcttaacatttcaaactgattatgtccagaaatggacccctgatgttcaccctatccctattctaccccagcccccatgaagcccccttctctttccatctcttttcaaacagcaaatgccatgacctcccacccagacggtcaacccagaacatgggaattgttccagcgtcctctctagctctccgtcctctaaaccattaggaaatcctgttagctctacctcctattatactgcgacatctgtccccacatctcctgcaaactccccagcccaggctgccctcctctttcacttggactttgcagtggtatcccaggcagattcctggccaccaattctttccctgtcccttatttcatgctccacacagcagtctaagtgatataatgtcttgcaattaaaagttgaatcgtgtcgcttctcagcttaaaacctggattatcgtcccaatgctgccgggatcaagtggaaaatcctcagagcagctggcatggcaatggaggatcaggctctgtctctccatcaaactccccttgcagcccctccctgcctactctctgctgcaacaacacctgcctgtttcctcacagctccccactgcaccaggatatttccctccacagggcccgaggacctgctttttattctatccggaatgctggttcctcaactcctccccaggctcatttctctggcttaaattctttagtgcatggactatatgtctgctgtttcagagaggcctttcctgtccctctcccttggcctcaaacaagctgtatgagccttttcaaaatgattctctctcacaccacactactttttttttcttcatagtattcagcagttaaaattatttatttgtacatttattactgagtgcatgcatccccactaacatacgcttgactgtttttactgctagaatcgggcacagtccctacatgtagcaatttctcaataaatgttgattgaatagatgaacaatccaattaattaagcaattaattattataacagataatacatgcaggtatttatgaagcagataattataattatattattttatggatgcataaatgagacccagaaacattaagtaccttggcataggtcacataagatcatttagtcatttaaataacttttattcagcgtgtgttctgtgtcagacagagagccaagtgttgaggatataaagaaaattaagcatctctattcactgaaggagagggacatgcaaatatatatgaaattgataaagagctttgaaccaagggctatgagagaacagaacaatgaatcaagcctgagcggtggtggtgtagcatagctaaaatgacttcaaaattcattcagaaagataagtaggaggttgccaggggcagagacagagcaaggaccttctgtaaaaagagaagagattatgcaaagacacagaattgtgaagattgtggcatgttcaggagatagtgtgagattcagcaaggctggagagcgcaagggaggaggctgggagcatgaaggaaaggagcatggcagaggagtttatttccattcttacaaaccaggtgacggagattgagcttatcctgtagacaatgggaagccaacacaggacctcaggcaggaagtgagacattcatctttataggagataacaatagatggaggcaagaaacaaggtgaaaaattaggagtctgttccagttcaggtgaagaggatggatcagtaggacctagtgccagatgcaaagtggcaatgagaaagaaggcactgagaataatgaggtttccaatgtaatatattcagggtgaggtgatacaaatgagcaggaatagagaatgtgagaggttaaaggatttctgtgtagaagatcacaagtgctgtttaggataatggtaagggggtgatggaacaggctgaccgatgatcatgccctggagtgaggctgcagctataaaccaaaggactgtaaaacttcatgtttgaatactactgccaataagttttaagaacatgccattatttatttatttaaaaaaatctttccatgtagtactgtactaatgtaagcattatgacgaatgcacaaaagataacacaaagggatgtgataaaaaaaaaaaaaaaaggaagacttcctaatgatgagcaggctgaagacattaaaagatatttcatggtgctacattttaaatggtttgtatcataaaacatggatctacatggttttcctggaaggaaaaattttcactcactaataaagtaatcacaaatgaaagtccagtttaagaagcctttagagattatactaaaagccccaaacgtaatttgcttatgtgcactgccctagggtacacgtaatcccatttttgtctgactgtggcattctaaagaagcctgtgagaaaacacatggaatctgaaatccagctctcaccttggcttttccgagcatcgttgttttatcccgcagctccgcatgctgcctttctgattcattcaggttggcttccatactatccatccaaccggagaactgtcgaacgccatcctgataacttgtccacttggagagagctccttcgagttggctgaaagggatttgaaaggacaataaatccacattgagaatccttaggagtctaaaatgtcattgtgtctgctccatccactccagtaagcaaggggtcaagagatcaggaagaagcttgcttgggagtgagcaggctgcccagggcttaaggacactgagtccaggtctgaagggcagcctcaggaagcaaggaacatttaaacccaggccaatatgcagaaacatggaactagctatcaactcaagagtcagcggctggggggacacgagacactgggggagcctcaaaggcaaaactgagagagatcccctgagtgggtcttttctggagccaaagctctgggcagggagagaagcaacacttaactctatcaaaccgagcaggacattgagagcaggagagaaaagtaagaacagtaaccaccttacgtgagattaaatatcagaaaatcgtaatgaaataaaaggacaatatttcctgacttggtctaaatagtaaaacttaattatttattttatcgataagttaagcacttcccttgtctcaatacacatgctagttttttttttttaagacaaagtcttggccgtctcacccaggctggagtgcagtggcgcgatctcggctcactgcaagctctgcctcccgggttcacgccattctccttcctcagccgcccgagtagctgggactacatgcccccgccaccatgcccggctaatttttttgtacttttggtagagacagggtttcactgtgttagccaggatggtcttgatctcctgaccttgtgatctgcctgcctcggcctcccaaagtgctgggaatacaggcgtgagccaccacacccggcctacacatgctatattttaaatttcattaatcaggccgggcgcggtgactcacgcctgtaatcccagcactttgggaggccaaggcgggtggatcacgaggtcaggagatcaaggccatcctggctaacacagtgaaaccccgtctctactaaaaatacaaaaaattagccgggcatggtggcgggcgcctgtagtaccagctactcgagaggctgaggcaggagaatggcgtgaacccgggaggcggagctcgcagtgagccgagatcgtgccactgcactggagcctgggcgacagagcaagactccgtctcaaactaaataaataaataaataaataaataaataaataaataaataaatataaaaataaataaattccattaatcatttctgcctaattgtactaccaggttttgggtccttttgtagcagacactgtaagtgctccatccatccacacccccggatcacaccactgcagcacagtccagttggacttctaattgctcctagatctcttagcttgaagacattctctagcccctgatgtactctcagtttgagggcaatataggcacaggggagcctcaccctgaggggcagccctcaactgctcttctaattcatatgagtttgtctctaaatactccagatcccctgcccttggatgggataactggggctcacactgtataccagctcccagcattgcctgactggattaagttgcagttgctcacaacggtgggcaactcgcttgataacatacctgatatggttaagctctgtgtccccacccaaatatcatcttgaattgtagttcccataatccccacatgtcatgggagggacccaatgggaggtaattgaatcatgggggtggtttcccccatgctgttctcgtgatagtcagtgagtgttcatgagatctgatgattttataaggggcttttccccttttgctcagcacttgtctctcttgctgccatgcgaagaaggatgtgtttgcttccccttccgccacgattgtaagtttcctgaggcctccccagccatgaggaattgggagtcaattaaacctctttcctttataaattacccaatctcaggaatgtcttcctagcagagtgagaacgggctaatacaacaccctttacttactgccctccccctgcctgccatttctttcccactcctctatttgtatttcctgggtttacctcccaagtccactacttggttttaatccttatatttttacattatgaatctttttttttttgtatttttatgttagcaacaacaacaaaaagaaacatgcatttttagttatattaccacattggcacagtattcaggtcaatctaaatgtgagattacatctgccagtttcttttgttctaataagaaaaaagaaagaaaaagaaagaggaatcaagagaaaacagggggaaggaaggaagaaaggaaagggagtgagggagggaaggaggaaggaggaaggaggaaggaaggaaggaaggaaggaaggaaggaaggaaggaagggaggaaggaaaggaaagggaagggaagggaagccggccacaggaatggtctgttcagtagtattatattgatcttttagtaatagcttccccagtgcttggctgtagtttccctcaccttttacaacgaatccctgcagacaaaagggatgcccacatatccttcacactctgcagctgctgctgaatagtgggaatgccttctggagaagtattctgaaggacagattctcccctggtcactatcattttcatctgaatctctttttcctgtttgactgataatagagcctgtgaaaacacatacagaagtcctttgtcatttgtatgtttaacattgctggctttaaatattgcagagctcctaaagatcacagaataatatgcaattgtgcccagccctggagctcccagtcggctgagacagagggtggggaagtggcttgctggtgaatgccagtcaccagctacccgctggtttttactaagtggccttggtgttgaaggtctgcagtcttctctgaataatcccttccttccaatgaagttttactttactggttttaacaagggaaaaatatagtacagtagaattcatgatttctcaaaggttataggatgaagagcttataaatgttatggtctctataaccaaaaaaacccatagaaatagattatatatttcatgttcttcataagtactattctttttctatgtgagaaggaagtttcttcttttgctttttttagagacagagtctatctttctctcccaggcttcagtgcagtggtgtaatcatagttcactgcagcctcaaacccctgggatcaagcgatccttctagctcagcctccttggtagctgggactacaggcatatgctgccatggccagctaatttaaatgtttttttttttttgtaaaggtgaggtcgatgcccagcctggtgttgaactcctaggctcaagcaatcctcccacttcagcctcccaaagtgctgggattgtaagtgtaagccactgcgcccggccagaaggaagttttaattccaagttataaaactgataatgttgcctaaaagacaaagcttcatctctttttataatgtggttcttgccaacttccaaagcctcagcttcagccacccattgccaccagtttctgctgtggcaataagcaactggtagaaatttctcacacactacgctgttctttcctctggctgttcctcacacttttcccctctctgccaccattcccaagtctccacccagttatctttgccaaaataattctccctatcattcttaaaaacttggttttgcccggacgcggtggctcaccctgtaatcccagcactttgggaggccaaggtgggcaggtcacctgaggtcgggagttcgagaccagcctgaccaacatggagaaaccccgtctctactaaaaatacaaaattagccaggcgtggtggtgcatgcctgtaatcccagctacttgggaggctgaggcaggagaatcgcttgaacccaggaggcagaggttgcggtgagctgagatcacaccattgcactccagcctgggcaacaagagcaaaactccgtctaaaataaaacaaaacaaaaaccaaaaacagaacaaaaacttggtttatagcagggcgcagtggctcacacctgtaatcccagtactttgggaggccaaggcaagaagattgcttgagttcaggagttcaagaccagcctaagcaagaaggcaagactctgtcttaattttattaaaaaaaaaaatttaaaccccacacaactcgggttacctatcacacttcctaagaaatctctcccaactttcaaccccatcccttctgcacggttccactcctgtgtatgtctataacaccataaatacatctgcatctgtggttgttgtcttctatatttcgacctccaacttcagacagtaaaacccctgaggaaaaagactatgttattcacctttgattccttggtgtcaagacagagtgccggtctcctagaaggcacccagtatacaaatgaatgcagactcattattttcttcacaaatgcgaaaatgaactcataacttgggatgggaggagaattggctaaatacaggaagacaagtgagtggaaaaagatggaaaatgttttgccctataaaatgtttcctcaaaatattttcccataatgaatatgtctgtgatctcatttaaaactagcctcttaacaagtgatcacacaagtaatcacattcgggctttattttattttattttttggaaaacatccggggtcagatgattcaggaattctctggcatgtgcacccaaggcagacagcgttgcactcacaaagcatctgagatttatcatggagagaatgtgacatcatcaccccaggtggatggagacgggaaattttgagaaaaacaaattctgtaggttggagatatttctgtgtaaagatgcacacctcgagcttgagcgtcctgctgtccagcacacttttgtcggatgtcgggtggcagtatgaatccagcatgtgaatcgcatccgtcatccagtcttgtaattctttaatcccaagagagaactgattgtgttctgcaacgattctatccagtcttgacactttctcctggaaatgacagaaatggttttcgagctgtccatcccacagagacaaactgcaaagctaacagtttgtttgaaacaaaggcaatcagtcatggcttcatacgctgcacagatacgaggcaagtctggcctaaatctatgagatatgttaaagatctttctaaatcataaaactattagaataactgggtcaaaagcaaaaaaaaaagttacaattttatgcctctccaattctttatgactatcatgattattttaaatcagtaaaatttctccctaatgccttgtctgggagactggtcaaagtagtttctagttttcacatatcacattaggctcacctgacacaacaacccacatgacctacattgtagccagagttctaaaaaaaaaataatctgagatttttgtaatatctctaaattttaaaacatgggaccatacacatggttttgtttatcaattataggttatatctaacacagtgaagactttgcaagaataatctacagctctcaaaatattcatatatcgattacttttggtatctaagtaaatacaaaggaatggaaagatgttcttcattcattctaagatgattcattccttatcttaacttaggtatgtgccagattttataaaaacatccaaaataacaatcatagaataaaaatgggtgtaaacatagactatttactcccagacctaagctagtgtgactgcttcagtgatgtgtattgaagacccaaatgagcagaccctctgtaaatgcacacttacagaacagatgaggccaaattaaagactaaattataccagtgtccctatattctaacacctgaaagttaaaaacataggaaacaaaggttataagccacataaagctcaagataggtctgcaacacacagttcaaaatgggtctacgttaccatctacgtcaaaatggctgaatgttctaaatgagattgtagtaggattccatttattttcttctaagctatttgaaaagaggtttaatcagttgtctgaaccattgccaattttgagctctgctctagaatctgaactgaaactctcaatcaacacatccttgactactatataatgaatgcaaagattcagatgaattttttaaaaatatcattatatttaatctaataaaatttaaactgtttagaatccatgttttttctaaagtaatttaatctgggattatttagaacaaaaactctgggattatttagaacaaaaaaaatcatgtttatgatttgagtcttccaaatcaaagccctgggaaacatatcatttcagtattaaaaggaatatcttgtgcaataatgaagactgaaagtctcctcaatctttgaaacctccttcggccttttcagagagccacatcaagcttatgcaacaacaatgatgaactcagattgcaaggctaaggaaacagcacacacgccccttactgctgacctggagacccacactgtgggcgggtcaggatgcaatgcacaccctgcagaacctgctgcaactccaattttgcgacatcagtatcacactcacacacagcacgtgccaggcgttacctttgttaaattgcttagcgctagatactgagaagacagctgcgacactctgtgcctaaagctcttgctggcagcttgtccttcccacagctgctgagctttctctttcagcctgttgagctgaggctcgtagcagtgtatttcctcaaggacagactgaaaagcacaagcaagttactattcagaggctggggaaaagcacatcgcggacgaagctttggcccagagaacatggaaatcaacactggcaggcagtccgtgtaccctggaggctttattatctccaatctacacaccgtggagcacaaatcatggaaggaaacaaatcatacttccaaggaaagtcagaaaacataaaatccaccagaaatggggaaaaacacactatgtctcacggcagcacagtctaactcaagggtgctgagcatgcatctgtaaggtcgacagaggacggacaaagactaggtcagatggggctacggggaggcgggctcatcacctggagcttctgctgctccctcctctttgctggcagatcatagaggcgattgctgctttcatggaccatcttctcagttttactcagccagtcctggataggctcagcacttacttcaaagtccttcatttggatctttagattctgcaaggttttagatagtgtccaggacaagaaaatattttaatagcaagtccaaggtccttcacttggcattcaaagtccacccaggctgggcacagtggctcacgcctgtaatcccagcactttgggtggccgaggtgagcagatagcttgagctcaggagttcaagaccagcctaggcaacatgatgagaccccgtctctactaaaatacaaaaaattagccagccatggtgggatgtgcctgtaatctcagctactcaggagtctgaggtaggagaattgcttgaatccaggaggcagaggttgcagtgaactgagatcatgccactgcactccagcctgggtgacagagggtgactctgtctcaaaaaaaaaaaaaaaaaaaaaaaaaattccacaaaaaaaaaaccaagcccgctccaaagtctgaaacactccatcttttaccttggcacaaacacaatttttgaatatcctttaagaactttttagggttctccttttgaaaatagaatttttcccccctaactctctggcccacttctgagatcacacccatttctcaacttctagagcatttgttgtctataccatgcctatatacttcatcatagactaggttggattgtgaattttcatctgacacaggtgtgccttgtctccagaactagactgcaagctccatgaggggagggcctgggtctgacacttccggagacacaccatagtaccttacaggaatgtaaagaaatgttagtcaacatttggttgattttcattaatgagggtacaagaagtagcatatccatgtagtttatgtgattatgttgttaataaataatttattctgatttatcaagtgataagaaatactaaataatgttatgtgcttatcacataagaatgtcataatactttcacagttactatgtagtaccctaggtgtaaaatgtgtttgataaagttttatatggtactgtctaactttagcaaaggtgtctgcatctactgtctcttacttataaagtggtaggtggacgtgaatgtgaatttgttatttatgttaccctgtgagtcaactaaaggctgtaaaaacaaccagtactttaggtagtattgtccaagagggagtacataaaggttagctgaagaatctaagtggcaagagctaatgaaacttatgagagaatagttcaaggttccacctgtatctggtctgggtcgtctacaatatggggaaaatcacatctgccttactcacctctgagggatatgggttagctgtaagaatcatttgaaaagttagtatctcacaaatgtaaaataccaaaataacttctggagtattctaccaaaatttaggttgcatgaaggcagggacttggttctgttttattctctgctatagccccagagcctagactagtccttcacaaatagaagatgctcaacaaatatttgttgaataattaaattcataaattcaaggtgtttccatcttcctgttactagagcctcatggggccacttgatatggtttggctgtgtccccccccaaatctcatcttgaattgtagttcccataatccccatgtgtcttgggagggacccaatgggaggtaattgaatcatgggggtggttacccccatgttgctgttctcatgatagtgagttctcatgagatctgacagttttataatggacttttcccgctttggctcatacttctccttcctgccaccatatgaagaaggatgtatttgcttccccttctgccatgattgtaaatttcctgaggcctccccagccctgcagaattgtgagtcaattcaacctctctcctttataaattacccagtcttgggtctgtccttataacatcgtgagaatgaactaatacaccacaaaacagggcaaatgggggaccatgatcaggaatttaggttctaaaaagaaaggagatgagaggggaggggaggagaggagaggggaaagggaggggaggagaggggagaggaggggagggcaaggggaagaggaaggcagagagagaggggaggggaagggggagggggaggagaggggaaggggttggggaagggacgggtagggagagagggaggggagaggaggggaagggaagggggaagggaggagaggggaggggaaggcagggaagggaaaggaaaggataagaaaggacaggaaaggacaggacaggacaggacaggaaaggaaaggaaaggaaaggaaaggaaaggaaaggaaaggaaaggaaaggaaaggaaaggaaaggaaaggaaaggacaggacaggacaggaaaggaaaggaaaggaaaggaaaggaaaagaagagaaaggaagggaaaaaggaaaggaaagaatcaagtaaaacagatagatacctattctgaggggaacagcagattaagaaaacaggcaattcatgacctactcacctactcttgggcatctcttgaactagataaccttgtaatcaatgctaaatatgctacactcagcagctgatgcttcagagctcagaccacatagcattaacgatccctgaaggattaaagaaacatttctaggcacaatggttatcactctgttaaatggaggatgctggccacgaaaaaacagtcaccattacaaaacagagatcaatggtcttggatcaggaaataattgaggaaatacacattttctcttactgaatattatttctctatcattatctttttccaaccttcattaataatggtcacaaacaaatgaaggatctattctgccaaaaagtgttttaaaaggaaaagataccctctatgcctctaaattttcctctgaaagaagagtcgatacataaaatagatagtctcagacggaaaaaaaataattatattgtggcagtaattattttatggttataatagattcatcttctattgtgtgtggagaaaataaaattatataaacattgtttctgcatacttaatgcctaaaaacctactacctggtatttgcattagttataatatacactctcatctgcagcattttgcagcttatgtagatattcctgatcattctcctagaccaccttccagaaatgagacagttcacatgaaaggctaagtgttctgctgaaatgtaaaactggctgttcctgctgggagagtgcaaggccaagtcagtgacaatagaccctaacatgcaggaagctacttaattcttcagggaggctcccacttctagcattgggctattccttactgttagcccattgtcttcttatgttctgagaggggtaaccaaaatcattgacaagggggctttgatatacagaaactgtgatttcactaacaacaacaacaataacaaataacacagaatgcttccatgtggttggctatatatacctctagagcagattctttttggtggagatttgaatgaaaatttttccaatcttcttttgcagctgtaactttggcctggatccctttcgctttctctttggtcagcagggtactcagaagttcccctttagacagcatcatgtttagcttgtgctgtccattttcactttctgacaaaaactcctataaaagaaaatatagaattagccataatgaaaatattgtgtgttgtttctattttttcttttcttttttttttttgagatggagtctcactctgtcactcaggctggagtgcagtagtgcgatctcggctcactgcagcctccgtcttctgcgttcaagcaattctcctgcctcagcctcccaagtagctgggactacaggtgcatgctgccacacccagataatttttttgtatttttagtaaagacggggtttcaccatgttggccaggatggtcttgatctcctgaccttgtgatctgcccaccttggcatcccaaagtgctgggattacaggcgtgagccaccacacccaccttctattatttcttaataaagtcaaagaaaaggaagtaagctctttttactgtatacgttaaatgacccaggttatcctttaatagtcaagttgcaaactactttatttaccaatctaaattctgacttgtctcaaaaaggtggtgagcaatctcataaaatattaaaaatttgataaaaataatcaggagaagaaatgaagaccaagggaagataagagctgtaaaataaaataaactctggctaagactcgtttacaaaacaaatgccttgtagttccatatagttggtggagctggattatgattttggctctgaggatcctagctgccgaagtgaaagagtaaacacaaccagggacaagactcgcagagcctactggataaaaacacataatctgctcagcagaagcacaattctccctaggaaaagacagcagatgaatttccgtggggaatcttattcaaataaatgctattaaatggagcagattacattattagtagcagcttatataaaaaaataacaagagagtgtttcatagggttgtccttatgaggacaagtcaatgacctagtgccaaagtgtagtttaataaagtgtagctacagtatatacttttcctttcatgtggctagagctcaaagaatagtcttcctctagaaaaatgggtagattctgtattctacagtcgattctcaatattttcaagtgctaaagaagaaattgaaagcacaagctcaaagttatttattctgacaagaaacagaagcatagatattttgtcatagattttgattaaagaaactttgccaggacatttgtcttaatggatggccatccctgtccatggaggcatgctgtggtgggagggtcagagaaaaggccaaaggctatcctctaaaacagtactagccatgtgtggtggctcatgcctgtaatcccagcactttgagaggccgaggcgggcacatcagttgagcccaggacttcgagaccagcctgagcaacatggtgaaaccccttctctaccaaaaatacaaaagttagctgggcgtgttgacgcatgtctgtaatcccagatactcaggaggctgaggcaggaggattgcttgaacgtgggaggcagaggttgcagtgaaccaagatagggccactggactccagcctgggtgacagagtaaacacttttctcaaaaataaataaataaataaataaataaaaagaaaagaaaaatagcactgtgtttctccaatatagaaaaataggtgattgagtttctgcagttctacccaccagcctgaagcaaaacgggaagaattttacattttatttttagtttattattttattttattttattttattttattatttttgagacagagtcttgctctatagcccaggctggagtgcagtggcgcaatcttggctcactgcaatctctgcctcctgggttcaggcaattctcctgtctcagcctcccaagtagataggattacgggcgcctgccaccacgcttggctaatttttgtattttattagtagagacagggtttctccatgttggccaggctggtctcaaactcctgatcttaagtgatccacccactgtggcctcctaaagtgctgggattataggtgtgagccgccgcgcctggcttggaagaattttaaatggagcaaattttcacaggcagagttgtcctgttatattaagttattaaccaagaatttaaaaaggtgaactacatatgaacaatactgtttcagagtctgctcctactagagacacttcaagcacgagtgcttacacacagtgttctacatacctgtgccctctgaaagaaactcaaatttcataaccaatcactcagaactgctgctatgtgaaatgagcggacatacaggtacgaaaagcaatttcaataactgtgcttaaaaagtgctgctattgaatgaaggtggtatgtgaattagcaccatgaagttacagttaggttaaaaaaaaagactagaaaaataaacccaaatgaacaaacataaaatataaccgcagctctggctatcttaacacaccagctctgtgacctcactgacgcttttaccctattgtacactgacagtaacaaatttacatacctgaaatggttgttgtgaaaattaaatgagaaaatccacttaaagtgctcaggaacaatgcttgtcacatagaaaaaacgttttattatttcctggatcaccattaatatataaaaatagtgtgcatttatataaatgaactggttcctcttcatatacagaagcaattgttttaagtggggatttatttgaaatttgaatttcttacgcaaaacttttatatgttctgcccttctgaaaagatctagagaagcggtccccaacctttttggcaccagggagtggtttcagggaagacaatttttccacagatggggtggggcaggggggatggtttcgggatgaaactgttctacctcagatcatcaggcattagttagattcttagaaggagcacacagcctagttcctctgtgtgcacagttcacaatggggttcaggctcctatgagaatctgatgctaccgctgatctgacaggaggtggagctcaggcagtaacgctcattggcctgctgctcacctcctgctgtgcggcctggttcctaacaggccagggacctgtaccagtccgcggcccaggagatggggacccttgatttagaggttaactttagttcacatcagcactgctactagaattaattgataacacccttacctgtattttctgaagactagttgaaacttcacttatattttgaggtatatcaaaacacttggcggtagtgatttttgcattaaccaaccactgctggaaatccctgaaggcctttcgaaatctttgctgtaaaatctgttctttattctggcagcccttggatgcttgcaaacaaagactgaaaaggtgacgcaaaaatttaatggcaggaaaaagcgataaagttgatgaaaatcatgtttgatagaatcaccagttcttagaatgtgcacttacctcacttagtaatatatttaatgctgaactaatattattttgaaattacaccttaaaataaacttctagcttctaatttgtataaaaatatcttgaacaccaataaggttcatgctcaccaattatactctttaatcaagccagaaacttttccactgtaggtactcaggtctctggaaaatcgacaaagttcattcagctgagacttgagatcctctgttctaggctctgctttttgcaaagcatccagtatctcctgttcagaaataatgagacaaagaagcgagcacttacattgggtgatctccatatcttcacactatacatgcatcaatcatattataaattattagtgagagaagaaccaacatggtagattcaatgaagaaatgaagcctgttttcaggattcctctgacaaataatagcacctggctcatttgtcccttttttcttgccatggatagacactctagcatcaaatactgcaaagtagttaagtgattaagtggtgaaatgacttaaaaataagacaagaaaaagaaaaaatagcctacattgtctataaatagttggactaggccatcaggagatatgtatattgtttaaaggtgaaaacaaattattttaaagaaaagcaacacttattttggattaaatatatatattaagggccgggtgtggtggctcacgcctgtaattccagcactttgggaggccgaggagggtggatcacctgaggtcaggagttcgagaccagcctgaccaacatggtgaaccccatctctactgaaaatacaaaaattagccagttgtggtggtgggcgcctgtaatcccagctacttgggaggctgaggcaggagaatccctagaacctgggaggtggaggttgcagtgagccgagatcgtgccattgcactccagcctgggggacagaacgaaactccgtcttaaaaaaaaaaaaaaaaaaaaaaaaaaaaaaaaatatatatatatatatatatatatatatatatctccaaaattgaatcctgtttcaattgattttatgttgtatatacagttaacttttacattaaaaatttcttataatccatgagtctggtttaaatagtaattcatttatttcatagtttcattcataaagtcatcaaatatttgctaaatgtttaccgtgtgccaagcattttgctggattctgggacccaagtccccccacgaataaaggtaagattcttgttcttgaagagctcacaatttaatagatgagggagacacatgaatagctacattactgtgtacacccaatccaaaataaagccttaggacttgaaaagtacacctctgaaatcgaggccatggtcatctgagttacacaaggtgctttgcactcagagtgttcctctcataggattgtcacaaggaacaaatgaaatcatgaatgtcaaatacttagcacagttcctagcacactaagtgtctaattcataaaatcagaaggagaatgactcccaaatatgtaaacactgtggataacagtagcactgaagcaaaaaaacaaaataaattaaggaggaggggcaaaaagatgagtaactactcaaatagctttgctgtgaccattattgtctgatatttgtcaagagatggcccagatttgtaaagaaaccacatccctcaacaaaccagccctgtgcttcattcctcgtcctggtaaatggcaccactgtcccccgctgatgtcaatcagaagattaagcatcatccgggcctctccctttgtttcctttctcactctatgcaagagatatccaggctagcttattctgtgtcttagctcctttcatcattcccctctttgcctctgcacgttgactttcacagacccacttacatattcattatttcttttgggggtggcactacatcctcctaatctgattcctcctctctaggttcctctcttgtgttttctgattcctcaatgatcctgcatcttgatgctgttcctctacctcacctgtcaggtcacattttaattatacctcaagactcaactcaaataacaactcctttaagtaccccctgccctccttcccacctcttcgggtttctcatctgaggatacacaggaccttgcagacattcatcacaaggagtatccacattggctttatgcttgcgtatctccccacctaggctgtgattatgagagcaggaatgacattctcttggtttgtcaattctttatttaactcggtgtctgggctggaggagtctaagacatttttatttacaaaaattcatcaacaactaaacaatttctctctgaaattccaaacactaaactaggaccaactattttacaccatatggaaccttttacttaagacagaacattgtaagaactaaagaaacttagcattcaacaaaaacataaaaatactggagattcaagtcagttacttatgaatgggatgacattaaaagtgaaaagtttttgaccaaaacgttacatttaaaacatttctataacttcatcctaaagtatgtcagtagagtcaatatataaatatcagcttatgtatttctgattctgttaagttctagaatgcatctttccaccttatacagcttaagaaaattatttccaaagctaatatcccaaaggatattaagataaatgagtttcgcaaacatagtaaatagaattatttttacaatattatattatatactttatagatcatctgtttttatgttttaaagaatttcttgagtattgtcatctaattgcataaaataaatactttaattcttattgtgatcatcaacaatgacaagtcctccctaaaagcaaaacaatgccctaagaaccctagcatatttactattttgttaacattttcttacatattcattgtgatagaaatatctccacttttagataaaatgccattattagaaataaaagaaaacatgaatattgagaagcaatgtagcattgtcatcaaaagcattgaccctggagtcaaatctggaagcagacatacacagagggctgtcacatttgaactatttaacacaactgaaaacccatatttactactgcattctcatgtatatttttataggcctcaaccattatttttactaataatatcaacgtaaaaataatgaacagaatagtaatgtaatctaggcacagccaaatctttcctttttaaaaatttcactctgtgactggaatagaaagaaagggaaagaaaaaggaaccaagaaagtgtaactgattttttcatattataccatgtagagcaattatcaacttctttgtccctctgtgacagaactgatttctatgctttattctggtacataaatctaaaggacaggaaatggaacagaataacaaaaacaaacccccaaacctagaatcattataaatagagtagcataaagaggtagaaagctttattttatggcatgctgcatttgtttcaaatacttgatttaaaaccagacactgctggaaatactacatgactttcttactggcaggagctattttgaaatgattgtaatataaataggagcagagaagtttactaaatttccttttaaggacatccatgaatcagggcattataaaactggaaatattgaaaaggctttcaaagatactgtttaacagtgaaagaaacgaagaagaggttacactcttgctcattcttcggtctcccttgtaggcttccctttctcacattctaaagaagctgccattagcttcaaaaaaaaaaaaaaagtctcgggaaggtgaccagggagggtgacgtagagttctgttaacaggctaattcaagaacagctgtcaaaaccacacagaggagagctaatcggggagataactatttgctgtgctgtaggagattaccaagtgagtcttttaaggctataaattcaatcatttagttgtatgaaatagttaactggcaagaaaacagctatgactctctgtctatttatgcccctgcccacaggccatttttcagactgaatggctgaatacagtattacagactcttacaccataggaatgaaagtaaaatgtctccactaacaacaaatgtttcctaccgcaaataataacccaaatctttatttttacaaaagtttgatatataagaaaaggaaacaaatcagactttgcttatttaatgagataaatacttcttccaagtgtgcatgttgcgtgtttttagttagcaagattttttttttaaggaatgatgaaagtcaaaacattttttaaagcataaccaccaatagaaaacaggaagccaacttacttgtcctttgtgccagcattccactatctcctcatccgtgttcttgccttccaggagggttaactgctgagcccaggttttcagaagggcactgaactgttccagggcctgctccagttgagccacttggcctgagaattcctgctccgaaagggccatctggctgaccaggttctccaaacagctctgcgtttggaatacactgtcttcccactgcttccagtcggcacgcagggcctgcatctccgtgtgcatgagctcacacccactggcagttgtgttctgtttcacttcgggagccagcgactccactctgctgagacggcttgcaccaatctctctggaatctatcagctcctgtaatggaatatcaccatggtaactgaagagcctgtgagtcacttggactgcaagttttcaactgtgtacacagggggaccctgtcctgccaggaagttttaacaagtgtgccacaaggacccagaatcaattcatctgtccactcttaaattataatagcgggagttgtcatcacgagtgcctaaggcttatggcaaaaaaatcccgagaatcctcaatatcctgaaacagactaaacagagaccctgaaatcaggcattattcgcacacgtgaaaatgtttagtgactcaagtgtttgcctgtggtggattgctcctgtgaatgattaaacccatatttccctcaaagtggatgctcaagtaaataaagatcgtggcagaactgtgttctgctcacggtctctatactcaattcatcttcttcaacagggtggtggcttaaatcacacttccattctactaggaatcaagcagactcatcacagcaaaagaatgagccctactcgattccaaatacctcaatactaagtaaacatttttgtagcatataaaatgaataattcattcatagactgacttactcaaaagtttaaagtaacctctagactgagtacatttattagtatttttttaccttaaaaaagtcactagaaatttaacagtttagctatagccaagttaacaatttagctcgatcttaaagcacacaaatactgtaaaggaaaacaagataaaattaaatcacattgttaaattgatataattgcagcatttctgagaatagattctcttactaaaatttttcttggtgaaataatcatccgatgtttatatatttacatatctattgctaaaggcaggattttgttaatattattacaaaattatgactttactaccggattaaatagaaataaaagataatcaggcacaaaaatgttcaagaagaaaatcaatgaccaattagcaagtaaagaaacattggaatgttaagtatgaagcatgcttaataaattatgttaagcataaagtatgtcttaactagtctatataatatagtttgcatctcattaaattaacttgaaataaatatatctgttcataattatatacaatagagccatattttaatatagatcatttgaaagtatttagtattcagttgtgcagtagtctaaattacaatgacatgaaaacccttacacacagcatgatatgtatattcaaccttctcagcagcaggattctaaaaaccatcactgtttattagtgtgtatagtagttatttgatgaagaaaaaaatctaactttttaaccagtgctatgtctaactaatagaccttaatacttgtaattattttgcctttgtgagcaatttcaaatttgaagtttcccaaaatactctcttatgctttatcccaattttccttagcatgaaaatggaacacttcaatatttgcaatcagaaatctagtcattcagaatttgaataaggacatcatcattgtcaagagttttgaaatggcttttgcatatattttcttatcttgtatttacatttttaaacatatgatatacacatacacacatatgtacattcccgccctcacacccatatacattttgctttagagttgccttttctcagtgattattcctgtggatgtgataggtatggtgttgaaggacagaggaggtgctttatgtatttcctccaaggtttttaaaaccacccacacactaacctacattcaggctggacctgaacttctgagaggcagtttctgatagtcttcactttctccatcccaatttctttctgccaattccttctcccatattccttgtctttatggaagcactttataaaggctttctcaataaaaaagagtatttgtcaacccaggaagcagcctttgtgaaagaattatcttactttctcttatttattaactttttgaaacattagtccatttctgctatctcctcttcctcacttgccatttactcctaaatccatgtaacctggtttctcaccttcccttgctgtgcaaatgtttctcagactggttgcccaacagcctcattgtcaaacctagttgggattctttagtattcctcctaatggcagcctcctgctgtacctgtgatggcgaccaccttctctacttagagcctcagtggcatcacaccctcctactcttccccttcttgtttttcccctcctttttctctctacctttcaaatcattttctcctatggctcattaaatattggtagtacccagcttttggtcctgtgcccattgttctatttgctctatacataggtcttggttttatctgttttagtggctttaacaacaaattagacactaatcactttcaactccatgtcttctatccgtcttcttaacctgaaattcagtcttgaatttacaactgcccccaagacattactactacctggcagttcaaactggatctgatcatcaatgaacagctcatgtcttcacctctatcaccaggctcctccgcatgcaattattttcctcaggtggtaatagtcctgtggattctaggcaaagacttgaccatcatccttgactcttcccaccttgtcatgctatagcccattaatcaatcatttaccaaatccactggattttcttattgggtgtgttctatgtgccaggcatgatgctacaggttttatgtgtatgatctaatttgcttgtcaaaacaactttatcagacaggtactattttcatgtatgtattttttaaccaattgagaggtggaggcttgaggacatcaggtaacttgctgacagacacggctagaaagccaatagaaggaggatgtggcattgggtttctttgattccagagcctgaactctaatagtacagtaagctctcattacattttttgtattattttataaagaccagtttgtggatcgctgttcctcactagactgcaagttccttagggaatgcacagtcctggctgaataaatggatagatgggtagatggatagatggaaggatggatgaataaatcagaatattacgaagaaatgtatcaaagaagaattttaaagaataacacacaaaaaaaggacttaaaaagtggttttatgtgattatctcagttaaaacatacatagtcataagatttaaataagataatacttttaaagcacttagaagcagatcttcagggaccgggcaccatggctcatgcctgtaattccagcactttgggaggccaaggcaggctgatcacctgaggtcaggagtttgagatcagcctggccaacatggtgaagccccgtctctactaaaataaatacaaaagttagccagacgtggtggtcagcacctgtaatcgcagctactcgggaggctgaggcagggagaatcacttgaacccaggaggcagaggttgcagtgagccaagatcgtgccactgcactccagcctgggtgacagagcaagactccatttcaaaaaaaaaaaaaaatagatctgcaaaatgtggttacaattgtaaccatcagctataatttttatgacttttatgttctgatcttggaatcaaaacacaatctgagttttaaattcctggccacaattacactatttattcctaacatttcctcctctaaaactaaaccactgaggatttcattgctccttcattttaatgttaaaatccattttccatgggggaaaatgattacaatttaatatttaagcaactagaaatttactaaaagataccagagtctgaaactcccccagaaaggtaaatttctgttttagaaattgtccttatgcagagtaaacgagatgataattttaaggtcctttgaagtactcccttctattatgttgttggatgtcgtctagaaaagcagaacaaaacatccagaatgacattttcaggttattgttagaatacatttaactaagttactatataaacttttcttctatggtgctaaacaatagtatctggttttgtcagcccaccaaattagccatttcctagcctgtcatattacggcaacaagcacatttgcatacagaaatgtaaagacaatgttacattgtgctcataagtgtaaagtcttttgaattcttctcatgactcttgtttatgtgtagaatcagtgaggcatcaaatagaaaacaggaaggaaacattttaaataacagaatcttatctacaaaatctttatcaaaagtactcaagaaggaatgaagcaatgtagatatagcatctgttcatttcctgaccttaatttttgataactttttctgggtggctgatgaatctccagacatatctgaccaccggtgaagttcttcctttgctgaatggagccaatctgtgaactcgtggaccgcatctaaatacattagatgatctttcacaatctcttccactttcctcattttttcctagtaaacaaagaaaagactaccttaacagtggtccttttgagaacatgaactcaggtaagacaacaggcctgatagaggtctcttaacacatctcagaaaatttcattcttgttcttgaattttctctgagtttaatatcttaagaagaaactatcaaatttaactaaatgtcaaggctttggaaaagcaactattttcctgtaagtttactattttctaccttagtatggaaatcatgcttaattcatgttggctaacatccctcactaaaaatcctcttaataattattatcataaccattctaattaaagcaattatttgttagcttggtgtacagcagtctgttcagcactttaaatgcatttggtcatttaatcttcataacagtcctgtgaggaagatactattattattattatcttataggaaaagacactcaagcttagagaggttaggtaatgggtaattgtggccagtcacacattcaaaagtgtcaaagccagaattcaaacttaacgtctttttgacttgagtcatagctcttaatcattaacaagatgaaaacgaagataaacaagcacatctattaataatcataatgtcaagaagaaaagagtcagttcccaagaaggcaaaccaaagaaaagaaaaagcagcaaacaacaacaactctctcccttaatttctataatatttacaaatatgccaaagaataatcatgaaggaaatgaaagattcatatagagaattggaaagatatttttgatattatataaaggagtttatactttggaaaatagaaaccgtttttactaagatgagagatgaacacaatatttcgtacacgactgaatcttgacggtaaatagacttgcatttaatataacaaatataagtgtagcaaaagaaaaacaactttaacggcgacatttgatgtgcaaagtagagagattaactaaaaaagcggagaaagagaaaaataagcaataaagaataatcccaagattgtagaaagagaaaaatgaataggcattcatagtaagaaatgatctttatgtcatacccatttactgaatgtacaaatagttttagagcagccaattctccaacaatttaatccacagtttcttctttacctgaccttggcaacagtcattatattattaatataaatcaatatattgtattaatgtattataaagcatctactttcaatataaagcactaaccttggcaacagtcattatatcattaaactgtgttttcagctcctcttgagctgtgtccttgaaagactcatcctctgtcttttcgtagagctccctggacttcgcaattagacggtgaagggctctcgtgtgatcttctgcctcagacaggatggactggaggtggtcaagcaggacgaacttctctttcagacctggctgtggttgtaagggatgttctattttttgatccactgattccatccactgctccaactggtttttcctctctacatagtcattccattggctaatcacagactctaaagtgctagaattaatgtcacatattaacaaaaatgaattattttgacatctctactgaaaaccaatcacaaagtcgtgacatccatgccaattgttttattgaatgctactggaagtgatgaaaatgttgcttttgagtgcagggagaaacactacttctctgatccataagatccttaccacaggtcctttgaacaaagtcaatctatattaaaacatgaaataagaagttgtggtcatacatgcatctggaatttgtcttccaaatgctaactattctaaatgagcaatatacatttatatgttatgttgtttaaaatcagcatgggaacatcaatgaaattttatttcatatagatcagttcttaattttcttggaattatcaatagtttatcttattaaaatcagatggtgattatttgttgactggaattcaaaattcaaggtatccttcctgagtaaatgatctatcattaggttgattttcatttggggacacacacacacacacaatatacagtgcttttgtgtcgaatgtgtgaatgaatgctcaagtatttataagaaaaatagtcacaaatataatagctttctccatagtcaaaccaaacgctctccagactggcatttaagaaaaatccctccattattaagcattacaaactattctaaactcatctgcagtgatttccccagctccccctgcatacaagcctatgagtctgaaattaaaatcctgtggtaaatgaacttccagtatttgctcaaactgttgcttttgcatctttgcatccattgatccattggaacctcatcatgcaggctttacagtcctacctgttcctcaaataattttctaaaaagcaccccccgccttttttttttttgacagggtcttactctgtcaccaaggctgtagtgctgtggtgcaatcatatagctcattgcaatctctgtgtcctctgatcaggtgatcctcccacctcagcctcccgagtagctgggactgcaagtgtgtgccaccacgcctggctaatttttatattttgtttctctttctttgaattttgactgtgacttcagataatttttgcatattttgtagaggcatagttttgccccgttgcccagagtagtttcaaactcctaggcttaagcaatctgcctaacttggcctcccaaagtgctgggattacaggcatgagccaagactctgcattcttctacaactccacaatgtgttttgaaaatggttagtaacatagtctgagtcagagtattccaaaatacatcctgtgctggtgtctgagcttttagagggcaaaaacctttctgttttatttcattattttaatgcaataatttgaacattgctatcactcaatatgtcactgtcaaatttaatttcttgctgaaatagtggagtcaaggaccagagtctgcttcctgcatgtaacatcttattctaacatctgaaaaatatctacccatattcctatgaagttttaggaaactggcctaagccaagcctctggaagcttagttcacgctccagcagtctatgatatagagtaagacaatgatagcatctgattttttttctttgctgaccattgtgagttattactaagatgcaaaatcctgctgactttgagagtcactgcctatgctccatattaaatgaaaaaacaacaataataacaacaacaaaaaaaccctccaaattgttagttgtaaccagggatttttgttcacattgccgtggataactgtagtgttatttttgttttgctttgtaatgaacttgaattttctttaaatatttttaaaattttattgtaggttcaaaggtacgtgtgcagagttgctgtataggtaaactcgtgtcatgggggtttgctgcccagatttatttcattgcccatgtactaagcctagcatatgacagttatttttgctgctcctctccctcctcccaccttccaccctcaaggaggcaccagtgtctgttatccccttctttgtatgaactttaatcttctattcatctattttgttatgatcacattgggcacccagtgtgtcaatgatctaacaggatatataaccatcagaatatggctcttttttactgtaattcagactgatggtcatttgtccaacaaatgagccagattatttatggatactctgagaagagggaggtagggagaaatctctcacttataattacaacaaaaacactacctggtataacaatcaaggacttccctgcttcctcatcaacatctggtacagatgattttcaacagaggctctacggctgggctctattctggatggactgactcttggttgtgggagaatgttccacactttgtaggatatgagctctctgtgcctcagtcactaaatgccagggatattccctcgtcactgtgacaatcaaaaccatcctacacatttcctataatgcaaatgggcgtagtatgacttctagttgaggaatagatttacgactaagctcaacagctgccaatagcttaattttccatatgttccttaagctaaaatgtattcaagttattaaagaaccatatattcttgcttggatggcttgaaaggagatgttttgctgagcccatgtcacataagattccagaagagataataggtagatttaaatatttaaaaaatgcaagtaagaacacagaaacaaagcaataacaagcaaaaaccagtcatcgccctatggaaaacacaacttagacaaagacaggcatgcctacaagctacagtaaaatgcttgggaattccaccccaggagacctcagtactgctccatcattttactaagtcactgcattggacttaaacaaactctaaaaataggttctgtacctttgagcgtggacggaggagctcatgatgtcagcccacacttctttaagggtctctaactgagtctgaatcaccctctgaccttctttgttgctacttctcaaggcctgttcccccttgccaatggccatattcaacttaacttccccttcacctttcatcaggagaatatcctgggaaggaagaaagaatactcatcagtaggcatgtaaaaaccttcttctattttaaaaaaatggtagttttccataagaattgaagtaggaatactttacttaccttaaaatgaaaacaacaaactctgggccctattgcaatataatattgactcaaaattaggtatctgggagtctaggagtcaaagattaattccaatataaattcttagaaaactaggaccactagcctagaaagtataattttattgacttcagtttcaaagagtgaaaatacattcttttgaaaatgaagacacatctgtctaaaacccagcagtcccctacattaattggctggctaatttctctctttcaaggtcagcttcattggctatagtctgggttggtgatctcctctgagctttcaatatacccttgatggctttaatcatggcccctacacacggactgtattgaaagtaacaatttacagattggtgtcttccctagactgtgaactcctagaaaatgggtcctaacttttatctctatattcccagcaacttgcagagtgcttggagcagagtagatattcagtaacgcttgctgaatatttactaaatcaaatttaaaattatttaaagctattaaaataacattttcctcttacaaaggggaaaaatgatgcctctgtatccttttttgcccaatttctccattttgcccacacaatcctcatttagaggcttacagaacaattaggacacaacacaagcacttgtgaatctaatcaaattagcattcagcagttgtcagtgtctggctggtgtcgcatgtacctgtatttgtgacagccgtttctccagggtgtctttgctcccaagagtgctctctgcacaggccagtctgtcctgaatggccttcacccagaaccacatgctttgcagtgcttcctccagggcttcgtgctcctgaagggccacctggcagctccggagtttctctttggtcattctaagtaggttctggtggcttgtgaggagctgggaacacaggcggccctcctgcccagcaccgtggccttcttcactcagaagctgccctctctgggaaagcttatcaagagactctctgaaaaaaaggaaaaaaaaaaaaaagaaaaaaaattaattctgacatcctggagtgcaggggagtgacaaatgattgttgatattggagcagtaaccagacacaggctcatagctgacatgccttttaaataaagatgctgggaactgacctggttatttcattctcttatgatctctcctaatgttgtcagtacctatcaggggataacattcagtctgtgctgtgcctgcatccaaatagcagtggtggagcctactgtattacttactgtatttccagaaatttaattcagaaaatggtcccagctgcctcttcaggcttctccgtagcatctctgcattcctatttaatggtcagatgaggaaaagctccctgaaattctcaaaacccctgctgtcttgtatctacatggagattcctcctttatgaaaacccttctgctcagcactgttgcattcctagttgcctgttcaaagctcggcgcaggcatcacatccccaggagcatccacaccaattcagggtgggtggggattgtgggacctctttgtgccctctgctccttgtcttgctctatcgccatgtatgccgactatctcaatccaaaagcctttcactttctaaaagctagggccattatattcatcttatgttcccaagacccaacacaatattgtgcagagactaagtgcaaaaaaaaaatgttctttcgaaaagctgttgtaggagcacttatgagctttcttgttatatcttgtgtattgagctcatcttagtttggagccatgttaattagatcaaggggaaaacgtaagcactatgtggcttggttggttttattcccattttatagagttctgaattcttatctgcacatttaccaggaaaaagcccaggatatcagagggtagcatgggatgtcttaacataaactattgtgactactagaaaaagaacacaaagcaaatctctcgtggaaactgaatgtttcaaatttttttggagtggctgttatgcaaatatatcctatgggccaccctgagatctgctaagagttatacaacaagacacctactctgtaacaaacttgcacatcctgcacatgtgccctggaacttataaaataaaataaaataaaaacacctactctaaaagacatttattatacttgttatctgtttggtgagacaagaaggtggcttaagcaatgatttgagttaaataataattcaagaaaagagatttcccttcttactatgagataaattgcttaatgcatgataaaaattcaatgagtcttaagctgaggtacttttatatagggcatttccttaaaatatttcaagtagtgaaatattatggtgaaaagaaatctagaagactgggaggagcaagcagcaagccagtgagagaagtcaggtggccccgtggagaacctgaatgagcagaacagtgtgttaggattgtctgcagaagtggccaggatggagagaaagcacccagaaacaagcacactaagatctcttagcatctggtcctggaatatcagactgaaactgcaagaaggattgcatgcttatcaatgcgaaaaagtcgcaattattagaaaaacaatgaggaacataaaagaccttgaatttggtgttgaagtatatttgggccactttctctaacgcagttttggtgtaatgatggcaggagaagcagatacagaggaaggtaatgagcagcctgtagagacgaaataaaagctgagactatggaaaaccatttaaaacatctggaagaagggaagtaggtctgggtgtgttatattgtatctagacacgagtcaacatttaaaaagcaaaatttaagtgcaatgtagttttcagaaagttatatggttgcaatgatgctagtattctgttaattcagcaaacattttctattttctggcactatactagataatgaacagaaatgatatagatcttaagtcactgatcttgagaaactcatagctggaaattggggttcatagagtaaatgaagagcttacactatagtaagggctcatagagatgttccaatgtatttcagggacaatttatagcagtcatcaaactagcataccaacaagtagttatcagcatgggttcttttgtgcatttgtttgtatgtttgtttttcaagacaaggaatactgggcatgtttgactaaaaagaggactcagtggaaacagaaaatgactatgatctgaattctggaatttctttttttatttttattttactttaagttctgggatacatgtgcagaatgtgcaggtttgttacataggtatacaagtgccatggtggtttgctgcacccatcaacctgtcatctacattaggtatttctcttaatgctatccttcccctaagcccccatcccctgacaggtcccgttgtgtgatgttcccctccctgtgtccatgtgttctcattgtttaactcccacttatgagtgagaacatgcggtgtttggttttctgttcctgtattagtttgctgagaatgatggtttccagcttcatctatgtccctgcaaaggacatgaaactcatcctttttatggctgcatagtattccatggtgtatttgtgccacattttctttatccagtctatcactgatgggcatttgggttggttccaagtctttgctattgtgaacagtgctgcagtaaacatacatgtgcatgtgtctttatagtagaatgatttctaatatgattgtttctgacttatttgataaagtagagtgggtgctatcctcttctgcttcttatgtagatgcactggctctttaagaggacaggtaatgagcccaaggagccaaagccaagctgcacttccctgtggaaagtatcctatcttccaaaggagagcaagcaaatgaaaatgccaggggtggagcacaaatttgggagcaaagccctcaatgtagggtcaaaagcacagatcagggaactttgcctgggaaaggagccagaaacgttttctcagtgggaagcaatgaagaaataaatactgtagttgggaacagggaccacaaagaaagtcagacttgaccataccttttactttattaagattacaaggatgggtgggtgggaaatggaactggaagctgaaatgtgtgaataacatatggaaattgacatatacagtactcttttttttttctttttcctttttttttttttttgagatggagtctcactctgtcacccaggctggagtgcagtggcatgatctcggctcactgcaacctttgcctcccggattcaagcaattctgcctcagcctcccgggtagctggaattacaggtgccctccaccacgcccagctaatttttgtatttttagtagagacagggtttcaccatgttggccaggctggtctcgaacttctgacctcaggtgatctgcctgcctcggcctcccaaagtgctgggattataggcgtgagccaccgcacctggcaagcactctttttttcttttttttatctttacagtcactgtgaatttgtggttttctttccttcatatcagcttcacattatgttaattgatcctcaaaataacctcagagaggaaagtacagtattattaacacaatgtttaaaggctaaaatcaagagcaacaggagataagtgacctgcccaatttcttgaacaaacaggaggtggatctggaatgcagatgagcttcttacttccatcctgcactctcaccagaatactgcactgctgcaaagagtgcagcatagtcctctgtattccagacattcaaggacagcacaaaccactacccacaaaccaactaactaaccaatcaaaaccaaaccaaccaaccaaccaactagtctaaaacatggtaagaggtaaaggacctgttccatttctggaccataccttgcagccagcagttctcccaaaaacatttcaactttatgaacttcatttttcttctcaggaatgtgctgtttactctctcccaagttttccgtattgaacctttcttccatttcatggatccataagttcagttttctgtgctgatcttcaaagctaagggaaagaaaatgccttagagaaattcttacatgcttgttatgataaattacttttaatagctgaggtcacaatgtcttttaaatggcaattaagacctcatgaatgttcaagtgacaaaaacaaaacaaaacttaacaactaacccacccaaattatcacttattttaataacaaagtgaaaatcatgacaatttcttttgagatccaagcaggaaaagaatcatctcacctagctgaactgatttcatagctggtaattgccaacaagatcacattcccacgtcaatgagcacttaattttgtgtcttactacgaagacccctgaattggggccaatggatatgaattgatttcatagctggtaattgccaacaagattacattctcatgtcaatgtgcactttaattttgtgacttactacaaagacccttgagttggggccagtgaataagtagggcagtggagtccctgggaagagaagggaaagtggcctctgtgtctttgtttcttaagggattttcaaatatatctcaagagctctaagttttggaaacaatgtaagctctccaagaaagctgggcaagagtcaggcaaattattctgccatcagaaagacaatttgattctactgacatcttttctcaccctagtcataggtggctctttctccccttctaatcgtatattcaccatatattacttattggaatctagatccacagaattcaatcattgttttctgctatgactctatcccaaatgaagtggatacaaggaaaaaccttgtataatctaaaaattgaggtgtcagaactttatatattggtgaaccaaataaaaattatatgcatttatataattttcagttactagtaaatatagtttgttttctctatattaaaaaaagccaagtcataacttcagagtccgaaaaattgattattgccctagtatcacctgtatttatgatcaaagcttattataatttaaactcacagtgtcaaacgttatttatttattcacatgactcttttctctaagcctttaaaaacacacttggtgtatgatgaaatctatgtttgttaaactaacctaccttccaagttctgaagcacagtcttgaagagcctgcttatctttaaggcattgtttcagaaatgcttgaaactcttcattggcctttgtgatttgttcttgaatgctactgacaatttgtttagacaaatgtgcatacaaagtttgtccttcttgagtcactgcatcaagtttgctctgcccatcactgactgagtccaaaatgttctgtttcaggaaataaaggtaataggtccatgggactatgcattacaattgtgagctgaagtagtaaagcaggagaagaaaaacagagtccaaaggaaaatggcttaacaaggctggagtaaaaatgatgcatacaattgggcacaaccaaggctcctcattgagaatggtgtcagccagccactggaaccactgaggacaaagtgtaaacaaggctgagctggaaccgaggacgttctcaccaaggtcttgttctcagtctctccccattctcactgtcccaacatggtccaggtccaccatctctcagggttcatgtgagatcctctacctggttagctgcctccagcccctcccctgatccaccctgcatgcgaaatcctcaggccctttcttttcctggtctgcatctctttcttggaaaatctatgcttggacagggctttgacaaagcaaaagaattccagagtccaggcctagccctgcctctccccagagctctagagtggtatgtcacctgttactcaggcatttccttgtggcgtttgctacacctcaagcttaaaaggagacaattctacatctgaattctccacacctcctgcaaaaccagcttcctttactataacgatctttctatcgttaacttctaatctaatgaattttcaacatcatttttatcccccattaggccacaaaatcctcatggttctcattagcttttaaaaatgatttattttggccgggcatggtggctcatgtttgtaactagcactttgagaggccaaggcgggtggatcacctgaggtcaggagtttgagaccagcctggcctacatggtgaaacctcgtctctactaaaaatacaaaaattagctgggcatggtggcacacacctgtaatcccagctacttgggaggctgaggcaggagaatcacttgaacccaggaggtggaggttgcagtaagctgaaatcatgccactgcactccagcctgggtgacagagcaagactccatctcaaaaaaaaaaaaaaagaaaaaggttactttttagaatacttaacatagtgctttactcggattagctgcttgacaagcttggccaaaacctaacttgagcctattcttctgtaaatcatttcttaactctacttcaccatggccttctccttcctaagctcatacattttcagtcagtaaaacctataaaacctgtaatatctattattttagtttgaatatctcctatctctaactatagaccataaattactaaaaaacacaaaccatgtcttcttctttttaaaactcctccacaatagtcatataatacagatacaattattatactcttattgttataaaaattaaaactaggtttagtttagaatgaatttcaaagaattgtcaataggctaaaaaaagagaggaaagggatctggaaattctgtagccccaacttgtttctcaacatacttatcatgttgtctatttccttctgactcaatcagcctaattctgttagggacgaggaaaagattggctcagataagatttgggaaatgagataacttaggtctgcctgcaggcacctgagtacattttggggaagaaggaaaaggatgtcagcttctatacctgaagatcatggagctttgcttctagaactttgctgtcaccggtgcgatctgatgattcttttgctgctgcctttgctcccaaaaaccattcttggaattcctgcatagactcttttgaaagaaaaaataaataaataaaaataaaaaatcagaagcaaatccaaaacattgaatgggctcccaggattaccacatgaattatttctggcctttagctcatctcctcttgccttacaaaatattccacaaagaaaataataatatataaagtaatacagtatgatctacagccatgaatgttcatggtagaattgagaagttatctcagaggaaagactaaaaagaaatgtatgttcctggaatgtctaatatcctgttgtgttttctctttgggtcaagaaaaataattaattgcctgaatatgtaaaaagtgcaaggagagaaatgctccagggacattaaagccattttgatggcacagggaggaaccacctcctcttttggggagtcatggtggatccatgtcaggcacagctgtgtggaaagcagaggcagggccacaggatgggcaatttcctggaccctatggctgccctgtttcatggcttctaccaacatctaagtttattgtgtcacttcatcatagcataaaaaatttcagcagttgtttggacagtggctgctggccacttgagcagtggaagtaattttccacacacatgagctatatatagaaaatgcagatgaaattcagaatcatcaagatggtgaactcttgctttcttgggaaaaagaggaaaaagaaagaaaaaattctgcatagggtgagagcctccagcacagcacttctattgctcaaatcgcaaagcacaaacaaatttgaaatgacaccctggaaagtttcctcaaacttttgctggcagtttctaggcagcatttggtttggattctttctcggaaacaaactactcatgctaaggcccctcagaactcaccactgaagtgtttttccagagattcctgcaggctggcctgggttttggagcacaactggctcacggcttcatgtttctttatcagaccagtcattgcacggcccaggctctccaactcagctgagtggtacttgcggcacaagctattgagattttcttgggtagagctgatgttgctttgttgactttgaagttctttttgtatatcctacagaataaaagtatattatgaaggatattcataacttgagagaaatactccatttacttcactatggtactgttttacaatctgaaattgacattgttgaatccactccatggtgtatacattttggtgcgtttttgagtacttgtactagatctgtactgattctttcagaattttgcccagttctccttgggaacaaacagctgttgggaagtagttaggaggtgaggtataatttagcatttcaagcaaactgaataggtccttatagattccagtccatgatcttgggtttagtcaattgattagagaccatcgcagttcacattcttcaatgagacacttgaactttgtttcagagtcacgtgctcaccaaaagcaccagtagttaatttaaaaaaaaaaaaggaaaaaagacctcagtttctagtacagtaaggaaatatgctaaaagagaacaaattgcatttgttgaaaagtcaactcagtgcttgtcctttacagatagctaattaggaatgttatctattaatatggataggaaacatgaaaatgggccaggtgtggtggctcacacctgtaatcccaacactttgggaggctgaggccagtggatcatttgaggtcaggagttcgagaccagcctggccaacatgatgaaacccatctctactaaaaatacaaaacttagctgggcatggtggtgggtgcctgtagttccaactattggggagactgtggtagaagaatcacttcaacctgggaggggaggttgcagtgagcccagattgtgccactgcactccagcctgggtgacagagtgagattccatctcaaaaaataaaaataaaaaaatagaaaacatggaaatagaatgttttctcaacttcttctttttcaaaaaatatacattatctggatgaaagaagtcacagtgaccaataaatataattaagtgatgaaaaactattggatactcaagtttgaaaatttgtggaagtcacatagttcttccagaggctccacccttttataaaaaagaaaaaaaaactttgaacaagcatagactctgagcaggcactacagcaacacatgctttctattttcaaggtattcatttttgatttctgaacacctgcacccagttcttcacgtgttgcttactttgctgtgttcaatgtcataaataagttggtctggtgttcatatgggtaactgagagcagaggttatattttttattatagtcaccacaaaacagaactacaatcaccatttgaatggaagcacttaatgatagtttattacctaccttgacttttttcaatgcttcacaagtctcattttgggcacagttcatcaacgattcttccacttttgtgaaccatgttgttatgtcattaataaacttctccacttgtgtactttgagccgtgaaatccttcagggttccttttgctacttcagttatttctttggcatgctccagtttctgcattaagtctgcttctataaactaaatatcaagcaagatttcatcaatatctctgaagaccagaagaatactcattcagtagaaattctgttcacgtgcagcttaattgtcaaagccacacaagtctcatcatggaagccagctccaatgttaatatgcctttccaagaaggaaaatcagtggacacagttgccaaacacatgaagtgatgggcaaatagaaagaggaaggattgtgttaacactgggtgggagagtggaagctctaactgaggttccagggaagatgtgagagggcattctgaaagtagagctagacctacccagaattcccaggtggtgaccaaaaatctgctcttgattctccctggaaatacccattgtctgctcagatgtaacactatctggggcaaacatcactgtaggattttatcataaaacaattttatttttgtccccactgttgctttaaaatattgagtggggctagttattctcttttccctggatgatatagctgaggagggtcgacttctatggccccctagttagtcaaaggacatatagtcactatacattgaaaaacaatctcaattccacaattcaaacatcctggcctatttggtaatgaaaactttgaacttaacttaaattgaaggcttctattcttacccccacctcagatctgctgggagcaggagaccaacagtgtggaagggagtaaatatctttctttctcttccttcattttatttctattctgccaccctgtgtaaggcttctttctcccataggctcagactggcaggaggcgggtgaggcattctgactcactggatgggcatctgtgccctctaggccaggcaaggtttagcattcattcctcctcccataggccttggtcttgtgtttttctgacttttttcatgcttggacttcccagtgaagttccctagacacgacagtgcgctgttctttggctctttactttctcattcctcagcctggaggcctttctttaacttctcattgctaaggtctgtttatcctccagatagccttcttaggccacctataatatcctcatatggtggtctcttcctttcttttcctctcctggttcatatttgggccagagtgacctctggcatttacctccaactaactttgaggtgcaggaccccacaagccatcatttatcctttggcaaatatagcagcagttagccagcctgtctgtcacttttaggattctttgggggatagagatcagactcccatgcctgccaaatgcaggggacaaatatcctgttcttcaggtggcactgccggaacccttctgccttgaggtaaggtaagccaccccctcacctcttccttgagtatacataggggtgcatgtatgtgcacacgtgtgtgtgtgtgtgagagagagaaagacagagagagagagaaacagagagagagagagagagaaaggaagaaagagaagactagagtacaccaataactctctgaagatcctgctcaactctgtaaaagtccaactgttaaccattgatatccccaacacaggcggcatgcataaggactctttatcttttttgcatatggatagcacctcctttgtgtcttcttacttcacacgaaacttctagcattcctgtgcatgtatatcatccctaatggtactgctgaacaagcagtctcaggtcagagcaaaagcataactgatcaactagattgattgcttagcccaaagtagcaaatcaaagagaaagcacaagaagaagaaaggaaatgtagagaaaatcaacagaagcagcaacacatatggaagctaaagggatgcagcagaaacctgagcctggagccagtggggctgccagccaaaagagacccaccatgctggatgcttccagggcttgggcactgaagtagcccaggtgttctgaccagtgctgatctaccctggcctgcttcatggttcccgtggatttgtgccatctgaagggccgtgaagggaggtttatagtggtgatccctctaaacccagttattcagtaacagcattaggaaaatatcaataagaacatcaacattcataagaagggtttctaggctgggcgcagtggctcacacctgtaatcccagcactttgggaggctgaggcaggcagattgcatgagctcaggagtacaagaccagccttggcaacatggcaaaacctcctgtctacaaaaaatttaaaaaattagcctgccatggtggcacgtgcctgtagtctcagctaccagggaggctgaggtgggagaattgcttgagcttgggaggcagaggttgcagtaagccgagattgcaccactgcactccaccctgggtgacagagtgagaccctgtctcaataaacaaacaaacaaccaacatcaaaaacaccaaaaaaagagggggttctgttcctgtctagacatgaaatggtccatgaggcaacttggctgaaatgcttccgaaattcagtaggcaaaaaaagaactacccttattataatattcgagttggaaatatgctattaatactggctgaaggaatgtggaaatatattaatattttgactcccatgtctgatacaatccacatgtttccttggaattatggtgatgatgataacatcgaggacatataaaggagatatacatatatatgatatatatatatgagatacatatatagatgtatatgagatatatgtatcagatatagatatatacgagatatagatatatgagatatatatatatacacacacacacacacacacagagacagagaaagtctagtatatggtagtaattacaaaatggatggaagtctagtagttattacaaaatgcttacctgaaggtctggcggtgtttctagatttttagttaattctttcagatcattaactttggaatgcagttcttccaatctcaatgctttgtttttaacttcagactgccaaaagggaagaaacataactaatcaaaaacactgacatgctatatttggcatttaataatttcaagaagagctaactttgtcgaaataccccaactttaagccagtgtaaaaaaaaatctgtttcatttttctgagggctgttatgatgtacaaacgtggaaaatgttacaattaatgttcactgggaatgtgaaggagtgtgcagaactttgtttttctccactcctttgtattaggaaaaaaaaacctcctggaaaaaaattaaacactgacccaaagtcttgagtcagtggggattttcaataggctaactgtcatttattcattaactttaatattactggttactatggcagcatgaaactcttgaagaagcatttcaaagcaagtacacatcaggagtgcctagttattatagactatgtgtaatatgaatgaatcgtttcaaataaaaatttaaaggatattaaagcagaaacagattcattacgatattgatacataatattttgcctttttttgcaccaacagtaacataaagaagaggaaagaagatcaaagaattatgaaacaaatgagatgcttgtaaacttcattagttatatgaaaccacaaaggggcatttaataaactattcctctcaaaaatggtattttggtgctttgtggacactagcaaacctcctgatgccttcaattcagaaaggaatttccttactggaagacgtgatgagctgtcagggcctctggctttctccagaagctggccgagcaactgaggaatcttgctacttacctacactcactatactgcagcgggaatggccctgtgggcactgggctgaatctgattcactgattttattagctagtgtgtcacacagacagtgggtaacataaagaacccatctctgtgagtaactgaacctggtcatatctaatgtggctcggaagcatattgaatcattggatttctgaggtcaatagtagttgattactttaacaactccctctcaacctcctacaaagagccctgatttgtagcatttaccaccatggtaagctacaacatgacgtcacagaacatggagttgaagacatacacagcagtacattgttctaaattatttcaaccatgatacaatagatgtcaataactcaaaggcctacgtaacagtagtgatatgtagaagaataatgaaaagtgatatgtttttagttgtcattacctttgaattcaatggaacttattttgtaaatttagttacaatttaagttttaataatggttgtttttaacagtggctcccaaaattcctgaacatttaacaattgacttttgcaagctggtataagctggatccagcacaggtcactttggagctgtaatgttagtttagcaccagagataacagctgaggacactgcggtatccatcacccctgcctgtacttttagtctggataattttttctccttctgattgccctcagagattggaattagataataaaacatttagaatgttctttggatcagagacaaataagttaggtaatgcaattcattcatgtatatttttctggaccaaagtcactatctccttactctatttctctttaccctactccacttttatcatagcccaattactacttgatattttatatataatatatattgtaatataaataatgcaaatcccacgagggtaggactttctgtttttccattatattttcaatgtctaaaacagtgcctgacatatcttaggtgctcattaaaaatttgaagaatgattaacaaatgattgcaagaaataggaataaaaaggtttaaagtgaattggtgactagaactttaaaaggtcagggactctttgtggaagcctgtgaccctccaatctccaattttcttccatttttgaaaaggaagtggaagaaccccactacctggcataataagagcacatggtaaggactcagtgagcagtttgggatttttttgaataaggaaaaatagatactaaacattactaaattacaaacacttccaatttggttttgaagtagaaggatgccatatcccccgaagaatgggaacaattaacttttacttttctactaatgatttaaagagccctaaataagcatagataaaaatgcaaaaaaaaaaaaacccttttattcataacctgttcaaattaaatagcaaaagatagttaagagttctctaatgctcttctatgtctctaaaaagaagaataaggtctggaacagtggctcacacctgtaatcacagcacttcaggaggctgaggtgggcagatcacctgaggtcaagagttcaagaccagcctgaccaacatggtgaaatcccatctctactaaaaatacaaaaattagccaggtctggtggtgcatgcctgtaatcccagctactcaggaggctgaggcaggagaatcgcttgaacccaggaggtggaggttgcagtgagccgagatctggagcaccactgtactccagtctgggtgacagagcaaaactttgcctaaaataataataatataataataaaataaaataaaaaataaaagttaaaagaagaataaacttttaagaaagactttttttttttttcatattctggtcaacaatatgccaccagctgccatatgtcaacacagtcaatttacctcaaattctttaagcagttcttcagctctgaggtggttatccaggttgctgatgttttctgccatctgtggaacgcagttgtttgaccatccctcaatctcatctctagttgacagtacatcatcccaaatggacaggcttactctcagcctatccatgttttcttcaagtttctctgatacctaggagagaaacagaagccatggcattcatagtcagaggcgtaagatgatcatcccccaaccaaagtaccaatgcttcttttatcagaaaagtatattctgacggacaaacagttccacaaaaattattgtaatctaataagtgcacccaactcacgtaaatgctaaccaatacatagattgcttctgtcattgggagagttgtttgaatttctgagacattgcattttcatttgtaaattgggatactaacaacaacaggtccattggaatctactataactcaatataaggttgaattctacaggacaaaggtccatcaagaacagtgttgtatttatttttgaaagcattaacaataagcatttttatttctaatgctgaggtataattagcattaattagattcaaacatatttataacataacgcatatgaaagcaaccaattttgcacattaaaataaaatagtattgcttatcactcttcctataatgatatgcactaaaatcccaaaagctataaataaaacaaaaatagcatgttaaaaaaaataaaagaatgttctttttttttttttttttgagacggaatctcactctgtttcccaggctagagcgcagtggtgcgatctcagctcactgcaacctccgcctcccgggttccagcaattctcccacctcagcctccacagtagctaggattacaggcgctcgccaccacgcccggctaattttttgtatttttagtagagatggggtttcaccatgttagccaggctggtctcgaactcctgacctgaagtgatctgcccacctcggtctcccaaagtgctgcgattacaggtgtgagccaccacgcccagccaaagaatgttcttttaaaagtggaagcatgtagggttttctgcagtccccaaattattttattatattacacaaatatcaaagtctaactggtaaatttagcttaagtaggggaaccactgtacatctgaaactagattttgatagaaggagggcaacagaatcactgaattttttagctggaaggtaatgtaaaatatttatggcttgatatctatatttccagaaaaatcaagtgacttgttctgtggtcacgtagctagtaagtgacagaacaagaactaaaacccaaagatgtaaattacaagtgcaatgttttccaatgcaaaattatagccttattacttaaaattattatatgttatggtgtaatattctatagaatgttcataaattcttcttttttatctataatttcatagtttgggaaagaaaaacattcagagttataacttgttatgactgaggctatcaagtgaaattcccaaaagtctgagaataagtttttacaaagcagatacatattttattatttctaaactttatgtgagcacggtttttcctcagactctcattttgcatttagtactaaatgttaaaagtaaaattcagctgggtgcggtggctcacaaatgtaatcccagcactttgggaggccaaggcaggcagatctcctgagatcaggagttcgagaccagcctgaccaacatggagaaaccccgtctctactaaaaacacaaaattagctgggcatggtggcgcatgcctgtaatcccagctactctcaggggctgaggcaggagaatcgcttgaagccagaaggcagaggttgcggtgagctgagattgcgccattgcactccagcctgggcaacaagagtgaaactctgtctccaaaaaaaaaaaaaaaagtgaaattcacatccttgaataacgctttgtccaaaaatttgattggggaatgtgaatatttaaatagttcacagaatcccaggtgattatcttacatccagccatttgtccacggtgctctccatgtctgttttcaccaagctgaaatcactactgtgaattttcttcagctcagataacaagtgttttcctttgctggtaaagttatccaagtctttctgtttgtaattcattttgttcttggcagtttcatgctgtggataaatgatttcttaattaataaaatagtcagtgataagtcatgagtttaaaaccatttgtctctaagaaatttaattcataattgaccttatgcagaaattagtgatagtgagattaattaactatatgaatatatataacaccattttcttgaattgctagaatcctagaatgtcagcattcctaggggaaaaaaagttgagctcattagcatgaattacccacatctaagtatactgataagaatagtgcagataactgctttatgagtaaaaaccagatctactaaagcagaataccaacataaacacattttgaattttaccttggaaaaagcccatttaagatcctcctgatcttttatggtagttctggttacaatcacactgctggcattttctaagactttagatacagctgatttcaggttctgatattctctcattaagtcaataagtccacagcactgaccctgactgtaatgattaaagaaaatatattatttggtgtcatgtatcaggaaaagggagagttgcctgcaattggacttgatgtttcactacgtaaaggtattaatactcatagacggattcctacatactgtcctcaaactagtgctgctggttaatcctacttactccaatgtctaaaatattctccgtgaatgaggtatgcacgcaaccactgaaacaaaatctatgaactcaatgaccattgaaacaaaatctatgaactcaatgacaaagaagcaatatatgttcttgccaactcaaacttacatagatgagtcatccaaatatatatatttttaattgtctttttccatgttgttttaattatttcataatggcatatgttgtgtgaaagaaaacaacaataaaacaaaacatagcccaaaactaacaaataaaaagattactcaataattaaagtatatatcagattttctcttccatctcaatgtaataaattctcattggatatgactaccctgaagactgtcaaaaggagaagatagctgttgtttataaaaataaggtagtctgcaatcctatcagcctgaatgcactttctctcatttgatcttgtgaaggtaagcagggtccagcctggttagtacttggatgggagaccctctgggaatattggaagctgtaggcttttttttttttttaaacaaacaaacaaacacacacacacacacacaaacaaaaaacagctgggcgccatggatgatgcctgtaatcctagcactttgcgagtgctcaaggcaggctgatcacttgaggccaggagttcgagaccagcctggccaacagggcaaaatattgtctctactaaaaatgcaaaaatcagcctggcttggtggcgcatgcctgtaatcctacttaggaggctaaggcatgagaaaggcttgaactcgggtggtagaggttgcagtgagccaagatcacaccactgtgctccagcctgggcgatagagggagactatctcataaaagaaacaacaacaaaagaataaaatgcctttgagcaagcaagtttacatctagagattttccaaagaaataaaattatgtgcactaagatttaggtaaagtgatattcttcataccattatttgtaataggagaaaatatagaaataaccaaaatgttaaaaacaggtcaataattaaataaatccagatatattcttatgataggacactgtgcaacctctaagaaatcacaatgtaggataatgtttaataatatggaataaagtttgcacaacatgattcaatttaaaatgcctacagaaatagtctacattatataatgtgctccgaattttgtttaataggtctttgtacatgatgtaaaatatatgttgagggtcattttttaaaatgcatatgaatgtccaattgttctagtaccatttattgaaaatattattctttctccaccgaactttctttatatctttgtcaaaacaattgactgtatatgtctgggtctatttctggactgtgttccactcgtttatatgtttatccttcagcctgtaccacactgaaactagctagtataagtcctccaatcctttttcatttgttatttatttatttacttacttatttattttaggtaccagagctgccagcaaagtcctccaattctttttgaaaactgtactggctattctagtaggtcttgtgcttttatgtatacattttaaaatcatcttgtcaatttctacaaaaagtctgtgggcgttttgattgggattgtataaaaagacctcaataacaaaaaaaatcacccaaatcggccaacttgaatatttaaaaagacatacagattgcaaataacttaacaaaatatgttcaacgtcagtcatcagggatatacaaattaaaaacaaaatgtgccaattctgagcacagtgcctatgagttagttagtcctgctccacaaggagcacttaaagtcacacacacacacacacacccccacacacacacacacagagatggctctacacatctagcagaatgtcaaccaagcaaataaacaaaaatgtcacaataccaagtgttagaaattatgtggagcaactggaaatcttacacaagactggtgtgagtgcaaaatggtgcaactacttcgaaaaatagtttggcaggttcttataaagttaaacatatattttgctatacaatccagagtctcacttttagattatttacccaaatgaaataaaaacttacgtacatgcaaaaacttgaatgtgaatgtttataaatactttatttataatcatccaaactggaaagaacccaattgtccatcaactagtaaatgaataaactgtagtacacccattcagtggaatatccagctataaaaaatgaatgaactggatgggtgcggtggctcacacctgtaatcctagcactttgggaggctgaggcaggtggatcatgaggtcaggagatcgagaccatcctggctaacacggtgaaaccccatctctactaaaaatacaaaaaaaaattagctgggtgtggtggcgggcacctgctatcccagctactcgggaggctgaggcaggagaatggcgtgaacctgggaggtggagcttgcagcgagcagagatagcgccaccgcactccagcctgggcgacagagcgagactccgtctcaaaaaaaaaaaaaaaaaatgaatcagctattgacgcacacaatgacatatgttgtgctagataaaagaagccaggtcacattctatgtgattttgtttataaatgattctaagaaaagacaaaactatagatgtggaaaactgcttcctggttgcagggggcctaagggcaaggggaaaagataaggccattttttaggtggtagaactttcactgtgaaatttaatagttacacaactgcataagtttgtcaaaactgatagcattgcgtatgaaaaaaagtaaattttagtgtgtttaaattatacctcaattacaaacaagtacaacaaaacaaaaaaaagtagaaaattaaaagttaaggctgtcatggtagtacttcataactgttgacaactcctgctttaagcattcaatttcacatgtaatttttttttttttttggtgagaaggagtcttgctctgtcttccagcctggaatgctgtggcgcaatcttggctcactgcaacctacacctccagggttcaagtgattctcctgcctcggcctcccaagtagctggcattacaggcaccctctaccacactcggcaaatttttgtatttttagtagagatgggatttcactatttggccaggatggtcttgaactcctgacctcaggtgattcgcctgccttggcctcccaaagtgctgggattacaggcatgagccaccgtgcctggcctataattgttatctcaaagcaaccttctcaataaagttctgtcgaaataagtaaattttcaatgttatgaaagtgacacagaatatctaaaatggtaaaagatatttaactactgatcacatcaacacaaaacaggcaatgtcccaatgtcacataataagtgggaagctaaaaacaagaactgggtgggttttgacttacttttcatgaattagtcttttggtatcatcccaggtgacctctaagcggtttatctccctgtcaacttcaggtgcaaaagctacatctttctgggcaatttgcttggctttgtctttcaaccaacatagttcatgctcgtgagaattcaattcatcttctagctgattaaacactcttaacctgtgaattaaaatgttattttcctattaatttactaaaggtagtaaatgaatatttcttctccgtaagtatatgatgagtccataaagcactcatttagacagctagaaaaacttttaacacagaaattaaattaatgtttatcaatggaaaaagtacttttaaagttaattttgcaaaataactcagactgtacctcagaaaacattgaaagtcattcttactactcaccatcaaccttctattaagtttgtattttctttctactttgctttgatggtagaagattttcaaaactaaggctgatctcataggctaactaggtaaatacttattgtaaaatctttggtaagaaatgtttctgggccatgaggttcaatccatgtaaataatagtgtttaaggattacagttgtttcattcaatatcaaattagctttactgagctctgcagaatatatatatatatatatatatactttttttttttaaacttaaattacctactttgttgaaaagattaccataaggaaatgatcatttttgtccctaatctattagtatctcagcatttataaaaagtggccatatcaccagccacagtggctcatgcccataatctcagcattttgggaggccaaggtgggagaactgcttgagaccaagaattcaagaccaacctgggcaacagagcaagaccctatttctacaaaaaattaaaaaaaaaatttagctggctgtggtggtacatgtgtatagtctcagctatttgggaggctgaggctggaggatcatgtgagcccaaaagtttgaggccgcagtgagccatgattgcaacactgcactctagcctgggtgacagagcacaaccctgtctcaaagaaaaaaaaaagtggccacaaagaggcagccatttactcttcattcttacagtttggtataggactgtagagttcacacaatgagtctacatgctttatcccatttaattcctaaaagatggtggctgggggcaggtgttcttattatccccaccttacaagaagagaagaggttttcccaaggtggcacagtgaagcattagtatggctggaatttaaataagtccattaattcaatacaacattttctgcacccgatgtgtgactttggtgagtgcagtgttgtgggtactgatgtggctcctgagctcaacctgggttttctactctggcaatttgaggatctcctgtctgcttggtctaagaaggccatgacaccctgcagcaccaatgatactgctggcatccagggtgagtgacactaggcaccttgttctctctttattctggaggctattttttcttcccaagtatcattcccttttgtaaatttattcttaaactaatcagataatttattgcctataaagggtataacctcaggagcccagtcccaatattgactccactatcatctgactaaatcctcgacataatggttgattctggttaaaaggaaacaaccagcaatggtctttcaggaacaacataatctttaccaattatgaataccttggcatgaatgcatttcagctgtttctttgcccactgaaaaaaatggaagagcaagtggccctgaaaacaggagtcagaaggttctattaagaagaaaaaaaattgaaaagaaggctacagttttaagaaaacagttacttttcaaatttactaagggaacttatctttgacccgtttgcttctcaaatgaactcacctgacaaaagctcagctttgcttacttaaacccactcctctgcctctccatacctctaagcaaacagttaaaagcagttgtagaaaatgactctgccaagctgattggtttcactttaaatgaacacagagctcaaatgacagttcatcaccttcctaagctcccctctacaagagaactgtttcacaccattttctttcctccaacatctgccctctcctctgaactaatgagcttgcaccagtctctaccaagaggctctcagccaccaaggaggaatttcctcatactttttaccaccaaaactactaggatcactacctttctcttctgccttcattcttgttatagaagatgaatcccttctcccatcagtaaaaaaattgtttaaaaacagataataagatctacatattctttgctcataaactgactttagggaaatccaaagaaattttagtacgtctcaagtgtcaaattagtcgttaatcttatcttcaaagtggtaaaaaaaaaaaaaaaaaaaaaaaaaagaagaggaagaagaaattgctaaatatggtactatcaaccaaaaagtatctgagacaggtctcaatcaatttagaagttgattttgccaaggttaaggacatgcccggaagaaataaatatgaaattacagaaacagtctgtggtttatacctttctccaaagatgattttgagggcttcaacacttaaaggggaaaaatgggctggaggggaaagagacagaataaggttaatccatgtgttgcaagagaaaagaagcaggcagggaatagtcaattacgaattcatctcgtgctcagtaaatcagcactttacctaagacaaggtgaacatagagtagctacctatggaattatttaatcttttctctgtatctatctgtttaggaacaaaaggaaaggcagctgcttgcatgactcaactcagcttaatttctttcttttggcagagtgaattggggtcctgagtttttattttccttgaacagtactaataaagttttgcataaaagttaattccagaacaaatacaaaagaaaagagacaagtggccgtgacagtttcctatttacctctgctgaagagcttggcgggtaggttctttcaatcgctctttgtcagtcctttcttcaatgtcctcaatgcttttcagaagctcctctttctggtcttggaatgcttttttcaacactgccagagcatctgcctcactctgcttggttcccagaaggttctggatcctctctacctctccacagagctgatcagccgtggctctgcaggaagtcctttgctcagagctcccgattttcagatggtattgggctttggaaagaatgccatccagactgacggcagcagattctaatgctttagcattttgaagagcatcattgaggtccttttctatcaaatcagactcgttcttattcatactgttggttgcttccactgtttgcctcagctggcggagaatgccggacagagaggcatggctctggaggaattctgccaaatgggacagggcaagctgccgcctctccacaacctggctggcctcctcaaacagctggaagcagtcctcagcctttccctgcaggaggtggaggtcctcagcacggcccagagaacccaactttgctaagtgaccctgcagactctgcaattcgccctttttgctctctacttctgctgcgtggtcctggaagggaagagagagttattgattcctgagatacactacagtctatggcagaggtattttacaggatttgtgatgtgaagatctattttaggtgccatggatagtatagtacttaaaggtcatctacagtgaatcttagaaaattcacaaaattttctgttttgctgatccacatttgttaaataaaacacaactctgggccaggcgcggtggctcacgcctgtaatcccagcactttgggaggccaaggcgggcagatcacgaggtcaggagatcgaaaccatcctggctaacacggtgaaaccccgtctctactaagagtacaaaaaattatccaggcgtggtggtgggcgcctgtagtcccagctactcgggaggctgaggcaggagaatggcatgaacccgggaggcggagcttgcagtgagccaagattgcaccactgcactccagcctgggaaacagtgtaaaactccgtctcaaacaaacaaacaaacaaacaaacaaacacaactctgttttggaactatgtaattaattctgtgaaaaaaatttctttgtggatagaaattgttagttaaaagaaataaaaacattggaagattcttaaagatgcttacatatattttacattttaattttaacattttaaagatgcatatatgtatacatttatatacaaatatttgtatttagatatctcatatttttaatatttcaactttaaaaattttaaattttagaagatgcatgtatgtgaaaaaattttaaatttaaaaatttaaaagatgtatatgtgtatacatataaatctttaaaaatctaaatgtttaatttttttaactaacaatttctatccacaaaatccatgaagaaatctttttccattaaattagttccaaatccgagttgtattttatgcaagacttctgtataggaaatttgactagctcacaataaatcatgtttaaaatctagcagaaaattggcaacattctcagtggtttccattaaatagaaattatcacctatcttaatcttgacaacaatgactttaagattcctctgtttgactactaaacttcagataggttcctcttgactgcagatcctgaccttttcttttttcttagagcatttactttagaaaacttgtaattgtaaatttattctctgcccctttgagatgtaactcttcttaaagctctggccagttttttctacctccgtaatatttttctgaaggacctgggagccatctctttgaaatgtaatcatcagggaagatagctgctctctctcagtctgtttggatggtagagcctaaattcactgagcaccttcccccaagatgtaaaactatctcctgtcctgaaggtaggagaaagttgcttttccctgccacagaaccaattagtcaacccagcaaggagtgaacactcaataaatatgaaatattctattgttaaatgttgctatatgcgtactatgtagcttatctccattatttcaatgctttatgatcaatatcggaatttttgaatgttttctggtgccaggatagatataatgtgttggggagtcagaaaatgataccctaaaatatgtcactttggactttaaactgagagaacctgaggagcagcaaattcagagaagagcttttcctgatgctcccttatctgactaaggaaagttcctccagaagaaatataatcatcaaccagggaggaataactcacaggaaagtcccttaaggtctgacatctcacttggaaagactgttagcacaggctgccatctgtaattctgaggtgtgctacctgagaaactttttctgcataataagacagcctttgttcacagtgcatttcctcccctcaccctcccatagcttgtccctactaccctcctgaagccccagcccctatttctttctgtataacataaaaactttagtcatctggttattcttagagtctcatattttgtgggactcccatacaatatgcacataataaatgtgtttgccatttctcctgttaattggtctattgtcagttcatttcatagactcaaattatttgaacgttcagagagcagaggaaagatcttttcacccctccatatgcataatttataaataagggaaataagctttaaatcattttaaagctgaatagtaattcagaaaaactatatccttaaagtatttgaattcagtattagttttcagttttgaaataaaacaaactgggaagcttaaaaatggacattcttatcactttatcctagcaatcatttgctccactatgaagagaaagtgtcttaagatggttgccaattttatctgaagtggctttatctgcttaattggtctgcataattcattgccttaactcatatgctcaattattaaaacattttcatataaataaaaagttaaattctcaccatttaaacttttttaaaatgttgcatctctttttaattcaagaacttttttatgaagaaattcttcttcaatcttaaaaaaaaaaaaaccactttaccttatgccgagtaagggctacttgatggtccattatgctaatctcagaggtagtttgtaattcactgagaaacagtttaatccagacagaaaaggaaagcagcagctcatcaaattgctggtgttcagcaaccacagactgaagaaaattaatcctatgtagacaaagtattaaagttaaaatgtcccataagtaaacagaaaggattaatgatgtattttgggaattaagcttacccaagggcaaaagcaatgttgtcacacatgaacactctatacctcttgatattttttacttcccaaaccctgctttactcacaatcttccctgtctcagtgaacattgccaccattcaccctgttggtcctatgaggcactcttcatcttgtcctttctttacgagtgcatctaatctatggataccctctcagcataacatatgttccaaaattgaatgaaattcctgtaattctgatgccttagtatatgttatcagtaataattatcattatgttcaattgttgtgtgccacagaagtaaccaaagtttttaatcgtgtctttaaccatggctagcctatgacttttgtcatccatagacaattattattttacttttattcttctcaaaaagtggtttacagtcagctgcaatccaaaatttgctttttctttaaggaaattcatggaaaggactcttgcaagtattctaaaatacagatttctgataactttggagactatactattgaactaagaaaaaacttccatggctaggtgcagtggctcatgcctgtaatcccaacaatttgagaggacaaggcagctggatcacttgaagtcaggagtttgagaccagcctggccaacacagcaaaactccatttctactaaaaatacaaaaattagccaggtgtgctggtgcacacctgtaatcccagctacttaggaggctgaggcatgagaattgcttgaacctaggaggtagaggttcctgtgagctgagatcatgccactgcactccagcctgggtgacagagtgagactctgtctcaaaagaaaaaacttccaggactctaattaaaaatacattcgtgagatttgctaacccaacattaagcagaacaagatttaattacataggactgaactaacagaggcctgaaatactttttttagtggtgttttgtttgaaacattgctgattctttttatgttttcctttccaagtcaagataacttttttttctttgaattgtctatagcttacaacaaattgggcaaactacacttctgtgagcaaaatttgtagtatattttttctctctacttgatttttccagaaattggagactatttgtgagcattcttaatgtatggtaatatagttatttgtataagttcaatatgttttgtcacaggacacaattggaaacattggttattttaccaaggctttgactggaatggcatattttcagatatgatcagactgctttgaggaattcagaaaaactttatagaaccaatgaaaagcccttgggaagattggccttatacttttctatgtgatgcctttataaagttcctgacctgtggtaagtaaagaatgtcactttctgacaggcccaggaatctcaagttatattaggacctttagaagaaaggaattcacccaattcatacagattatctgcaggcacagataaaccttttgtttggttaatgttgagagacttttgaaagtctaatctgagatttcttatgaaaaacgtagcagcaaagccaatttttaaaaagcctgtatggccaatcactaatcttgctgcactttatatggataattaggccaagtataataagactaaaatttatcttgcaaataagttgatcctactgtgatttgtctttggtagaaattgggggctgaagagagaaaaattatgttttaaaaaaaactacagtatgtatgttactagaatctaactttgttcattgtttttgagtttttattatgttcccataatttggactgaatcctgaattgtttcctggccgcaagtttccaaactaaggttttccaaatcttccttccattttccttattttatttatttatttatttatttatttatttatttatttatttattttttggagatggagtttcactcttgttgcccaggctggagtgcaatggcgtgatcttggctcactgcaatctctgcctcccagattcaagagattctcctgcctcagcctcctgtgtagctgggattacaagcacctgccaccacacctggctaatttttgtattattagtagagatggagtttcaccacattggccaggctggtctcaaactcctgacctcaggtgatctgcccacctcggcctcccaaagtgctgggattacaggtgtgagccaccatgctcagccaaaactgctttccttaatgccccacaaactgaagctaggcaactaaactttgggagaaataacagaaacttgtaagtaaacaacctatgtgcctgttgatgtattgacttctcagaaaattcactcgaccattcatctgaactgaactacaatccagaaaaatctgttcagattgctactgcaatctgaagatgcttcacaaactctagaaaaacaagtctatagactactctagatattaaactttgtttttcttctgtttccttagaaatgtctcttattaaagatctgtttgcctgcatcatatgtagaggcccagcccatttgcaatgccactttctggaatgggacacagctatttaactgaactgatctattctcaggactaagagactgactaaagaagacatgcaacaatatatttcagtttgctttttttctgtttatcttaatttgcttttccactcctttgtctatctctatgaaatagcctttttttttctttttattttattgagacaaagtatcactctgttacccaggcttcagtgcagtgctgtgatcacagctccttgtaacttcaaactcctgggctcaagcaatcctcctgcctcagctttctgagcagctgagactacaggtacatgccaccatgcctggatacttttttgaaaaaaatttattgtaaagatggggtcttgctatgttgcccaggctggttttgaactcccagccttgagcaatcccctcaccttggcctcccaaaactctgggattatgggcatgagccatcacacccaatctctatcaaacaaactttaacacaaatctcttcaaaactttccatttagcatttcacattaatacgtgaaatgttttttaagtttcaaaatgggaactgaaggaaatcaaaatattttactccaaaatatatttctttgacaaattctgaaatggccctgcaaagctgtcttttggggaataaacttgcttctgtagatctgtagagaatctgcactaatgcagctagccctgcctttgtccagatctaggaaagatgaactgagagtcaaacaccataaagacctgaaaaagacctttaccatgtattctctttgagggctatacctgtgaggtttcatctacataacaagaccagctttgctagccaagcctcttcctttctccctccaataacctgtcttaacatgaaaacctgttttgggccattttctgagctcacaatctttctgtaacctcaatatggcatatattctgtatgtcaaatgtatggagtttggatctccatcctgaaggctcctgtgtatatacattaaataaatttatatgccttttctattaatctgcctcatgtcagtgattttctaacctctagggggccaagggcctcagccctataatccccccactcctccctccccaccaacacacactatacattgactctgcactcttctctccatttgcactgctctcatcctggtctaaacctcttcagttcttgcctgaccttcaacagcctcctaactggcttcctccctcccacctttgcctacttacaatatactctctagataataagtaaacatgatttcaagtgaacagggcattccctgtccttaaacactaggtggtttcccattgcacttaagaaggcagaaccccaaactccttactgtggtctacaagaaacctcacatcatctacttctctggtctcatctgacacagctctgccccatattcccactgacttcctctctgtctcccaataaaaccaactcattactgccttagagcttttgccatttttgctccctttgcctgtgtgggtctgtttcctgcacagcccacagatcttaatctgatgtcatctccccagagaggtctcgcttgaccaccattctaaagatacaccatcctgcagtccctgccatgctaccctgttttgttgtcttcataatactgaacactgcctgaaatcgtcttgtttgttcacttgcttagttatgtatttattttccgcccagttccttcctcccctctctccacaccatggacctgccttgcttactgctgtatcctcggcacctaaaaaggtgcctgggatatcatcagggaccaatcaatgaattagttaataaataataggtgattggagatcagaatccaaacatattaaaaataatcccttaatcaaaactagtatttattaaaatggtttgtatccaaagttcaactgttaaatcagctttcacattttaatacttataaaatcttctacacattatccttatatgcatacattatattttcaatgccttcacacattggtatcactttaaaagtcccttactttccctctaagggataggcaaagggcagctactgctttgttttacagaaaattgctcacctttcaagaggtggcatcaaatctttccgtaaatttctgaaaccattcaaatgtccctttttttgatcctataatacttcgtgttcacccctcattattcccacactaatctgtcaattatttggggttaggttttgttcatttttatggcttttggtgtctgatatggtaccttgtactcagcaggcacctgatatatatttgttgattgattgaatacaggaataaataaataatagaataaatataagctccatgaaagcaaaggatgaaactctttattgctgctatttccagcacatagaagagtatgctactcattgtggaaagtcaataaatatttgctgaatgaattaattttttaaatggtcagaaaggttaaatgcctaagatcacatgggtgatcaataccaatttaaagagaaaatttgttttctggtatattggaaaggtatagatgccaattgttaatcacctagttaattaagatttaatccatttttgcctccatttatcaataatctcccttgctctctccagaagatctatattaaaatgaaatggactagcatatgtgtataaaatgcctctggttgagaaatgtcatgtgagataaaattttaggtaccatttttttcctatacaaaaacagcttaagcaataaataatacatacattagcaatcctaccgtctttaatctatttcaactggtttaataacttgcccttattttaagactaaattttgtattgggattcatcagaaatgctcagttttgtggaccttgattttcaaaataaaagttttcttcccttctgtagttatcaggtgagtagttgagttaaataaaagtaaacaaaactatgctttcttaatttatatgctcatcatttaaaaacaaatgaacaatattagaagatttatcttttagaaccaaccttttgttaatgatctgtggtaaatctctccatctctcatccaactgctccaaatgtagtttcatcattttcacatcatctttggaggctactgagaacaatgattccttcaattgcaaaagtttgctatagaatgaggcctgggatacaacttcattttgcagtgcctgaaaaatacaagacattacggatctcatcctaacaggactgaaaagtaaggaccatgcggcacaggcggctgttgtccaaaggattcgcattcttgcaaaatgcaagtcattcgggacaggctgaagagagtttttattacttgatttagaaatggatccacttaaccttttaaaggaatttggttcatccacttaacctttaggggaatttggttccattccattaaaggttaagtggatccatttctaaatcaagtaataaaatgcgactaaaacctgaataagttttctggagtctgagttctaagttaggcaaatctagaagctgtagaatttctttcacgatgaagagactgagtaggcaaagagaatcaaagaaaaactattgccggagagactcagtgcacagctaacaataagagagatgcaattctagcctgggacatgttctgcctttctatttagagtctagattaggccaaactggagaacttaagggctcttcattttacttttaagcaacagaactccttcattttaaaaatgtaatcagtcaacgaatctcttaagtgctgtgaggtgcataaaagttgtggctcctacctaacaaaagataaaatataaacactccaatagataggtaataataataaaaaaatattaagtgaaatgataggtatggcacagcagatagtagatacttgtcaaaatgctctccttcccttcctagtgaggccacataggtgatacaagcaagattgctaaagggattagaggaaggaatacacagcctgtggatgacaggtgagatcataaagcagaactgcgacttatgctgggtacaagggaaagaaacagcgcagggtgcagagccaggaggtaggaatgcacaagtcaggtccagcccacgaggcgaggctgccttactgacgcaatgtcaggatgcaggagtaacagagtctgcagtcctctcagtcatatggcacttagtttccacgtggagatgggcagcaacagttttacatgcccatgtagccttgagtcagtgtcttcatttataaggaaaagagctgtgaagtccctcccctctgggaataccccacatgtatttgcaagaagacaggaaccagattgtagatcaggattgccctttatggtcagggcgggaaacagtcagtacaggtttctgagaagggactttgtggaagatgagtgcagacaccagtgtttaataaaccagaaaggcaggagaaccagaagaatggagtaccccccaagtcaaggaaggagaacatttaaaggtggggccacagattccgatgctatagacactggtgacagagttttcagagaagcgattacaaaaggcaaaagaacgtagcttcctcttaaacgtcttataaaagttgatgggagaaagttggagtataaatctgtaatacaataaatcttttttgagaagcaattttgactgttgaattttccagcatagacagtatcatttaaggcaagttattaatctctagaaatcagtaacattgcctttagcttcaattatactcaacgattttctttctttaagtttaaaaaattggcttcttcaagtatgaaataaactttgtctttctacctattacctacatttgtgctcattcatttttttctgtcttccataagaataatcattactgtgacttctttctacattctattacttatttctttaaaagaacaccctttattgcccaaacgtcatataattacaaaagtagagagattatacctatttccagcctcagaaattatgaactgatagccaacctctttcatctatattcctacccatcctttcctcaactcctttgccaaaccatgttattcagatgccgggcattacattacaggattttctaacacatcatggaaattgatcatcacaaagttctcattgttagtttctctccctttcaggtcatggttgctttcttctttttggaacaccctgatgtcaaatgatgcttcaggaatcacaaaaccaaagcaagaagggaggtacaagtttatttattttattattttaaataatgtaactgtaacaaaaagcattttattttttccttcctcacacttccttgaacttgcctgtattaactgaagttcaccttccactttgactctgtctgcagaaatgtccatttctggggaactggctttagcttcaccccgctctaaccaggtcaaaaaggatgatagttctttctctagcctaaaggaagcagagagcagaaacaaatttattgaaaattatcatgctagcagattaaacctttgtgaagttggagggtccaacacaaaccatagtaaatacagcctcagttatctcagtcttagatatgccagcacaaaaatccctccttttattttcatttgtgtccctgcactcacatttatattggataatatgtaaagacccatatatatcctctccactctcaggaatctttgccttataacaaagatcaagagtttcctacagtagacccacaagttcacgtcttttgcatctgggataactactccccatcactttaagaactgctaatccagaatttcctatttagtagtgcagcaactcaaggaaaagtgctgctcacctctgccagtgggccagcagattctccagcgccgtctgtctctccttcgccctccttaggatgtcctcgtattgctgctgtagagccgcagcctcctgaacacaggaatctctgttcacaaccttcctggcactggctgagaaggcagtgatcgcgctgctcagtgactccagggcctggcagagatcctaagaagagtgcgagaagaatgcagtgaaagcacaggagccaacgaggcctgcatttttctttgacaccgatcatcgcaaaatattttccctcagtcataataaacaggaatagcactaagaatgggtacaaatatacagtttgatagaagaaatgagacttagtgttcaatagattagtagggggactataggttacaataatctatcctatatttcaaaatagctagaaaatagtttgaatgtttcttgaataaataaaacacaaatattttaggtgatgaaggtcccaattccactgattttacttttacaaattatatgaatatattaaattatcacatgtgcacccccaaaaacaaataagagttatatctattttaaaaggtctgtgcccatgatttgcagcaagacatagtgaaaatgagaagaaagtgacttcataaatacagaaatcaaaaacgaaaatggagacacttcttcaaataagaatgcactgctatttatctaaaaactttcaactttcccttaacaatttaggtaacttgtgaagattattagtcattttatgctaaatacgtatttaaaaaccctattcttaacttacaaaacccacatgtaacatgctataatcactccaaaaaatacatataaaaagaattatggctgaagaagctactgtctatctcaatagtaataataataataataataataataataataatgacacagtgcctcagaatgtggcaggccctgcattacctgcttcccatgtattgactcttttcatcttcctgagaaccctaagaggtatgttatttcattaccttcattttacagattaggaaatcaagacacagaaaaacaacttgctttaggaaatctaaatatcggaaaagtagaatattagcctctttggtcctccattattaacttagttgtctataaaaataatttcatcacactgaattctcctacttttcctcattttttgtattaagaaattacaaataagtaacgcaaaagtgtattctcattatcaatatttaaacaatagaaatctcactccctcttccagatggcctttgtcaatggcttgttttctattacatacacctttataaatgttcgtgcacacatgaacatgcaatatgaatcatatttgtatttttgtttattaattaatgtacggtagtatttctttgtacgtaattatccccctttgttcctccccctaaattctgccagagccatctgtctgtagccttgcagaagattcgcaatgatgagaaaaaccaatcattggaaacagatcagtgaggatatattccttaaacatctgagtacagtgggttaaaatatgaagacagctatacacatatatttttccttgcacatgtacttttttataatgctggcaagaggtaacagggttgttaaagctaagctctaaaaatgttactcatcctaattaaaagagagaaatgtatttgaaatgaatactcctttaatatacatctttaatgaaaatttattcacatccttacatgtcttggattatataaagtgaatacattagatctatataattactcaactaatataaacatttttccaatttcaattctcttaaaaagtttactgtattttcttttcaagtgggaattatcaaattttaagttggtaaatagtagaaatgttgaagcatactcttaccatatgttcttgaagaactttgtatgtttctgtagctgaagaacatattttaattggaacagcaagtttatcttcaaattcagacacagattgctggatctaaaacattggtgcaatataaaaataacagtgggaaagatacatagcaagacaaaaaaaaaagttactgagaaaatggcatacctaccttttatggataacttttaatgtaattataaaatgcattctttaaacatctaaaatcaacatgtcccattatttcacaaattatgtctttctcttattccactatttgtaaagtatttattgcacttacccacaaatacaatgtgaaatatgtaaacttaagtataggtggatcaattcttacctttctaaggttctcttcaaacttttgctgctgagataaatgtcccaggattgttccttccagacactgtgcatgctctcgaagctcttccccgtatcttcttatttgtgtcaacttggctttaattcgagcagattctccagtggtaacaaactgagcaaaagactgggcttcttcttctaatcctacaatgctgctgagcttactttctatttcctgaattgtgacctaatagttaaaacaagaaaaatgacaatgtaggctgagcaagcttgccttcctgaaatgatacaattatctgcaaagagggaatattttcttaactgatatttgaagacttggatggttagagcgcagctgtgagcaaacaccatgtgtttggggagatgagatatgccgaaaatgtctgcaaaatacagtgatgggttggggggtgcttgctggatagagcatacggagaaatagctactcttgcttgcagtgaagtaagcaaggagatgtccctgggacacttacagtatctctgaaggtacagagaattatgtttacgttatgaattaggcgttttaattaactgagctggggaagcattgtgtttcagtaactcattagaatgctaaatactgacattcacttatttttctaaaattcagttgagtattttatatgttactaaaaggtttaataactgcacacctacctaaaagtagttttcctttttcaaacttatcatctattcttgatgccagtggtttccaaagctagaatgcactaggaccatctggtccctattctccgggattcagacttactaagtctaaggtggggctcaagaattttcatttctaacaaatctccagctgatgctgaggctgctgatccagggacctcattgctatgtacttgacagagaaaagcccacatactgtcatttcaatttatttcaactgggggaagaaaggacattttacatgttaaccaacatctgaaaaatactgataactattaaggaagtgtgtgcatgtgcacatgtgtttatgtgtgtctgtggagtgtctctcacaaacatagaagcttgtttgtatataagaagatgaaaattatttctctgagaaaaagggccaaattattcaatcaaaatacatcaaaaattcagccaagtctctgtttcagattatttaaatggaaaatactattgccctaggaaaaaaataaagttttgacttctgtctagatgagacaccatagtcagaaataatttctgcctagttgaggcaatcagaaataatttacataaatgtcggatatgcatcatttttatttttcatatgaatgaatgaagtggtatatctcatcaatatttgttatttgagcatttatacaggcttcctttgttttgctgttttttaagattatattttttagaaaaattaatcataaattcaaaaaatataggttgtctacaaagcactaataattgttctagttgcttgtaacacatcggtgaaacaaacttagttaagaaccgagctcttagttattagagtaatacttgccatcaacaaattcatatatacgaatcactcaatcatattgttggattgtggtaaaaataaatccatccaggagaagaagatggaagacgaacccagcatatgttcttatcatttatcaattataagttaggaataagaactcagtcatttgaaatggcatgtaataatgaacaaaagtgggcttagtgtatttatcttccaacaaggcaaatgcttcattacttttaatcctaagatcgttttaaaggaaaaatattacaagtgttactatattttaaacctttcctataatgtagtcttatgtttggaaataaaacatgaacctaatagaccaatttccataggacagtgtattccactgtaactttgcttatttctagcaaatatctttttcctggtattcatattcacttacatattttagatagttttaaaaatgccttattggacgtattgaaatgtatttctagtctgataaaataaaaatagacaattgaatatatattttaagaaaacatgtaatctttttttctggagaataacaatgagatgacattagatagttgatatattccagaagctctggaataagggtggaaataatagtaaatgaattatagaaaaaataaatacgttgaaaaatgtgtgttaattttcaaaaggggacatttttgagacaaaactatttaaatgtgctattcttttttcttagaatttagtgaaaatgattaaatgacaacttttaaaaacaattttaacaattaaaaatatttaatgaatattcttccatggcctcacatctatttttcctggtataccaaagaagacatagcagactgtgtatatgaaactccatgtatgcttgattgcaaaagatgtgtgagaagcaaggatgatctgcacagcgggtaatcttatctgagcaacattgcaccctcccaccctccacatggtaacgacttgttctgagccacagtgtgaaatgttccctcaccttggtatttattttactatatttaattgaatgaaatagcagagggttttcccattccaaaaaaaaaaaaagctgaggtagaaaaagtggctgaattttgaaaatgtgtggtataaaattgtataaaagaaagagaaataaacactccaagcccctgtaagcccatttttcttcttgaactgtctgaatgaagtggccaatgatagtctatccacctggtcattttagagctgggagaggtaaggaatcagaggacctctgtccatgctccaaggtcataaatgaaaacatcataaccatggagtagaactgcttcacttaagaaagatgcttttcaaactcctccttgtgattggtgtgggtaagtaccactaatacttgaactagacattgggaatgggattttagagttgtacaggatgaatacatttcatgttgtataatgaaccggcagagcattctattgaggttaattcaaaatcaaggaaaagaattaatgtaaccataaaaatattttaatgatatttcacacaatattaactttgaatgcacaagtcagacaatgtgaatacataattccaactataaatgttgcccagtattaatccagacctcttagcttgataaaatgtatgaatttaattttaatagtcacattgcaatgaaagtcttgtcctgggaccgaacagcatttgatgaaatgtaagaaagtagttcttaaaagctagacatggattataaatataatgtgtgagcaggtcaccttaatttggctgatttgcatgtccatggcagatgacgaagtttccaaggcattgagttctttttctttctcagttatccagacggacagagtctcaaaattactgccaaaatgatcccacttggttttcaccatttccatggttttaatactaaaattaaccaaattaagtaaataaaactcagtattttaatagagaacaacaacacattttccttgaaatcaccaggtgaagagataatgaagacatttgtgaccatttcaaagttgaaactattcacgctaaaaaaaaaattgcacagttgttctgagtagtttatcaggttttcctatcttctctgagaatgaacatttaatgaggcagtatctacactttgagtgaaactgcactttgaacaaaacattgctgggtccaaaggggtttgaatccaggtagaatctaattaaactctgcatgtgaccagttgttgccaggacttatttttataaactatgccagaaaagatttcagtgtacacagcttttcaatagtcctatttccaaagaaatgttcttcttacacttaaaggagagacactgcagtgatgctttctatagaaatacctttataaactgcatcttatcaatcaagacagagctcgtgatctcaatcccatgctgccgggcaagaactgtttctattattagagctaatcctgcgatgtataatctttgtgacttcagccattttcataaatgtcttatggtcctgattccaaaagacatttataaattattgtacatgagcaccctaactacttttagacaacttataggttttatttgtaacaaatctagtgaacagaatttcaactatagatttctaatttgtattagctatgcatgtataaccaggtgactatggctttcagtttagaaaaagactaagaaactaacagtatataattgaactagtaagtccttgggttaaaaaaaaaaaaagtgaaagaatgtccctgtttaccaaaaggcacttgaagacatcaagaaaaatagagtggcatcattgactgtcaaattaaataatattgcagtctcaaatttataccctgaatgtgcctaatgctgtcagcagtacaggtaatgcaagctgtgttatattgcaactttttaaattaaataaaggttaaaatggctattcttaatagaagtaaattcctttctaataaactctgttttactatttccataacttgatagagaatatttaatgtaatataaagtcctcaaaatttcaagtcataatttgttttaaataaaatatgtatcaaattttaaagtttaggcaaatgtaaaatgttaattttaagctgttaatagtattaaaaacacattttacattttaaaacccaccttagaaatgatggcctgtcccttaataataatatgctattatgtatcattgatttgccactaaattatgttaaaaatagaaatgtttagccatattgttttgaataatattggctgtatcctcatatgtttttcccctccaaacttttttgtatattttgggtatataacaggatatcaataggccaagcagtttttttttttcagataaacaaacattaaaagtttaaaaataaaatattttaaagttaatttctggaaagagcatattagtcaggataacttgaataccgaggcactgtaaacaagctccaggagcttcttcaggttggagatatatggtctatgtgatgtgtatttaggcctggaatctacactaacaaaatatctccttttcgctctaaatggtgacagcagaataatatagtaaaaaaattattttaaatattagttctttttcaagattccctctacaatgtacaaaggccacagaatagaatagatatggctttctcatgaacatgatcagtttaagatgcaaaacccacatcctttatattttttgggctctgttatagatattggtttctgtattagcgatactttcttttgaactgtgagttgtttcctcaaaacatgctgaaatacacagacactttgagattttaaaagagtgttttgaatacaaggtacaggaaagattgtatgaaactttatctcagagaagaaagtttaggacttgtcaatcacatactcttcttcaagcgtgtcttctaattttttgacttgttctttgattgacttggcctgctgttgaagcagctgcttattttggggcccaagcggtatctctgaagcttcctttacaaggttctcagcctggactgcaatactttctgtccgtttagaaaactcctagaaaaaatattatgatcattaggtaggcactttatattatttatctctgccctcaaataaagtgcacatattgcatacagaacagatgggtggatgaagacatagagtcatacatgtatggatcttacattgttcttaacaataaatctgacttatttccatatggccaaaatagacactttgctaacagttttttattttatttctttttttttgagatagggtcttgctcttttgcccatgctggaatgcagtggtgcaatcatggctcactgcagcttccaactcctgggtttatatgattttcctacctcaacctcctgagtagctgggaccacaggcaggcactaccacatctggctaattttctgatttttgtacagatgaggtctcactatgttgcccaagctgatcttgaactcctgggctcaagtgatcctccagtcttgacctcccaaaatgctgggatcacaggcaggtgccaccatgcctggctaactttttaattttctatacacaaccagctatttgccttcatagttttccaataatactcacaaaaattgtttctcctttgtttcctggttttgtctcattgtttagaattcttagatccattataataattaatttattcacaaatatgcttacttattacaggccagttcacaaaatcaatagtgattgatcatagacataatagatttctaggccaatgaatagaaacatttatttatttaatgtaatatcttagtcaaaagagactatcaatgatctttggccaggcatgacggctcatgcctttaactccagcattttgggaggctgaggcaggaggatcacttgaggccaggagtttgagactagccttggcaaaatgggaagacctccatctctagggaaaaaaaaaaaagtgaccaggcatgatggtgcatgcctgtagtcctggctactcaggaggctgaggtgagaggagatagaggctgcagtgagcaggcataatggcgccactacattccagcccaggcaacagagcaagaatttgtctcaaagaaaaaagagagagagaagtaatcaagccattttgttaactagttctctgaaaagagctataatctaatcttagtgctgttaaatcttatttattacatacacatgtatcacatgatggaaagagaatataagttttgaaccagtcaagcctgggctagaatccaggatcactagttgtttgactttggtgaattattttcaggctctttcatgtaaaatgcagatgataatccttttcttagaaggttactgttagcattctattagcaatcttacttttaaagtgcctaacactcttggagatactgattattgttttttatgtctctcatacaaacttgaggacaaaatgatttattaagccaatatacttattttaaatattttaaaatagttgaaaatacttattttcaactattttaattgaaaagttgatttagtatgtatgtggctggtaaatattagatgttacctgaattttgtcaagtaattatattgaatgctgaattagaaaaggtaaacccagtaataacctaagtgaagaaaatgtacttggtatctcacttcttctcatgtaagagaatctcacaggaggtttaaattttgatcaactcccttctcctaaatgaataatgtagaaatataagtatttttccaaagtcagcttttcagtaagagcatctcctagaacatagtaccatataagatagagttactaaataatactattatatcttcatgtttaaaagacttaatgttctcatagaaatatcacgagttcggccaacaaatatcagtgttggccaagattgtgccactgcactccagcctaggtgacagagtgagactctgtctcaaaaaagaagaagaaaaaatcaatgttacttcagagaactacgttgcaatttaagagaataaaaatgaataagtacagcttccttatggcatagagatttatagtacactaaaatatggtagttgctaatgtcacaacattaaattctttggataaaagcacccactgttactatatctgacagtcatggtagattcaattgtggagattacaaatcaccacatgatctcttagaatcccatgaatataatcagaagtgaaaaataaagtgttttatttttttctgctagtgtttctcagaacccaggaaaaacatggaaaaagtaatgtttgaaaatgcttatatacattcaattttagagctttttatgtgagctatgtatggaaaaagcataatgcagagaaatcgaaagagcagaatgatggtgataaaaaaacaaaattaaacaaaaacagaataacattgtaaggccttatctctaacttcttagaaaacatatgagtggcaggcagcaggatgcatcaggtaaaaattgactcacattagattgatctgggatgaaacctaggctccaaccttcattagctgagtgacctttggccacatctctctgaattttcctttcttcatcactaaagccatatcttattttcaagattaaacatgacattgctatgaaccctctatcacacacaccagtacacagaggacactcaagtcccttagcataaccattccttagcacaactactcaagggctatcaacttgaataaaggtttgtaataacaaagcaaaatgagcaaagaactacaggagaacaatgattctagattggcagtgagcataggcaattagtaaaatggctctgttttttgaatgaaaaaataacgtagtgactaaagatgtgggctctggaaaaggaccttttggattgaaatcccaacctcactatttagtgatccgcagatcttgagtgagttcatcaccaactttgtgccttatgtgtccttcctcatataacacgattgataatgatacctatttcttaggactgttttgaggattaaaggcgatgataaacatcaaataattaattcggcatattatatgtgtttgataaatgtcacctcatattattacatcaatcccaaagcatagaagaccatggacaaaggagaatttgaataacaagactcaaaagattccatttgtttcaatctacaggtacttaaactgatccaaaggaattagtgcaaatggaatcatagggggtcagaaactctggctggaacgtggtcagaaacatttaggaaattaacccaataaacatctttgtatttataaaaggcacctgatacgtttttaatacacgaaataatttatttattttttaaaatagagatggggtattgctatattgaccaggctggtctcaactcgtggcctcaagcaatcctcccatctcagcctcccaaagttttaggattacaggcatgagccatcgtacccggccaaataatttaaattaaaaattaaaataatgttctatttaaatgactgatgaatatcgtatagacttgaaagagtctgtggtcttagaaaacttcaaaatcctcagtgagtttttaggagaaacaaaaaattagcagtatgggagagagtgaagccttttgcaggtaagaaaacagaaacacaaaggttttcttgctaaaggctagggaagggtgggcacaaggctcttctttctaagacaccggttagttcatttctctactaattcagtctttctataaaccccaaagaggcaccacaggaacttcaatgcttggtacaaattggttggtctgcttagagtgtccaaggtgtttgagcttgtagggttgggttcaccaagtacacctactaaatacggtctgtttgatgccccattggagtctcaaaatcgctacctccaaaatgaagttggtcatcttttcccatgaacaacttctcgttcacatcccccatctcacttccattgtctccgtcagactcaaaacctcaggtatcaacattttcgtcactcactctgtctggttagtttccctatcttcctgtgaactccacatcttttgtatctgtttctgtgtaacacctgccaccccaccgcccttatttatgcccatattaactcccatatgcccatatgcaataacttaaatggatcccatgaccccagtctttcacactttcagtcacttttctacacctgcctaaaaattcatccaaagcccagctctgatcgtgtggcttttccttttaagccttcaacaagtctggctccatgttgcctagaaagtaatgctttaggtcttcaagactctgaaatatgggccaaatttcctttacaaattcatttcccattgttctattttacaacacagaattcctattcagaacacttgtatgctctatgccattccaccttccaaagaatgtctgtattttgctccaaactctactaagttttactgacctttaaggttcagttaaaaaatattattgcctccagatttttttttttttttttttgagatggagtctcactctcttgccaggctggagtgcagtggtgccatctcggctcactgcaacctctgcctcccgggttcaagcgattctcctgcctcagcctcccgagtagctgggactacaggtgtgtgtcaccatggccagctgatttttgtatttttagtagagatggggtttcaccatgttggtcaggatggtttcaatctcttgacctcatgatctgccctcctcagtctcccaaaatgctgggattacaggagttgagtcacagcgcgcggcctgcctccagattttaaaaactctatacacatctattagggaactaaccattttccaatttgataaaaatctttgttttacttcttgatgtttaatcctacttatgttttcattctccaatatgttgaaagaatgggtcatcaataaatagtaagtattgattaaattaacaataacaattaatagtaataatggaggagaaatcattttgtttgttttgctttgttttttctgaatattgggtaccaaggagccataatatacctttgtttgttccagttctgaagataaactttccaaactgctaaaactcaagaagcgttcatgactggaacctgtttgaaaaaggtatcttactactgtttctttgtttgtttcaaatcgctcccattttcttaatgtgacctaaatttgaaaaaataaacaacaaatgggttacaaatgtcacacaatactatcatattttcattcgtttgcaaaactgtcaactttcagcgaattctcatttcaaatttcacacagtcacaatgaatagagatgattctagtatcttctgtaagaatttcttttctctatgttaatgttttcatctacaaaaagagaggacacatggactcagatgatttctgagttttttataatttgtaaagtcttagaaatgtaaagatattacttaaaatgtagataagtgacaaaaaaataaaaaaggcctctcaatctgtctcaaacaagaaaggaagcacagaagaaggtagggagagggacaaggagatgaagagagagcattaagcagttggcaaaaactcagaaacatttttaaaggtaatgtgtcaacatcccaataaagcataaaggtggcataaatgtgtggctgcatggcttcctggaaaagtgaaatggcatgatcaaatttctggattcagaaaagtgtggatgaaatcctggctttattattgatcagtgctgtgtgatacagcacctagtcctcaaactctttcttcttaagcatccacacttgcaaaatgtgcaacttccaatatccatctctaaggctgatgtgatgattaaaagatggttcatgtacagaatttaacacagggctgaaacatcagaggcggtaacaaaggttcgccttggtgttatgaggcacaaccggaagtgaacactgcccagcctctgtttaaatggcccctaacttccggctcctacctggatgcggcgttcctgcctctcccggctgcgctccaggccatccagtgtgctctccagcttccgcagctcctcgtggcctcggtcaggcagccccccttctccctgctgcgcctgcgcgatctgctgctgcacatctctcttctttgctgagatccgctttgtcttttgctagaagcatttattcaacagatggatataaattgtgctctctaaacagctaagtagggacatcaacacccacgcttaacagaagtacagaaaggtgggcccgaaatgtattttaaagctaagattaacagttgaaatggtagtcggttgctatattagtcaaagatgaacattatttataaatattgtatgtttttaatggtaaacaacataaataatttggctttcgtgttttgtgtgcaaatttggagaatatttagcattttgtgcaatactctaggaagagtctggcaaaacaattcatctgacatgattcttcttaaataattattttctgcttaaaaacacaaagtcccaactccaatttttaaaaattatttattttattaaaatgcaaatattaagagatttatggccaggggcggtgcagtggctcacacctgtaatcctagcattttgggaggccaaagctagaggactgtttggggccaaaagcttggaacagtctgggcaacatagcaagaccctgtttctacaaaaatattaaaaaattagccaagtgtggtggtacatgcctgtggtcccagctactcggaaggctgaggtgggagggtcacttgaacccaggagttcgaggctgcagtgaactatgattgtgccactacactccagcctgtgtggcagagtgagacactgtctccaaaaataaatgaataaatatttatttcctaagtatattcggaatggttaatttgctgagattttgtggggggaaattgtcttaaagtaaactttttattgaagtataatcttcaaatagaatagtacataaatctcagatatgcagcttataaattttcacaaagtaaatgcacccatataaaaagtacctggcctaagcattttaaaatattaacataaatatctataatcttaaatttattggacctaaagtaaatggaaacccaaaaaaccatttcacaatgattgagaacaatgtaacaccaaatattaattttttatactcagccattttttagacagagtcttgctctgtcgcccaggctggagtgcagtggggcaatctcggctcattgcaagctccgtctcccgggttcatgccattctcctgcctcagcctcctgagtagctgggaccacaggcgcccaccaccacgctcggctaattttttgtatatttagtagagacggggtttcaccacgttagccaggatggtctcgatctgctgacctcgtgatgcgcccgcctcggcctcccaaagtgctgggattacaggcgtgagccaccgtgcccggcctatactcagcctttttataattattaagtaaatctagaaatcctgaaggctgggattttaaacatacttttaatgcaacttccgtttttatatattacagaatatatatgtatataatacacacacaaacatattatataaattagctaccattttgctactgtgtatcaggttagctagaatttttcattaaaatattttatttgaatcaaatttccatttatattgcgtttaacaaggtatatattccttttatgcaaacatttgtaatgtgcactaccagactatcagaaattaagttgattaaaatagcttcttatcagtatatataccagaatttctttatttctagttctaatctttataagagtgtacactccaggaaggtctagtacttcaagtaagtcatcatttctcaaactaaagtgtgttcagcgttgtaagttgaagagaaagattttaatataatgacaaaagaacagtgatctcaaataggaagcaattggtccatctatgcctttccatctgttttgaaaaggagaatctagcacgttttgtgcagtttttcatagctaaatcaattttctctccacagtattccttgaactttttgatgtcatcaagtcactcggtctggaaatttatgttgcagaatatcctgaaatgtttaatatttaacagagaaagcaaaacccagaagcgccaaattcttttagccattcaactcttccttcccatgccccctcacccactctctcaagccagtggttgtattctttatctctctggttctttcagtagcaaatcaactttacataatcttgttggaagaaagaggcatttttacctggtgatgaagaagtaactgctgtgcttcaaacagattttcagtatccaagatcttctcagcttgttcctggacttctttagagccagaaattaattcttcgagagaatttttgactatttctttgtactggacacagtccccaaaattgcttagcatcttttcaacctatattttcatgaaaaaaaaaaacacgtaaatcatatgctacttgttgaagtttgtataatttttttggtaaggtatgattgacaaataaacattgtacatatttaaggtgtactacgtgactgtgaaatgattctccacatcaggctaattagcctgtcatctcacatatttctccttttgtttttttgtgagaacacttaaggtccactctcgtagcaagtttcaagtatacaataggtaatattaactgcagtcaccaccagaactttttcatcttagaacttaatgtttgtactcttcgatcaaaacccccctgttgaagatcatgtaatcttacatattttaggactgtgcacaaagtctacctcaaccacttgacatataaacacagatctttaacttttattctttctcatattactcagccttattccattatcattaaatttcataatcatttatggggcttgcaggttttattcgatatggtgctctggggcatattaaaaacccattcaacctggtaatcaaggaaggataacaaaactgcatatattatatatatatatattgccttttaggtctctttcattataattgcgtgactaaaacctaattataaaagtgccttacaagaaagtgagtccgtattatttaaaacaaataggaaaacatttgtagagttgaaaaagagaataaaagagtatttgttataaatgtgcttccaatattcctacataaaaataaatataatttacaattttgtagtcatctaatggattctcttccttatcatttccctaaattttgaattttcttgtctaatttctgcttcctctatttcagttttaccaacatcctttgttttcgaagcctatcctttatcttcactaagatcctcctttttacatgttgtcatttgttttccacagaagccttccagtttcttcttcttttatcctatcttttttctttgactctcttctgatctaagtttttccaaggagagcaatctgttctccaaacaagcagcaatgagaccttacgaaaaccacaaactcccaatttcaatataaatcagagcaaatctattgaaataatgactcttcactgtatcttgtgcatccacccacagtctttttttttcttacactggacaattgcaaacacattgtgttcaacattaatttaaatactaaatgaattattatcaaagaaaggggctgaatgtgccacatccatctcttcatacaaatctatctgtaaacaaaatgtgtttttctcctttcctctctttctgctttcactaagtaagtgatcaagtagtggaaaagggtattaatataaattatgcagaagtttaaggcagatgagtgtgtaaaaaattaatgtctgtatgaacattcattagagagagattcttactataagtcctggggcaaaatcatgacagtacttggaagataaagcaaatggccttggtaaatgttagggaaactactgacttctaactttaaagacagtcaattttttttttttttttttttggtgagacaaaatatattacaagcttgtctgtgaataacgacaagtatttgtttgatcttggctcaaagatcaccttcatgtacactaactttttagaatgttgtttttgcttttcctgtcaccaaaagagggaaggaaagagcaaaacaggcaactggctaaatgtggccgttgctttgaaagatggataatcaaaggattgaaataggttatgttccaaaatttgattaatcatagaactattttcaatttgtcaaaaactcatagggaaactctaatttatatataaaaattctcacataaaactaaaatcgtaagcagttcagagtatttttggcttatgtaaattcagcactagagtctcaagcagatttaaatggattaaaaacatgaaggttaacagatgaattgttagatgagaaatctctgtggagaatttcagattttcagaaacagagctttgtggtcattttcttgtaatccattaggccatttttccatgcaagtttctacttaaatgatttcaagaaatactggtaaatatctattctactttacgttcttacattatcttccaaagcacaaacttagatttatataaaaacctggtcagtaaaaatatttttgctgatggtggaagtggccctactggaaatgaagtagatgcgtttgtatattttaatctataaaggaatatagaaaaacattaaaatgcatatcaaagcactaggaagagaatttcactggcctgctgattaaacactgaatattttattattactaagaaccagctattgagcatttactctgtttcaggaactacactatgtgcttaacatacattactgcatttaattcatgatacttctttttagagtgagtatttttaaccctgtgttataaataaggaaatcaagacctagatgttacgtaagttgaaggttacctaggaggtagggtatcacatttaaactctaatcctggatttctttgaccctaagccttattcttagcctccatgatttatcttaagctgaccataaaataacaatgctttttataagagtaaaaacagtggatttgacaagttttatatttcagatataggtcatgaacctgaactaacatttccaataatggcacagaccatacatcaaacatcctcttcatctttcccaacaagcttcatacaaaaaaagcataacaacaattctgtttcaactatggtttctttataaaattacttgctaaactacaaccagaagaaaaagaaccttccagatgcctcactcagaactgtctgtttagagtgtgagtaaatgctgtacctctgacagcagcgtcacaagagccttgaaagagctggataattttgccagctcatctccctgcttttgggcttcattctcagaagaaacttctgtcaaaactttcagcctggatttcagccagctgagggtctcaccccttttggtaacaccatttctgatctcctgaaatgagagaacacttttgatgaacacagtgcaattgtgaaatcataactttccagcaataaaggactcagcctaaaaaggtttgcaggtggagcagaatagagccagacatcattcagcaatacagtgcctgcttagtttactttttgtatgtacttttaacaaaagtccacaagtgcttgaaagaaaactgttgtctattcttgaatcagcttcataattagattggttagatacttatagatatgtccttgatgggaaaaaagatgattctaaaaatactgtagaaaaatatgagacgccacaattggcaactataacatacatacactttgttatctcacttcctttgagctggaaagaagatgatattttgtgaaaaaataatgaaagttctttttttcaaccagctgatttcttttattgaagagtctacttgttgaatattgttatggatgctctaaagatttattttaacttcattaacttacattttctgctgaatttttattagcttttagaagccagtatcccatatagcaagaagtataaatgggagcacagctctaatttaggaagcgaggctttattgataagaaaatgctagaaagactccagggcttcagaccttgaagggctgctgactgagggagtggtgactggagcagcctgtcctccctacagcagttctggggtggctcaagagcaggggtccccaaccagggccactccagggctttgccagggcaaatgcacaccagccaggaaactgttggttccagaccccagtgatctcttcattctaggatgtgaatttttttttgtgcgatgcaagcaaccagtagcaaatgtagatatccttccatatgcataccatgatattgagcaccactagcatttaaggggattgtataatttaattgaaaaagaaatgggccaagggcaatagctcacacctgtaatcccagcactttgggaggccgagcagggcggatcgcttgagcccaggagtttgaaactagcctgagcaacatggcaaaaccctacctctacaaaaaatacaaacattagccaggcatagtggcatgtgactacagtcccagctactcaagaggctgaggtgggaggattgcttaagcccaggaggtcgaggctgaagtgagctatgaaggtgccactgcactccaaacctgggtgacagagaccttgtctcaaaaaacaaacaaacaaacaaacaaacaaacactcaaaggacaggaacagaaaggaaatatattctccccaacagcaactatgtggcaactttgtgatgtgcaagggttaaaaatgttcaaagatgaagactttttacaacattatgtgtctaagagtgagagagtgccatttacagaatgcaaactgtgtttgagcctgaggctctgtggccctggtggggtttttcaggctgtacccacactgatagaggctgaaatgaaccaatccagcttaatgtcacatagaaaggatgcctagagaccttgcccagctccctgatctttctgtgacctgccttttgcatggctgaaaatgtattgtataaaagcatacagtgttcttgttttccatgatgattcttaagtttctactgggttatacgcccatgcatgcaattttccactcaggactccccattagttaaagatgcatttgtggcaccacggagcatgactaaccctcaaagctaccaaggattcaataggaaaaaactctacatgctccacagtaatataaggggacttattttaaagacaattttcaagaacttattttttttccagaaagaaaaaagcagagaaccgttagattctctaacattattcttccactatgagaaattttcctctagcaaataatgaccctgaacttacttcaacggcacgtttaacctctccgtggttggcagtatcgatggcctcacccttgatcccctttaattgtgtctcatttgtagatatccaagatgagaactcagagaatctgaaataacataagcactttcttattaaagggagaacataccagaatgatcagaatatgttttctattttgaattcactcatggaaatttaacaattaagtgattaccaaattgattaataacttttctggaaactattcttttaacatgaagctcatgttaaagggcaggggtggccgcctctatgctcagttactaggggcagggtgatgggggagctcagctaaggaaaaagatgtgttctagggaatgagcacctgaaaagaaggaagggaccacttgaggtctggcctcgtgtgtccccaccagggtgagacacgaacctatagaggaagaagccaccctttagggatatgagattatacagtttggctgtgtcgccacccaaatctcatcttgaattgtagtttccataatccccacatgtcatgagagggacctggggggaggtaattgaatcatgggggcagttaccccgctgctgctgttctcatgatagtgagtgagtgctcacaagatctgatggtttcataaggggcttttcccccttttgctctgcacttccccttcctgccatcatgtgaagaaggacatgtttgcttccccttctggcatgattgtaagtttcctgaggcctccccagccatgctgatctgtgagtcaattaaacctcttttctttataaattacgcagtctcaggtatgtctttattagcaaagtgagaaaggactaatacataaggatattggggagaaagggattggccaactttgcctcaaagagataacatctgggtcacttggaaacaaagtgcctcaccctgattctgactaaaatccattccttttattaaatgaaggatttttgtacgagaacatgagcaagaaatatgaaataagttatttcttgttttgtcatgatctccgaactaacagaattaagtttgactacacccctctctggaggccattctgaggctacctgctagtgtagtccttccacttgtctgggtcttccatgagcttcctgtaggtgctgtcaatggcagctctgagctctttgagagtcacgtgacaggttccaggtgtgtcccttactgggtcccgcactgggagtttcacacagagttcctcgatgagctgtaaccttttctcacagagatgatgaggacctttgtcactgaagaaaacctaatgtgtaataaatgtttttataatccctgtgagaagccacacagtacttctacattttcacagaaaaaccaaaggaagattcccacgcagactaccaaggtagagtaattaagctattatttttcagactcaaaccaaaatattagtaatatcctttatggaacaatgtgacttgacacggctatccacattgtggtgtgggagacgtaccctgtgctctttaattatcttttcactgccttcctggggcatcagcttggtctctcgatccagctcagttctgcattcttctacagaggctaagaacctattcttctccacatcaatcttcagatgaagcaaatgataaggggcttctccttgaagatcctacattccataggaagattcagaaaattaggatgaagttcctgattatgtacattcccaattgaagtggcaaaaaaaaaaacaaaaaccataacatattccttttagggccagtgtgaatgggtcactactttccacacctggtctctctactttgtatttttccaagtaccaggaccacagcaaatcctttcagtctgctgtgggttaggtgtttcctcagtgattacttgatttaattttcacagtagccctgcaccgtatttttttttttttttttttttttttttttggtgagatggagtctcgctctgtcgcccagggtggagtacagtggtgcgatcttggctcactgcaacctccacatcctgggttcaagcgattctcctgtctcagcctcctgagtagctgggactacaggcagcaccaccatgcccagccactttttgtacatttagttgagacagggttttaccaagttggtcaggatggtcttgaactcctgacctaggtgatccacccacctcagattcccaaagtgctgggattataggcgtgagccactaagtctggccagtgctgcacagtattaatgttcttattttacagattacatcattaagtctcaggggtaagtacaaaagctaggattttaccatagatttaaatcataccctttcccctgtatgtgtcccttttgattttgtcaatgaccttgtgaggtaggaggggcagctattatacccacttcaaaaagaaagaacatgaggaaagcttattactgaaaaaaagttttaaaaagaaaagaaaaaaaaaaagaaaacatagcccaggctgctgaccacctgccatatcctcttttccttagatcatacattgagaaacaagcaagcaagcactcaaacactacataacatttcatgttcttttaaatgataaacataagcttcatcattacctttagtcccataattaattttaactaacttctatcctatggcattttaaaggattacctttgaaacagaatactaagatgactgatgagaaaaatgaggtgggcctatggaaagtcccacctagattaaatcctagaggtgtgtgtgtgtgtgtgtaataaaatacaaccttcagttatagtctttattccataatacatttacaatatgatatgcttcaaagacatctaacaaagcttggatttctttaagaatcctttttttaatgaaaaacttgaattttcaaatttagtaatatagcaagtaaaaaggatatttctttaactgtgtttttcttgtgcacagggataattatttagcttatgttactgagatcttaaaaatacacaaagtgagacaacctgatggagagagtttcagctgccaatcttctgaactccaaaactcctccatgtagcgcatgtgaaatatcacctcaaggtagtacacactcacctaaagctagagctgtcttcctcctgtctacctcaaggaagacagccttccatgggtctccactgtgctgcagctacttccagaatctgacatgcagtctgaagtcagcctccatgggacagactcagctcatctcccatggttcttccacagcccatgacacaaaagtcagacggaagcccgcgggcccccgtgtcccgcttcacgctctcctgctttctcccttctgtgctgttgtgtcaccccctgcttactcccatttctgcttcttctgtaaagttctggctcaaaactagttacctgattcgctgttttccaatttccaagtggttccacctccctctttcaaagctttcataaatatatgcacatttggatttatcatatttatacttgtattatttgcaactaattatctcctttactgaactcttaagctcttggggggaagaggggtatgctttgttcatcattgaattcttgactacaaaatgttttcatttatattttttgatcatagctatctcaactagatgataaaatctttggggggcagaaactatacatacatgttttatgatttcagtaggtatacctagcaagatttattcagcagagagaagcttatgaaatgttgctagaataagttaaatgttcttgcaccctggattaaaaaaaaatcaggaaaccaaaaagaatgctcgagtaataggataaaattgatgctgataataaataggaataacacaattctatcatatattatcaggttttatttaagtccagttttttgagtttttaaatgagcgaaatagttacagtgactttccaggaatttctaaatttctcttacatttggaccttaacacgctcaagcttctcccttcattgaggatgcacggtgtctccgtcctgtcctgactcaccttccattgtttgtggagctttcgaacagcttcctgcagcccctgctgctcctgctctggaaggatgtcggtgagttcatcacaagctttcaggaaagcattgagcaccctctgatccagctgactgaaaaactcctgacatggaaggggaaagtgggtaagagtgttggacagacgaaaaggcagcaccaggcacaatcagcctctaagcctccaaacaagcctctcagccagctgctgccctcttgcagacttccaggcacccactattgttttttaaggatgaactatgtgcacctatagttatgaatcagaagccatcatatctgaaattctactagtattttttattttttagaaaaattctttgtgattttcaaatttggtagaatattccaaaaggaatatctcatcttccaaggggagatgccaaaaccttgattctgtagcgatagagcttcggttcccctttggtgaagtcagaagaacagaacagaagccaggactaagcttcataattccacattccccaaccacagtgcttcagggcctgatgcttcatcatgagccattgtcacattcacacatgtgcacacagaagcacacatgtgcacacagaagcacacatgtgcacacagaagcacacatgtgcacacataggcacacatgctagcaccaaattgtgttcttcttcagactcatatggtatttggagatgggaactttggaaggtggttaggttcagatgaggtcatggggatggggtcctcatgataggattagtgcgcttatgaggagggacaccagaaagcttgctagctcactctctctgccatgtgagggcacagggaaaaggtagccatctgcaagccaggaagagggccctccccagaaccctactatactagcacctgatcacagatttcccttctccagaactgtgagaacataagtttctgttgctttagccacccgtctatggcattttgctctggcagtcaagtagataaagacaatacacatgcacatattacatatgactaagtctcacacagtctcaggagtagacatgcagaattattttgtaaaaacggtgattcaaaacaagaagtaccatactgtagaggtgaataaactgaatgagatattttgtgttttgtggtcacagacattaaccctaaatctagtctgcagaatcacaaatacattgcatatatcatttgagagtgtggtttatacaaatagccactgaaatgtcaggaaagataactcaaatacatgttctcagagtgctggttatttccatataccattcatgaacattatgactaatattcccaatattgatattgagatgataaacatgaagatggcttttcatgataaacatgaagatgataaacatgaagatactgggacaagttgtgtatcagccaccagacttcaagtgacacagtatctatactatgatatggtgaatgtataaaatgagcacaaaggacttagctagtcacctcgagttatctgtttaaaagaatctttagttatagaagaatttgcaagctaaataatgaattagtaatttggataacttgaattattctatgactgtctactattctggggacttaggaatggccaatgacaagtcagctcaccaactctcttgaagttctttttgctcaccatatctttgggtctcatacctaaaaagtctctgcttccctgactcatctgcccgctctccttctgtatcagatcagcatgccttttttaagctttcctccaaggttgtttgtccatgtattcaggtcaagtgtcccctaaagggtggactcacagtgtgtctccgcaggagctcctctggatcccccttttcctccaggccctcctgagcaatccgcagtaccttctccaactctgctcgagactcctcaaacttcttcatcaagcgactgttggtttccacatgcttcttccaatctccagttttctttaccatactcttgatgtgaaaaacaatcataatgtgatgctgctttctcattactgaaaggatcattttgttagagggtattattcatttaaaaagcacttggaaaaaagacatttcatcatcatgggaataattaactcttttcaatattaattaatattaggtaaaaaagtaggacaatgattggcttccaaacaccagcaggtaaggcgttttagcaagaccaaaagcacgagtgatggtttcttgtcctcactctgcattttccctggctcacagctctaaagcagggagagcaaattacctgaaaagcaacatgaatatctgcaatctgtctttgtagcctcgtctgatcaaaatgctttaacacgttgctcaaggtcacaaacttttgaacactttgactgcctttctcaataagtgtcaaggttttcttacagttttcttgacaagctaacagttcctataacgaaatgaaaccccacaacaatgttatttacaagacagagtgagagagaaagaaagagagtgaccattacagataataagaacaacattatatagcttttaggcttctaacaccaataagtaaaaccaaaagtatggtggaacatttcaaaagatctcaattttaaacaatcactgaagtcagtgctttcttatataaggcatttaaatgttacaaagagtttttttttttgagatttttaaatacctcatgtacattttattgtcattaagaaaatgatagagcatcaaaagttgtctaggtctgcattcctctagtaagatgataggcctgttgtttattgagagaacaatcatgaaatcaatgaatacatatcaggttttaatgtgactaaacaaattgagcatcaatgcacattcactttgctgaaagagatgcactatatatatatatatagtatatcctaaatttataatatttgaaggtgtacaacctatcagccttattaatgaaatggtagggttcagatcctaataaaaaaaggcagcagaccgatgcacttggggaagacttgcaactgctgcacatctgcaggacaagatgcaatggtgacttacagacacctccacctctgacttgtagcctgcaattgtgattttggcagtagacagcatggaaatcattgagcccagcacaaggcagagggtcattttttggcttgaattacaccatttgcatttcagtatcctcaactgcgttagaaaaatacttcaaactgctcatttggatgccatttttggatatccagatgcaaatatcaagagcatggtttttttgtttgtttgttttgggaaaaacagaataaagacatactttttccttttgaaaacttaggagataaaagggtaatataagtccaaaatgtattattagattttattattaataatgctatgaacattattttaattatggaaagattgtataatgacaacttgtacaaatttagaaatgtaggagatatcaccatgtctaaaaatgaaagataatctctatccaatacaatgagaatgcagtttggtggtataatcattgtggcttcactacagataataataataataatgctatcagtcatatagtgccacttattatatgctagtgacattatggtgtatctaatgtaatatctgcaataagctttacactcaggtattgtagccttcatcttaaagtgaggaagttaaagctaatcaaagcttcctaatttgcaatattagatctaagatctgaatatctgtcagactcatttcagacactctcggctctttctactaatgatgctaccttcctcccatgaacctatgtcaattaatgcagtggcaaaccttttgtacattagtgtctctctcctctgatggacaggttcattataataaaccaaataacccaattaactacaacactcagtaggagactgttatgcatacaatctgtttactaaaaatgagacaaagaaaaatgattatcacatcaaacacatttccagagtttcaaggttgtttaaactgtcatatttcaagaagcaaagtaaagatctcataagtcagaggttatggatactggatgaaaatggaaagcaattgtttttattatatgtatataaatatatatcaaattatctgtctatctatctatctatctgttttcaaagtatcaagaaaagaaggcacgtatgcctttttaagtgaaattaaccatttcgtcaatcagcaaggcagcaggtaatgcctaaagctatgtgtgggaagcaacagtaaatgattctccaaaagaaagtcaatataagaaggaaaatattatatctgtatatataatacaaatatttatatattttatataaatatcctctctgtataagttttatacatataaaatttatatatatttatcttttagttatgtaatgtagagacaggatatttatttaattttcttatagtgtctttctactagcaaacctagggatcacgtttcatgaacaaagcccataaaaagtttaatgtaaataaattcttatctgtatttttaaaaggatagactatatgtggtctattgctagtaggcaggaactctaagaaaagtaaataaatacaaagcagagaaataatagaaagtcctttgattatgggtacccttaatgtttgaagttagagtggcggatttggctccatctctataacacatcccttatttcacagagacattgtgaactttgcactttctgtagttggggctcaggatgcatggcttacgcgtgcacacagcagatgtttataaatgcttgctgagtattgccagatcacaatgttgctccattgatagaaaggggagctgggtgctcaaaacaaaccattttttctaactttgctcaactcagtgaacttactgattcagatgaatgagcctggtttgcacctgagtccagctagaccattccctggaaacaaacagctcacatagcccctgcactgacagtgaatggattttcatctttggacaagacatgtatttttgttttgagttagtagtactattctagaaaaatgtttcttgtcctcactgaatttctattcctgtaagcaacaccctggtcttgttacacatgctttagaataattgtctcctgaaaaggattgttctcacctgatgtttttgtttaaaaagggcactcgattgtgcctcacgctcaagaactgtgataatttcattgattttcccaagtgagtcataaaaggacgtcatctgcttttctaattcctccaacggaatcaacagctgctgagactcataaaggagtggggagtaacattctttgacctttaaaaacataaagacaaaaattccatgaaagaccattaagtgccactagctcagggaacgttcatagctctgaggaacattttctttagtgacatgatcatttggtgcttacaaatatccaaagacatttctttaatgatatttcctctatattgtcaaattttgctgtgaaaaataatagtgctgtaccactgagacaaataaatggctactgagttttctcatgaaaattcatctaaatcgtccatctggatagcactttctcatctaaatgattgtttttagtgagccagatggcatcaaattatacttcataaaccatgcaactcattttcactttggccttgaaatctgacctaagacagtcatgaattattattatattacctagaccaacctgtgtcttccagctttgttttcaagagatcgcctacttgaacccttgactgctgataaacttagaaacctgttgactcactcttcccagacaggcctgtgctttcctgcctcccaccagctccatgctttgctgctccctgcttatcaacatcctactcatccgaagcactaaagtcacaccaatttattcatgaagcttcccatgctaggggagggctctgtagtccaaactgatgcagcccttacctgtcacttgtcttgtaaaacatgttttagtttatagacctgcattgtcttaaagatgaggccactagctcctggaaatcaagagctccaggaggtgtctactcttcatcctccaagaacttcccacctcttctcatactttcagataaccagggaaaggaaattaatcagtatttgttagtaagccattctttgtttttcatatagtataaagacaataatgttctaaccagatgaggcatattccaaaaagtaatccttgaagaaagtgggagagggcaacattttgctctactgttaaacatagaattatgtatgaagaaacgtttttatgttctaggatatactgcctgaagtatacactcatcaaaagaaagttaccatcctgctactgcaacaagactctgatataattaccttgaacaaaaccaagagagtctactaatgtgtatacaaatcagtgtgttttattgatctctcctgggtagaagagaaaacctatcaagatgctgcatctgaaacagtaaaaaggcaaatgacaatttgctttctcaggggttgtcctgaacacctaagcatggctcaggctaagatgtgcaagcccagctatggccctgaaagctgctggggagttatcaaattggaaatgttgacttcaaattgtacttattgtttagcagcttttactagtagccaatattatcattattgcccacaacctttaaattataaataattctaacttgaatgttaaaataaaatgaactgaacataaacattctcatacataccatattgatagataaaattttctcttttttatggtcatgatttttcctattttagctttttgaatgcattctttttcattaattccctaccactgatgtcacagaggttattctcttcctttctacctttctttcctatttaacagggtcttctactttgtttctactttgttttcccattcttcattttaaaatatttccattcatttattataatcacttctctcttttactagaaattaattacccaatctaggtggattttgcaaacaataccatcttcctaaaattcatatttggatagataacaaatcccaatggaacttccaaagctcttaaggaaaatcactgaatagactagaaaatgcttatgactagtgcttacatccatctagttccctgtacagaaaaggtataaatgtatataatctttttttttttttttttttttttttttttgagacaaagagtctcgccctgtcacctaggctggagtgaaatggcgcgatctgggctcactgcaacctctgcctcccgggttcaagtgattctcctgcctcaggctcctgagtagctgggattataggtgcacgacaccatgcctggctaatttttgtatttttaagtagagacgatgtttcatcatgttggtcaggctggtctcgaactcctgaccttgtgatctgctcgcctcggcctcccaaagtgctggattataggcgtgagccactgcacctggcctaaatgtatatattctaagcctaagtgagctccatgagatgaggaggtcagaatttccacagctttgtggctatgcttgcagaaaattgcacaaataagtttggagtggagatatatcaaacaaatcttaaccaattctcatttaaatttatgatcccctcttcttcctcctcctcatctcctttttctctttatctctctttccctctcttggttttatcacatgtaaccgttccccaaaagtatctaactttctattaaaatatagctataatacttctaaattaacagaggtaatacttggtatcagcatcatagttttattttttttaattcatgacaaagttactaaattgagaatcccaattagaaacaaaagcatcgttaacaagtaaacactttgcccatggggagaaggaggtagcaagcaagctgaaggcactgttggtgtcacacagcctattgtgcattaaattattttcgcaccttggttagctgctctttgagctttgacatggtcgcaaacatttcttttccttcttcttgggggctttctttggtaatgaggtgtgctgtctttgtaattatcttgtattgggcatccatcacaggcaccctctgctcaatatcctgcatgaatcattgaaacagccagattcatacatgacacatttcctcttaacttccggattccacagaaggcagaacaaaaatcaatatgcactgtataaaatccaatacttacactaaactttcgacgattccagtttttgcttcccttcattactaataaatattggtaatattatatagttaataaaattttcctttaaaagtgaccaaaacatcaagattagctgaaatgatctttgtactttccaaaacaaatcccatgttaatgtagtatggaaatataaaataaaatgtaaatgtatatttaaaatgtgggggaattctgactttaaaaattagactggttttcgttaaaaaaaaaaaaagtaactcattgccattataaaaacttataaattagaaatattaggataatgacaatttaaattacttatagtcttctcccacagtaaaacccaaagccaacatcttatctatacatcattaagtttttttttcctgtgtttacacccattttaaaatttttacaaagacaaaagaatgatactgttgtttgcttttctcatgtaacaatatattgcaaaatcttaccatgtcattaaaaattcttccactacttcatttgtgagagctgcaggctattcaaaatatgcaaataccacagttcatgcaataaatcctttattattgaaagtatttaggtgcgggtgctatctatagatgtctcctgttttttcctaatactttttaacttggttgtagaaaaaaaaaatctccaaactgagaaacaatttgaagttactttatatgatcaagtcatgtcttttttatgttcaatacatttttttctgacaggtgcaaattgggacatacagacatgtcaaaatgatgcccaggagacacagaaacagcttttgcaatgatctgaataaacttgctgatctttcctctcacaacagagtaggcttttcattttgattcagaaacccctcacctccaagtcttgaattaatagcttgacattcataaaagagacttctaagggttcagaaagtttcttatgggcttccgttgcaaaagcagacagggtaacaacacagtctgtgtattccttcttcattctgtccatctcatcagcttgagcatactgttaaggaaagggaggagggaacatcgtgaaagccatttagctgcgaccactggaaccacaactttcactttcacatattcgctggaattgttatccggtaagaaagactctaatctttgattctcattttagataaatttgaagtaagtccaattagtttgaaagaaaaaaagaaactagcatgaaaatgaagaaatatgatttgaaacgagaatcattccatataagtaggctccatatgtcaacataatccttaatcaaactaatgcatttgtgtaatattcctccattatacatggaaaagaatgaagaaccaaccataaaacacaccggttttaaacatatctatgctttgccttaataaacccgtgctctaaaaatagcattctctctaaacagactacttatcacatttgtaacacatacacgttgaggtgtatatagacttgaaagacatacttgcttgacttccataaacaactccctccaccgcccatttagcaacagtaattgctgcttcaggtcacgggaaaccatctcatcacaggtttcaattagaaaattgccagcatcgttcatggcagtatgctgctgaatccaatgaggtaaatttcgaaaaaaatcctaaacaataaataatgcacaatatcataaaccataaaccaaatatcagtgactgatatgaaagtgactaaagtaggaaaaatatttttgttttaacattcatgtgaattttaagataaatcacaaatctctttaaaatgcacatttttgataaaaagtttcaaaatgtgagctagagatactgtctttttttataagaacaattgtgccatatcatttgccgaagacaaaacaaaacatgatgaccattttctgttatttctgttttacagattaaaaagctgaatttctgtaagtgtaagagacctgtgcataaccttcaggctagtaaataccagtgccagagtcatataaaaggcataatacattagggaaatatatagcttccttttttatttgtataaattgatggggtatgagtacaattttgttacatgcatagattgtgtggtggtaaagttggggcttttattcctttttaaagaaagaatagctttctttaataatttctttttgacctgctacttttgatttttaaatttcagtgtagtacattaagataattagcaatcatggagataaaccatcgaagcaaaaaattttaaattaaatatctgagtcaagagcacttagtacaataacacactttcttatttatttaagggttccctcttggcaatgaaacagtttccaactcattttaaataaagcgtatgtgtgcacacgcacacacacaacacacatcacagtgaaaaacaaggataccaaagataattcaaaatccatttcgtaagccttgtgtgggaggactttcctacatatataaatagattagaacacttctgtttctggtggttatatttcttttgatcaaattaacatgtatgacatccactagggcactgccagtctaatcagaaaagccaaaatctgtatgggtacatagttattgcctccctcagctacacaagaatagttgatctacatgaaatatggaatggtaaaacatttaaaagtgatacatctacttgtccaaacaataatagatgaaccaatcttggatggcatgtggtaattctaatgcatgcatttttagtatcacttacatataaattgattttccatgtaaaaatgccaggctcccattaggaagtatataagcagaaatcagtccatttcatgtgacatttacatataagtgacattaacataaaacagtaactctcacaggcacacacacatacacacttataactggccaaaaaataaatcactcctacccagaatgagacccttgcttgaaggttgataaaatccaaaacagaatatctaacgagatacaaatgtcatggtccagttgttcaactggcgtatgctaccacatagatccagtagtatgtgtttcagcactacgtgaaaacaaagttgttttcatcctctcttaaatcaggaaatccatgaaggctggggccctagacactccccttcatagacagacttcagggtaatatagtgccctcccctttgctgcccattggatttactcaaccctccatcagcttctattaagcagtgtatttattggtctgttgctaacctgaaagtgcaacttttcaggcaaagtcaagattcttgagtgacacttgtaaatatatgcgaccccctagtgagctacgctgtaaaagtctctcatttttacatacatcaaacgtcttttctttttgcatgaaccaatcttacctttttggcattttctgattgattgagcattttttcagcatcctctagccaggcttgcagactagccactgtattgccatagcgatcccagttagagatcacttcttccagcatgctcctcacactcctcacttctactgagagattcctccactgagcggtggtttcattcatgaatttcatcacattctcagcttcttccactgaaacagataaaaccaattataacccttatctcatattttaaatcctctacacctttttttctatggtcttatacattggtgtgcaatagtatccatcacaaatgccagagttcatttccaacaaatatgacagacataattacaaatggaaaacaaatgtattttacaaattgtgtctttacactaattaatttctcatttacttgattggtaatccttaacgtattctatgcttttgcctttaatccttagatgcaatttagaaaatgaatgcttattttgttctctcttagaagaacacatacacacacacacacacacacacacacacacaatgattatgcaggttaggcattgtacaaagccaagggaactgaatccagtatgtgttctcctggccaatggcaaggtcactcaaaaattccacggacagaaagaatgatctgatcagatagaaacctgcaggctctaaattctactgcagtctacgttgcaacaaattctgtagtatgttttacctgaaccatctgctttgacatacatctcagctgtctgtttcaagatctggtatgtcacctcatattgttcaaagaacttgctattttctataaaagactagaaaaggaggaatggttagaagatagcaaacattaggctcatgtagaatgccaaagtcaattttcttcagtatagctataagcacagtttacccaaatttgttaatctcagtcttcttgaaaacataaaattaattccactgctacaaattacctaagatcattctgaacacataaattgattccacgcttttgattctaacccagtacaggactgagaaaatattctatttcttcaccaaccaagggtttgctttttgaagagacagaaatttctccagagaacttgggtctaacatttagaaagcactaaatttagaagaacattttaaagtgtcccactgtgtctcagctgcggaattctgttgctctttgaacattaatcctggtgaatgactgctctgaggaactccagattataaataaatgacggtgcacaaatgcttcccttaaaataaaaagtcagtagaaaaattggaaataattacatattctatccatgttatcaatggtctcacatttcaatgacctattacagaaaaattgcagtaagacatgtttatatatctatttgtaatttatatatataatagaatcactactggaaagtgaatactataaaattgagaatagacaaaaaagttcttaggtaaatgttattattgttcatttttaggaatataaaataatgtgcgtttcaaagattattattacttcttgaaagtagaaaattaatgcaattacagttaagaacatatcaccaaaggctctttaatttcttgcgatagtataatgagttcctatgatttgaatctattaaaatacttgataaatgtcacggtcataaatacaaaattagccttcaaaaaccagctgaattcttgtatagcacgctgatgaatgcttaatatagagatgcaagacacttgtgtgcagaggaaacattattcatgcagcaatttcatagaaatctctggatttttattgataactgttttgagataacattttaaaaattgtatctataacatatttcatatcattttatgtttataaagcatttacttataaattaactattcttcagggataaagtgaatagagaaagctggaatgagaggttccatgatgaatactacattcaataactttaattggctttattttatttgtttgagaataaagtcagacaatagtattctgattaattcactatttagccttatatcttcttattacaacccagttgagaaaagaataatttactagaatttaaattttgaataatttaactaaacaagcaattcattatttgatcaaaaatggaaaattatacctaatgttcaagatactgcgtaagaaattgaagaaataattatatttggcaaagtttagaaaagaatctgcatttagtattggtacaaatttcaagaagctaatagcaaaacaatttttctaagtgtcaaagaaatgggaaatagtgcatgtggttcataggaagacttaaatatgcttttcctagagaagtttacaaaataattaaaaatgaacaagtgagaaaatcttatttccaatttaatttctggtccacgaggcaggaaagaggggagaatgttttcagaaagaatgttttataaatgctgtagacactcattaatgtatttttgaatttggctattaggaagactggatgattaatttttaaagaaagatacctattttgtattttaaatttgtattggtccatttaatttggtcctttttttctgaacatggagtaaatgcatttagcaatatggattattttatctattgaatcactttggcagaactgctaaatctccattttactgtaagctatttagacacacctgtcagaaaaatacaaatgcatgtttaaaataataataacaagattcatttatttctttcaaaatgaggttgaaacttggatcccaagttcaacaaataagccattttaatcaggggacttttaaagttgatggtgcttcaagaaaagtaaatggcatacttatttttggtatttaactttagtgttagtgaccgcatttctactttcacaagatgagtgtaaatataataaatatgaagctcatcaatttcacttgaatgcaactatgccagattattcgagatatttaaaattaacattgaggagaggtttatcaagactatttacattaaaatataattatgaataataaaatgaatattcacactatgttgcattcacacagtccacaatttcaagagctgtttttttttctttcatgtgaaagattgaaatattagcctcttttttccatggtgaaatggaagcacatgttttggtcattgtcaacaattctgacagcaaggactaaaccaattaccttttggtttgcattacagcatgcaatcacttaccaatggcatgtggcctaaattaatgatagaaaggatttgtgaagtattttccaagaattctttaagcactcagtggctgcatatctgagttggatgtacattctctttctctaacacttaaaaaaagtattctttcttttttgcaggacggataagtctgaattgagaattatgactaaggaaaatataattacggaaaatttatggcctgaatattactttggttattagatgatgtagaagcatgtagcttattataatactttatttttatttttatttttttgaaatagggtctcactctgtagctcaggctgaagtgcagcagcaagatcatagctcactgcagccgtgaactccagggctcaagccatcctcctgcctcagcctcctgagtggttgaaactacaggtgcacaccatgacaccaggctaaatttttaaaattttttgtagagacagagtctcactatatttcctgggctggtctcaaactcctggcctcaagtgactcttcaacctaagcctcccaaagtgctaggattacaggtgtgtgtgagctgctgcccccagcccttttttgggggagtgtggggggtgtaaaccaaggaaagaattgcacttacaaaactgactttggtgatttgtgattttatttgaaagttttcagcctctttgaaatagcctgttctataatgaatgattttccataacactctaaaaggataagagaggctctatgaggtgttaacatagaataaaaacagtatatgtcagtctttgttccctagaaaaattcctaccatttcattattattattattatcatcatcattatcattattaaacactggggaaagactaagccttctagaaattaagttattcacagacacatgggtgctcagtagctaaaccatgaccaaacacagttctagtggctggtatctgcacttcatcagttccccaccactacaaccatgctgcctcatatataactaatagcaactatgaggctttcacagtacacttacaggtatgtaagtgtaaaatattgtcaggtatggaccaatattaaattgaactgatatttatgtgaattacattctttagatcactaagacgtaagataccatatcaatgatttggtctgttaagttaaaaattttttttacaattttttttagattgtgatattcagcacttaagctcaagggcttttgatttggaaagatatggattcaatttctgattccacaatttaccacctggagcgtgtgccgccaggagcaagtgacttgagtctatggaacctcagtgctcctgcactggctccttggtatctaaaacaatgtgaaacccccagtctgtagggccatcactgagatgaaaaatgatgcatgtaaaacacttggcatgtgggaaatgctccatactccacggttatcaaaactattaaacaaaattaccttaaaacccttcacagaaaagaaacacgagtgataagtaggtattcttcagtagcagatgagagtactaggaaatgttaattaaagcatgctacgtatgtaggataatcagcaattttatgaatagttatgaaagttacaaggcagtttggaattagtagctgagtgaacttgatgaagtaggcagggagtactaacgtttttatcattaataattgtttattcacatatcatttgagaaaaagagaattattaatatcattgtgttggaacattaacctggtggaatagtcttattagctgtttaaatctgattggctgttctgaaatatccagaacaaagactgtgtctggtataaataactactgggctgagagggtatcatttggcatgactaaatctgaaaatatacatgcatatttgtatttcatatttgaagaactaacgtaattgcttgaagcttaaaatcaagtttttcataactttccaaaacaactaaaaatgagtaaaggaacataacagattttgcattttggaacaaatgtttcctagacaattttagtaaatctagggaaagattttactgtaaagcagttaaatcatttttttctcaactgtatgttgttcacccgtcacagaaaatgaaattaaaatgtagcaaaacagattatagttctaagatgcttcagtgaaaatatggtttcaataagtacttcaagcagaacatgttttagagtcactgtgactaatcaagttacaaatgggtttatattttaaaagatcattgatttatcatagtatttgtgtttaaacataaatgaaacagtacaagactaagatactctattaacattaattttatgagcaaatttgcattgaaaattaatttgtaggatggccatgtttaattaactaagaaataacctgtctttagtatctataatacactaattacatgtaagtgaaaactgctagttacagagcaaacaaattctttcatcaatgcaggtctatgattctagtaaacatagaattatctatattgatagcccaaaatgtgagataatccttaaaaattaagttggtacagagattcatagataaaatgttactcttccagggtgcacacaagaggcaatgaagcccagggaattacggtaaaaaaagacacagtggacacaatctaaaaaaaatagatagttcccatttggacacttgagaatggttctaaactagtcatagttgaattttaaaagacatgaaggtaatctttaagtattttaatgtagttgaaatggtgacctccaataaaaaatgtgggtatgcaatacaaaaactttttttaaaaatcaataaagccagtcaggatggtcccatatgattaatgcagcaaagcattaaactaaactgaactaggggattttaaataatcaaattccaaagaaataggtttagatttcagataattctgaaaagctcataaacttgtatctaacccatttaacacacgctatctttatgtttaaattcaagaattaaaataacaacatcaaagaaactgaactgtgttgctaaatccatggctcataggaattctctgtcaaagcacgggggactcaccacgtagttttgtagaagctgctccactgactctctcctcccgtacttaatgatccaagacttcagctttgactctgcaagaaccagcagtgagagcagacggtactttaattctaaaaattccattttcattaggtgtagctctgatgtggaggaaacaaaatgaaacctagaaataaaacagggagaatttatagaatgtaactaatagtaacagaactgatgcttacttaacctgttacatgtcagccttaaatagaatgcagccacaagctcttctaactctggctgatcattttctggaaatccgattccttttctagctctggatttaaaagcaaagcatgaatgattgaagtcttcgatttagttctttcccctgccaacacatctctcgtctgtttcttttataagctgtttttgcaatattacataatgttccttacagtactgaacaaaaatacagcctctgaagaaaccatttctgtgatttctaggctgtggataaattcagagtcactcttttcagttaataatacattagaatggtggcattcttagcatgtcttatgggagcccgctttctatttaccaaaggtaggcgcctctgttaaaaaaaaatcatgaaaaaataaaagaaatataaaaagcgtccacctagtgttttaaaaagagacttcctttaaatgcagatattctcttacctctcggccatgtcctctaattgatcaggtggcactggaatcccgttaacagacctggtccggtagatttcatggaatgctcttttgtgggcatccgtgttttgaagcagatcctaagatacagtttaaaaaaaaataaaaaatgaaaaacatgtttcacagagggctaagaagcataatttccagcccgcaccgatgagtcaatgtattcaacaatttgatcccgctgccacattcagaggcagcttggtgcctgtcaaaggctcttaccttgaataggagctgggtgcttgtacttaaaacactatgctggaactgcatctaataattatgcatcttttaaacacacatgacacttgcacagcaatgcattcagacgttttaaaggcacatgatccaaaggaaaatgtaattactgctatgaaatgattttagtattttttgcctttctggatatgttggtttttaaaagcttaaaactgagcatgacaaattgaaacctttaatggcaaaagagattaggctttctactgttattttactttgaatgcatgcagactattataaagtggtatttgcttgccatctaaagtaaatcaatcatattacaatatattttgaaatacccttttgattagaaaatttcaaacaagtgcagggaataccccataggtaacacagtgagaagattaaatgtgatgttaataaatattaattatagactgtatagaactccacaggtttgattcatttatttaggttaatttgaatcttctttgatttgtttgctgtgtttttcatcatttacaaactaatttctaaaaagatgtacatgtattttacactccctcaccaatttctcacatagaagcaaggaagaagtcaggtgaaaggagattcatgccttaatttctagagcttagtttgtgtcttgattgcagaataaatacagtacttaaaaatgtgtcactcattgaaaaagtaagacatattagaccaccaaaataatacattaaaattaatatttttatctcatactaaaatttagcaaattagagaaattagtagcaaaaccagcctaaaatcaagagacacacttggtgggacaagtgaaaacttttctattataaattaaaatgttcaggtttgtatatgcttgcccacatatgacattttaacatggtagaaaaaccttagggccaaactatttctaacctgatatattttgctatgatcacattttgacctgctttgactctgaaggtaagtgcagagatactcacaagtcatgtgtgcctcaagggagggtattatgtgaagccaagaactcatcacaggagggtagagaacaaacaggtgttcttagagcagctattgatgatgagtattctagccattctctacctcctttaccacacacagacacattactgtagcttatggttgggctgaaactttcccaagtgactgcagagcacacttggagttatcaccccagctagctctgatttgtgacagtttttaagtatctactatattgaaaaagtctttacaagctacccaaacaaaaacattttcacacatatgataaaagaaattcttaggccgggtgtggtggctcatgtctgtaatccccgcactttgggtggcggacactggtggatcacgaggtcaggagttcgagatcagcctggccaacatggtgaaaccccgtctctactaaagatacaaaaaattagccaggcatggtggcgtgcacctgtagtcccagctacttggaaggctgaggcaggagaatcacttgaacccaggaggtggaggtcgcagtgagggaagatcacaccattgcactccagcctgggcaacagggtaagactctgtctcaaaaaaaaaaaagaacttcaacagttggcatgatgtcactgattcctctgaaaggccatctcactataaagcagctagatgctgggcaaaatatatgattttaattcaccttgctgggttcacaggaagtaaatgaaatattttaggtcccccattcttagtaaaacatgacccaaaaactagatcacagacctgtaggcaaaaaacaaatagacaaatccagattgtcctgggcaaatatctacaccactgctgagagagattgagtcttacaatgtgaacaggatgaggacactgaaatgagatctcctccatttagtcagaaccctcaatgagggctaacatggccaggttattagcaaatgcaaatacaataggaggaaagcagagaccacgaaccacaggaaacaagccaccatgagtgagaaccagcagaaacaacaaacttatcatgctagaaaaatgtcaataatttaatacttgacaacaatgtgtaagataaaaaggacagtggtttggttaaagtattcataattacttatattgattaagagggggttaagatatggctaactttcaattttgttaaatatctaaggtcaaattttgagggcaatcatactgtacaactagagtttataactttcttgctagtagaaataaaaccatggaataagaaaaatgaggaaggagacaaaaagcaaaacctccttaatcaacttataaatagcaagaaagtagaaaagaagaaaaagtagaacagttagaaagcaaagactcagatgctagaaacaaattcaagtatatcaataataataaataaatgtgaataaagtagaaatttactagttaaaagacagagattaccaaattggacaaacaaacaaaacagaactatcttctttttacaaaagatacacctaatcattaagaacatggataggttaaaattaataaaatggaacacatgtcaggcaaatactaagagaaatctgatataaatgcattaatatcagacaaaatggatttcagaacagaagcattataagtacagtcactccttgactcatgatggggttatgtcccaataaaactcattgtaagttgaaaatgttgtaagtcaaaaatgtatttaatacgcctaaaccaaccaaacattatagcttagcttcaccgacattaaatgtgctcagaacactcacattagcctacaatttggcaaaattatctaacataaagccaaattttataataaaatgttgaatatctcatataagaatatcatatctcatgtcattgctgaatgtatattgcttttgcaccactgtaaagtcaaaaattgtaagttgaatcactataagttggaaaccatctataattaattgcataaagattaaactttcaacttactagaaggtacattattcctgaacttgagcatgcccattaaacttcaaaatatataaaggaaaaactgatagaactgtaaggagaacctgaactatcaacatcactgtggggtttatcaacatgcctctctaaatgagatagagcaaaggaagcaagtgttatagcagcttgttgggtaaagaagggaaagggctgcaggaatggtctttataagaacttgtggtgttttgataatggaagccaactaggaattttgagcagattggtgaaattatctcagctgcattttaaggatcactgtggcaattcttctgaaaataccctatcctccatacgtttgcttcccgtggcttctaagacaacactgtagctggatttcctccaacttcactggttgctccttctcagacttttattggttcttctactcttcaatctcttaatactggattccctccaggatcagtccttggtccctttctcttctctgtatatacttctttatttaatttatccagtctcagagctttaaacatccctctagatgccaatgactccgaatttttatctccaagctgtacttcttccctgagctctcttacctattgcttactccacatatcctcttggatgagaaaaagactcaacatgccccaagctgaattcctgatctttcctcccaaagccgcttcattgtctcctattcttaattgatagaaactgttttttcagttgcacagcccccaaatcatagtgtcatttatgactcttcttctttcacggtatgtatctaatgctgaaaattgttctgccctcacaacatattcagaatctgtccatttctcaccatctctacagctacttcccttgttcaaagcactctaactggatgatggaaatggtaccctggcttctggtctccattcctaacccagtctattctcacatagcagccatatcatgaaaatactgtcattcctttgggaaaaaaaaatggggctgggtgctgcagcttatgcgtgtaattccagcactttaggagggtgggcagatcacttgcacccaggagtttgagaccaggctgggcaacacggtgaaaccctatctctccaaaaaatacaaaaattagtcaggtgtggtggcccatgcctgtagtcccaccttctcgggaggctaaggtggaaggatcactggatcctgggaggcagaggctgcagtgagccatgaccacaccactacactcccgcctcggcaacagagccagaccctatctaaaaaaaaaaaaaagaaaagaaaagaaagaaataaaatggatgaaaaaagaaggttagaacattgtggagcaaatcaacaatgccaaagtgtgattaaggaaagtgaggcagttcaaagaaacaatattggggaaatatacataggcacagaaaacaccacaaaatatataaaacaatattctgaacaattttatgctaataattctgaagacttagtcaaatgcacacatttttagaaagtatgcattatcaatattgacccaattgcaattttgagagcctgaatatggggagacaacagtgaaaaaaaatcaataactcccacttttatggagttgacattatagtgcagaaaatcaagcaaaagataagataaatgattaaaactggtaacagttgagatgatgataaatgctaaagagaaacatcaaatgggaaaggggaaggggagtttgggggaagttgtaatttcaaaagaggtggccagaaaagggtggatgaagaggggaccttttagtaaaggccttaaagagatgaagaagaacacaacgggaatatcagtaagaggatgtttcagactgagggatgagaacattccagaaggatggcaagggtaaagacctcaaggtagggaatatgcttgcctgtttgatgtcatcttttcaatgaggcttcactgacaaccctatttaaaattgcaacaacacctaatatcccatgtccttttactttctaacctaaatttacttattttttatatttattacctttatctgcctcctctcactagaaggtaaattaagggaagggatttttgtctgttttgcttacagatgtatcacaaatgcctaaaacactgctttgcaactgagaaagctcaacagatatttgttgaaagaatagggaagaccagaaaggtacagccaggggagtaggaaggaaactacaagtggcacaatcatagcttacccactgcagcctttaattcctgggctcaagcaatcctcctgcctcagcctcccgagtagctgggactacaggcatgcaccactatgcctaattttttatttttattttttgtagagacagagtctcgctttgttggccaggttggtctcaaacttctggactcatgtgctcctcctgccttggcttctcaacatgctgggattataagtatgagccaccatgccttaaagaaagtctttcaagggtaaagggacaactatgtgaaatgtttgtgacaggtgatgtaagaagactgagaactggccattggatgaggaatgaggcaaagcctggtaaacttcacatggtagatggcaagataaaagcttgattggaatggattttagaaagaatgagagaagagaatttagaaagaagaaagagccaattctctcaaagagctttgctgtaaaaggaaggaagaaaattggacagtagctgggaggggaagtggggctaagaaaaagacttttaaagatgagttaatggcagcatatttgtatgtggatgagtaaactccaacaaagaaagaaagagaaaaaaatagagaagggaggaaggacaggaattaccttttggagagagggtgggatctaatgtacacatagagaggttggcctcggcccagagcacagatggttcacccatagtaacagaagtgaagagcgtgtattcgggcacagatgcaattgcgtaggtgggttgatgtggccgtgggagctggtggcaattcttttctgattgcttctattttctcaaagaaaaaggaagtaatgtcatcagctaagagtgaggatggggaggaggtgtggaaggtttgaagagacaagatatgaaatagttgtcccagaaatgaagagggaatggagtcgggaaatgccttctgattgccaggcaccattaagggcccacttgggttagtcatcgcgcctgggggtgtgtttttttccagccacagtcagctacatgtgtgtgggcatgaactaggcaaagagctggctttcaccggcattgtgtttttaccaggacactaaaacaaagtgaaatacggacaaggcaagcgaggatgtggatgagtggggcttttacattgcatttaagcagagcacaaaaggagatggtaaagagaacaggatacagtgaaaaggtggtagggtaacagattatagggcacagaggagatgaagccttgtctgactggagaggaaggtacttgacaaagagcttgtggaggggtctcatttactggtgatgagcattctaggctatgactgtggagtgagtggctagggttgggtgtaggacaggatcctgggggaagaggtcaagaacctgagaggtcatgatattgggaggatcatctctaggttactgaagttattaagaattatgacatgcattgtcatccaggaaataaaatcttcaagaaaggaaggcaagtgacctaggtagggttggtaactgcaataaggatgtgtagcaggtggcagagcctaatggctactttcatgattccttatgactgaaagccttactttgccaaatcaatactaagaataataaattagtcagtataatcactctacaagtatgataagcaatagctttgtggtcacattttaagcctagtgctgaagacaacctggctcatcagctatgtgaccttgggcaagtcacttaacctctctctgcctacactttcctcatcagcaaaaaaggataataatacctatctcacatccgtcatgttaagtgtttggtaaaaatcaaatacttaggactgaaacatggttaagtcctccataatagttggctatggttattgttatttttctagataactgaacattagggtaactggaaaatagaaaagataatacaggtacactatgttttgcagaatacataagttcttacacatatatacatatatacgttaatttttcagaaatagtaaaacaaaaccactggcagaaccattcacaaagtgaactctcggaaacacacctttaaaaaatgatctgaatccaacttgcaaacgttgcctatgcattaagtgttgaaattgtgttatttttttaaaaggtgtgaagaatgaaaaaaaccaagcattgtaactttgatagcttgttcaagttttcttgacaaaaaccagaattactttttagaccaagatgggaagacaatattcccaaacattcttgatcatacatcaatgattcctaaattgtgattttcccaatttattgcatctccaagtgagcccaatataccagcacagaggtgttacatcaaatcgagagactgagttggtgccattgaggaaacttataatttttagttgttttaataagtcaaacttggccaggcgtggtggctcatgcctgtcatcccagcgctttgggaggctgaggcaggcggatcacttgaggtcaggagttcaaggccagcctggccaacacggcgaaaccacatatctactaaaaatacaaatattagccaggcatggtggtggatgcctgaaatcccagctacatgggaggctgaggcaggagaatcgcttgaacctgggaagaagaggttgcaatgagccaagatcgcaccattgcattccagtctgagagtgacaaagcgagcctccatttcaataataataataattcaagcttttcaccctcaaagcttagcttattataggctcctaatatatatttttcaataaatgagaattgattttaaaattgacaatttaattgttttatgagctactttaagtacccatgcccaggcctagtagaagttcctacctcaatgaaaagatcattctaatattcaccttgaacctggcctgagcccctgtcgctgctttttacctttatctctttattacattccttagttttctcttcagtctagtcctttctgggtttttgtttgtttgtttgcctcagataaccattttctccaactcctgcccctctctctctccctgatccacttcatttctggtttctatgctttgttcactagactttggcagagagattgttctagctgtattcttgggggttggcacagggtgtctctctctcactgtctctcaagggagctagaagggctcatgaagggcctgaaatcatatagccattgaaacacacagatagcatgtgcattggccaacttaggactcactcccccgtaggagatactactgtctatagtgtgccttgaattaatatttctacaaactgttataattaactagtaaatagcagttacattgtctggcattttctctgtggtgggacatttaagtcaaagttaaaggtattatacaaagaacaattgtgtagatgcttctcagacctctagattggaggcaccacaaacgcctggacctcgtctgtgcccctcacctgttgccctggagctgaaaacctgcacatagtaggaatatttgctaccatgcctatttgctgaattaacgtatttaattctcaataaatatacattctacatttcatttaaaattctaagttgacttctttagtatcaaatatttacatcaattaaaatagtttcatatgtaggtaacaggtacactagaatcctaatccccaccattatgtaatatactcatgtaagaaacatgcacatgtaccccctgaatctgcaatttaaaaataaataaataaacaaatgccagttaaggtaaaaaaatagtttcaattaagttttccatgaaaaaattattgtgtgttatatatgcttagttgctaatttgctaaagatgttattgtttgtgtaatactattttcacacttttctctatttttaatatactggggtgattcaaaattgacatggcccaggaaactgattcaatcccaggaaaattcttgtgacttgatctcgtatgaggcctgaactctgggtcccttacggcatagctgcccccactttagggcactaaggcacagataagcaggccccgcttttatttgtgagtatctgcacagatgaagaagaccccaaagtcatgcttgcatctgagaagccaaatgacagagagttcagtgtgtgtgtttgtctgcgttggtgattgggggaggagaggagctaagagatcatcagcaactttaaaagtgtctaaaggcactgagtatcagaaaaggccaagaggaaatggaggcaggaccctgagtgatggcctctgcagatcatcaaatcttgccgtggccatctggtttgatgagcttgtctgaggttgagtctgtcaagttgaaatggccaagatcggcaatggcatcacatctctgtgtctctgtatatctagctccaaaagtaaagccccagagaggcataaaataataaaaggcaataaaatctgttgtaaatttgctttatgatcttgtctagaatacaggacagtgtatttccttggggtaatttttcaaaaatatcaataatttggcagaaaatatacatgggctatacattgcccatgtgtagtcaggagtagaaatctctatttttcacatatgcaggaataccccaccacattacagcaaatgaagtatacaaattcaattgcataaaatgcaagattgcattaatgtgatgttaatgaaaaacggcatttttagttaggcctgtaatatcacaaaacacaaagaggaaatatattggaaattataccatatacaactgatcatatactaagtttaaaacatcccaaatgactaagagaccatcaaagcctaaccccaccacttcctacagcctccattccttctacccccaccccacagcaccaagacataagaacttctgcctgccttcctttgagaatggaggcagaaatgaggtctggagccaatggccggccacattattatgtaaatgcataccatctatgcttatcttttgaaaaataatatataacaacagaaataacaaagatagctgcagatgaaaaaaataccacacaggtatggaaaatatctcaggaagtcaacccactggaaccgtcattaaccagtgtaagaaagaaacaatcaaattagagaactctaagaaggtgtgacgtctccgatcatgtagaattaatatttggggcgtccccgccagagcaggttgtaactaggctacctctccagaccacagtagggctgttatgctgcaaggttttccaaccagaatttttaccttatgttgctcaagtttccgttgtatcgtgtttgctgtttcctcgtggacctgttgaacggttatttcctctctcagggccacctccgctctgtacagccaggcacctatggtgcccagaggtgcaggaagagatttatcaagctgtatatgccagtcaaagagctaaaatttaaaaagcagaaaagtaaaatatctttaatacagatggcaatttataaaattgcacccaaataatagtaaagcatacataaagctttaagttaatgatttcaggctaagttaataaatatcaaataagcaaatgtctgtgttctgagtttgacactttagggatggggagaaaattacagttaaaagcaaattttgaagaaactgaaaatacatcttaaacatggaagaatattatcagaagtgtaagcaattttcctcttacaggagtagcatgaagcacccactgattttcagtgtggcttttgctgaaagggaagggatcaggtttggtgacatgcttggaggatgcagcagttatacacctggcacatgtgtatcttggtcgtcggaatgagaatcccattaaaacctcccacgtgatcagaacaagttcagaaaaatgaggattatctaagcagctctggacaaagatgggtttaaaggattctttctataatcctatgattgtctacccttctctccatctcttccattttacccaattctcagacacatttcctagcttactggaaagccaggtgggatgagttgaggtgcttaggaactagcctattctttaatggagtcactagaaaaaatgagactatcaaaaaaaaaattaggctgggtgcagtggctcactccagtaatcccagaaatttgggaagccaagatggatgagatgcttgagcccaggagtttaaaaccaccctgggcaatatagtgagatctcatctctacaaaaaaaaaaaaaaaaaaaaaaaattagccaagtatggtggtacatgcctgtggtcccagctacttgggaggctgaggtaggatgattgcttgagccaaggaggttgaagctgcagtgagctgtgattgtgccactgcactttagcctgggtgacagagcaagacactatctcaaaaacaaaataaaataaagtaaagaatatatggtaagttcaagacaaatattcttattagtgatagaagtgttccaggggtttgaaatcttggcctttaagcatgaagaatatgaatatgaaagatactgagcaattttccttcagattcatgatcagataaaaaaagatgcttgaattaaagaatgcaaaactgtatgtcaacacaggaaggtcattaactgttgatgaaacatgattttagaatacaagaagttgctgtggctctactctggagaatctgctacaagaccagagagtcacctcttctaaaccacccagaaggaagttgtgtaaagtgtgaagtgatccagatggtctcaggactttaatctatcatctagttaattgctgatatcacatagagggaagccaaggcaagaaaatagctgttaaaccaaagacttccattaacttacaggaaaactagacaaggaggcaaagattctcccatagttaagtctttctagcctcagacagaggcagtagaacctgttgccataccactgtgtagaaatagatgatgaaaaatattcttttctaaatttattaagctcagtataactaattgtgggagaacttaccctggaggtcactctatcccaagattgttttaccaatgcttggtcaagtgacaatttaccgtctctgtgtaatggttgtattaaatgttcaatctgtttcctcttcatttcatattgaactctgaagtgcttaaatgactaaaagaggaaaaacagcaacagtatggcaatgagtcaaaaaaagcaaaagcaaaggaaagcacatttcctaaataacaatcttttctatttggataacactcaatatatgttgttgataataataacggtagttatgatactaatagcagctgtcattcatcaagccctgacatagcttgaccctgtgctaagtgctttcttcatattatcctctctggttctctccatcaccctacacatgcattattattctgaagcccagaaatgacttatcaaggacaagtagtagaggtaggactaaagcctaggatttctcatttctagtaaagtaatttgtgtaccagtatatgtttgtcaggaaatcatagtaaacaggagtataaatcttagctaataatcaagatagttgctttacttcaagtaccaaacaatttacaaatagaaattgcatatatcaaaataatgcagaattaaagctgtctagatttgtgtttaagtaagcctgcataaagaggtttactttaggggaccatgtttacatgataatcctttgctttaatttcatggtattaaaatattaagtatatcacagtacagttgacatcaatgtattatatgtagacttaactataagcttaatgctaacattaaaacaatttttaaagttttatattttacattaactaaattaacccatcctaaaatatgactccaaatctaaacataaaatgaaaagataattaaaatgtgcaattatgttacaggagaatggccccacaaaagttagcagataacacaactaaaagaatttcaaaattataaacaaacatgtaaattcacgtgaagaacactggggggagatagtgaactagaattttatctacaaggttttctttcattttctctaactgaatggaattttaaaaataccaaaacataggctgggcacggtggctcacacctgtaaccccagcacttttggagatcgaggcgggcggatcatgaggtcaagagattgagatcatcctggccaacatggtgaaagcccgtcgccattaaaaatacaaaaattagctgagcatagtggcgcatgcctgtagtcccagctactcaggaggctgaggcaggagaatcgcttgagcctgggaggcggaggttgcagtgagctgagatcacgatcatgccactacactccagcttggcgacagagtgacactctgactaaaaaaaatattaaaaaaaacaacaaaaaaataaatttaaaaaaaaacaaaacatcaaatcaacttttaaattttattccacaggattctgagtgaaaaaactggaaaatgcagcatttgctacagattgaaagagatttaaaatgctgattacagaatgtaaagatgaaatgaaattttccctaaattcagatttcagagagactctaaacccatttttatgagactagtgatcaccttcgggctgaaaggaggatttctgttttctgttttcctaagcctttgtttccctcatgaactagcatctgtataacagatagctttataacttggaatttattttttgataattggtgccaaacctaaacctcatcagtggactaaataagtatattcactctgttcttgcaattcttttctccatttactggcttaatcattttttaatggatctcagcccagaaaattttattttggggaaaaaagcttacactgaatttcaaagcaaaagagtacatgcatattaaccacatatttattgctttgctaagtttgacaaatataatattgatgctatcatccacctaaattcaggcatattttaaagatacaattatataaaatcactaatgccatagataaatcttttgtctaccatgttgaagttctcacttcatttgacctttttctgtagcagaaatgactgaaatatgatgtcgagtagaatatattacagaatataattcagaatatactatatttaattttgccactaaaagggactgatgttttacattgggaaaaatgataatgctgcatcaaataaatcacaatttttattaatttttattttttctccaacttttattttaagttctagggtacatgtacaggaagatttgttacataggtaatcatgtgccatggtggtttgctgcacagatcaacccatcatctaggtactaagcccagcatccattagctattcttcctgatgctctccttctcccactcccccacaggccccagtgtgtgttgttcctccatgtgtccatgtgttctcattgttcagctcccacttataagtgagaacacgcagggtttggttttctgttcctgcattagtttgctgaggataatgacttccagttccatccatgtccctgcaaagggcatgatcttgttcctttatatggcagcctagtattccatggtgtatatgtaccagattttatttctccagtctacattgatgggcatttgggttgattctgtgtctttgctattgaaatcacactttgtaaatgggaataaactgtgttttgtgtcttggaagtgaaaatcagaagcagaagtccaattaatgacactgtagtcagactggagaaaaacattaactctgagctcaacttgaatgcaatggtgttggactaggcaggtcgcagtcgaaactgatccctttaatggaccctccaatactcatgttgcaatcctttgttaaattcagtttattttatactaattttcaatttgactcaactctttgttcttggtagatttttgggttaggtgagatctataagatcatgagttctggccgggcatggtggctcacgcctgtaatcccagcactttgggaggccgaggcaggtggatcccgaggtcaggagattgagaccatcctggctaacatggtgaaaccccatctctactaaaaatacaaaaaattagccaggtgtggtggtgggtgcctgtagtcccagctactcaggaggctgaggcaggagaatggtgtgaacccaggaggcagagcttgcagtgatccaagatcacgccattgcactctagcctgggagagagagtgagactccgtctcaaaaaaaaaaaaaaatcatgagttctataaacacaatgactctgcatttgttttccaagtcatctataagactgagttatggaaaagtgatgaagcctcagtgctccatatatagtgtggacacaatgcaacttaagactatctacataagttagaaatacaattattaaattatatgcaaacttagggtaatgaatgttatgtctttaaagacttttctcattaatgtaatttgaagcattaaatggagatcaaatgacatatataaatattagtcaaaaatagcttttgaaaaattcaaaaatcttctccatacaatacctgatatttatcctgtaaatttgattccaccatctgtgctcttgtcaaatctctctcaaattgttctatccaaactttcatttccttaaaaattactctgtcttctctctggaaatgaggagacattacaattttattagtatctgtgcatttatttaattgctgattaatacttgactgattctagaagagacttaatatttagtaagtcccaactgtctctgaaaaatttcctttctccttacccccacctttaggacagtaagaagcaaaagttaactctagaaaagtatcttagttatcttattgaataacgaaattaaccaactccattttttttttgccaagtaacgctaatttaataaagaaaatgtgaccaggagggaatttcctaagtacacaaataataagagtaatagctggagtagaaacacagtcctgtgggttgcttcctacccaaagccattggtaacccagaagacagttctagatgggattcattttgactgaatttgaggagttacacccagaataccattgggtgacttgtctatattactatttaaactgatattaggtattacaatctccatgtggacagaaaacacatttatcttgttcaacacagtattcctagaccctgggaacataatacctattagagatttatcaagttatttggtgaataaatgtatccaggtcaccactcatctcaaaaatgaaaaataaaattgggattttcatacttattttcacaaataatgacaagggccattctataatagcactgatttagtgaaaatatcctaacttttcatcaagatgtagtgtctcataagaatgccaagtattcataatcataccgtacatgatttttcggcatttacaaaatgcaactccagcatctcacttgctgctgacagtgctgtgacacaggtaaaatgactgtcccccttggcaggtgatgtttccgaatggaaagaatgccatttatggaggcaggctaaactgggtttcaaattctggctttgccatgcattagctctgtgagcttggtgtgtcttttttttttttttttttcgttaacctctctactgtcatactacaggatgtactaaagggtgtgttaaatcatcacggaccctttcaattgttttgctgagaattagaggtaatctatgtagcatgtccagtacagaggttgtcacattctcatgatccatgccttctctcactttcttgtcttgcaaaagcagttgtcttctgcctaaacacttaccacattttcccttggataatgcctttttcagaactcggctcaggcacaacctactctaggaagattttctaacccagaagtctgagtgagggcatctgtttcctatgccagtggttctctcacttagtacacactagaaatcatctgaggggcttataaaaacacaaattgctgggcaccacccccagagtttctggctgagtggatgtggggtagagccaaaaatccgtatgtctaagttcccaggtgaatctgatgctgctggtgaaggaatcatatattgagaacacttctctatgatcctgtgacaacctcagcgctaatattcacccaaatgcattatataaagtcagccctctgttttcttagattcaatcaatagcagattgaaaatattcagaaaataaacaataaaaataacaatacagcaataaagataatacaaacaaaatacaacacagtataacagctatttaaatagcatttactttgtgttaggtattatacataatctacagattaaagtatatgggaggatatgtgtaggttatatgcaaatactacactattttatatcaggaacctgagcatcataaattttgctatcttgggggtcctggaaccaatcacttgtgaatatctaggaacaactacacaaaatccttgtcaggcctctgagcccaagtctgcacgtatatatccagatggcctgaggcaactgaagaaccacaaaataagtgaaaatggctggttcctgccttaaccgatgacattccaccattgtgatttgttcctgccccatcctaactgatcaattgatcttgtgaaattctttctctggacaatgaatctcggaagctccccattcagcaccttgtaacccctgcctctgtctgcaagagaaaaaccccctttgactgtaattttccactaccctcccaaatcctataaaactgccccacccctatctacctttttcggactcagtctgcctgcacttgggtgattaaaaagctttattgctcacacaaagcctgtttgttgggctcttcacacggacacacgtgacatttggtgctgaagatctgggacagggggattccttcaggagaccagtcccctgtcctcaccctcactccatgagaagatccacctatgaccttgggtcctcaggccagcccaaggaacatcttaccaatttcaaatcgggcaagcggtcttttcactctcttctccagcttctctcgctacctttcaatctccctgtccttccaattccagttctttttcctctctaatagagacaaaggagacacattttatctgtggacacaaaactccagcgtgggtcacggacttgggaagacagtcttcccttggtgtttaatcaccgtgtggatgcctgccctgatcattcacccacattccactggtgtctgatcactgtggggatgcctgcctgattattcacccacattccactagtgtctgatcactgtggggatgcctgcctgattattcacccacattccactagtgtctgatcactgtggggatgcctgcctgattattcacccacattccactagtgtctgatcactgtggggacgcctgccttggtcattcacccacattcccttggtggcaaatcaattgtggagacgcctgctttggctgctcacccacattacagcccagggctgctcaccacccccttctctgtgtctctacctttctctttaaacttacctccttcactatgggcaagcttccaccctccattcccccttcttctcccttagcctgtgttctcaagaacttaaaacctcttcatctcacgcctgacctaaaaccttactgccttattttcttctgcaacactgcttggccccaatacaaactcaacaatggttctaaatggccagaaaacagcacttttgatttctccatcttacaagacctggatgatttttcttgaaaaatgtgcaaatggtctgagatgcctgacatccaggcattcttttacacatcagtccctccctagtctctgctcccagtgcgactcatcacaaatcttctttctctcctgtctgttccttcagtctccaccccaagctctgagtcctttgaatcctccttttctatggacccatctgacctctcccctcctcaccaggctgctcctcaccaggctgagccaggtcctaattcttcctcagcctccactccccagccctataatccttctatcacctccccctcctcccaccctgtctggcttatagttttgttccacgactagccctccccaacctgcccaacgatttcctcttacagaggtggctgcagctcaaggcagagtcaaggttaaccctcctttttctttatctgacctctctcaaatcagttagtgttcaggctctttttcgtcaagtataaaagcccagcccagttcatggcctgtttggcaacaacccttagatgctttgccgccctagacccagaggggccagaaggccgtcctattctcaatatgcattttactactcaacccactcccaacattagaaaaagctccaaaaattagattctggccctcaaaccccacaacaagacttaatcaatctcgccttcaaggtgtacaataatagagaagagtcagccaagcggcaacttatttctgagttgcaattacttgcctccactgtgagagaaaccccagccacatctccagcacacaagaacttcaaaatacctaaaccacagtggccaggcattcctccaggaccttctcccccaggatcttgcttcaagtgctggaaatctggccactgggccaaggaatgaccacagcctgggattcctcctaagccatgtcccacttgtgcaggaacccactggaaataggactgtccaacttgcctggaagccactcccagagcccctggaactctggcccaaggctctctgactgactccttcccagatcttctcagcttagcggctgaagactgacacagcccaatcacctcggaagcctcctggaccatcacagatgctttaggtaactcttagagtggagtgtaagtccatacccttcttaatcaatacggaggctacccactccacattaccttcttttcaagggcctgtttaccttgcccccataactgttgtggatattgatggccaggctgctgggccctttaaaactcccccactctggtgtcaacttggaaaacagtcttttatgcctcttttttagttatccccatctgcccagttcccttattagatcaagacattttaagtgaattatctgcttctctgactattcctgggctacagccacatctcattgctaccctttcccctgttcaaaacctccttcatgtcttcctcttgtatcccctgcacctgaacccacaagtatgagacaactctactccctccctagcaattgaccacatgcccattactatcccattaaaatctaatcatccttaccctgctcaacaccagtatcccatcccacaacaggctttgagaggactaaagcctgtccaggatcttcaccttatcaaaaaaattgtcttgcctatccaccccgtggtgccaaacccatatactctcctatcctcaatacctccctccacaaccccttattctgttctggatttcaaagatgctttctttgctattcctttacacccttcatcccagcctctcttcgctttcatttggactgaccctgatacccatcagtctcagcaacttacctgggctgtactgctgcaaggcttcagggacagcgcccattacttcagtcaagccctttctcatactttactttctttctgtccatctgcttctcaccgtattcaatattttgacaaccttctactttatagcccctcctacagatcttcccaacaggacatcctcctgctcctccaacatctattctcaaaaggataatgcaactcccccgtcaaaggccaaatttcttcctcatccattacctatctcagcataactcttcataaaagcacatatgctctccctgttgatcgtgtccggctaatctcccaaaccccaaccccttctacaaagcaacaactcctttccttcctaggcatagttaggtactttcgcctttggatatctgtttttgccatcctgactaaaccatcatacaaaaggaaacctagctgaccccatagatcctaaatcctttccccactcgtctttccgttccttaaaaactgtcctaaaagctgctcacacactagctctccctaactcatcccaacccttttcattacacgcagccaaagtacaggactgtgcagtcagaattcttacacaagagccgggactgcactctgtagcctttctatccgaacaacctgaccgcacagttctgagctggccttcatgtctgtatgcagtgacagccaccgctttaatacttttagaggccatcaaaatcacaagctatgctccatttactctacagttcccataactttcaaaatccattttcctcctcacacttgatgcgtatactttctgctccctagctccttcaactgtactcactatttgttgaatctcccacaattaccattgttcctggcctggacttcaatctggcctcccacattattcctgctaccacacctgacccccatgattgtatctctctgatccacctggcattcactccatttccccatatttccttctttcctgttcctcaccctgatcacacttggtttattgatggcagttccaccaggcctaattgccactcaccagcaaaggcaggctatgctatagtatcttccacatctatcattcaggctactgctccgccctcctccactacctctcagcaagccaaactcattgccttaactcaggccctcactcttgcaaagggactacacgtcaatatttatactgaccctaaatatgccttccatatcctgcaccaccatgctgttacatgggctgaaagagttttcctcaccatgcaagggtcctccatcgttaatgactctttaataaaaactcttctcaaggctgctttacttccaaaggaagctggagtccttcactgcaaaggccatcaaaaagcctcagaccccattgctcaaggcaacaattatgctgataagacagctaaagaagcagccagtattcctacttatgtccctcatggccagtttttctccttctcatcagtcactcctactcactctcccactgaagtttccacctatcaatccctccctactcaaggcaaatagttctttgaccaaggaaaattcctccttccagccttacagctcattccattctatcgtttttcataacctcttccatgtaggttacaagccactagccctcctcttagaacctctcatttcctttccatcatggaaatctatcctcaaggaaatcacttctcagtgttccatttgctattctcccactcctcagggagttcgcccctgcccaggattggcagattgactttacccacatgccccgagtcaggaaactaaaatacctcttggtctgtgcagacactttcactggatgggtagaggcctttccctcagggtctgagaaggccaccgcggtcatctcctcccttctgttgacataattcctcaatttagcctcccgctctacccagttgtcccatcaatccccattacaacttctaatggctgctgccctagctggatccctagtgttagatatgagttctaaatttcttttcaaagaatcaatatgtcagtaggttcaattctttgccttctacttttaaacttaacttcctcgtaaagcaaactttttcaattacctgctccaccctgactcatttcaatcacctgctccaccctgactcattccgattacctgctccaccctgactcattctgattacctgttccaccctgactcattccaatgacctgctgtcataaccatttttcctgccaaaccactcaccctgtcactctctttaaattagccaattgaaattagtttagcctgtgcggtctaaccctagccaataggggaaggacgcagcagcaggggccacgtgcatcagggataagaaccccttcccgtcccttgtccaagtgtgtgctcaccattgctccatctgtaagggtgcaaccttctatagaagtaacttgccttgctgagaattaaaaagaaaattttatattcgagtgctatttcttttgtggcacagaaacttcatatataatactaggagtctgggtacaagacacctcttttagtgctctttctcattttttcactttgcatttccagtgttgcacaaggtctcttcttctgtgactcctctacctacatgtgtctacctgctaataggacaggcacgtgcacactagttttccttactcccaaaattcaatttgcaaataggactgaacagcttcctcttcccctcatgacaccaacacttcaccactattttgttttatttttcttattaatatagaagacaggaataggcctcgacttactgctgaaaaaggagaactctgtatatttttaaatgaagagtgttgtttttacccaaatcaatctggcctggtgtatgacaacataaaaaaactcaaggatagagtccaaaaacttgccaaccaagcaaataattacgctgaaccgccttgggcactctctaactggatgtcctggttcctcccaattcttagtcctttattacctctttttctccttctcttattcagaccttgtgtcttctgtttagtttctcaattcacacaaaaccacatccaggccatcaccaatcattctatatgacaaatgctccttctaacaaccccacgatatcaccccttaccccaaaatctttcttcagtttaatctctcccactctaggttcccacatcagcccaatcctgctcgaagcagctctgagaaacatcccccacaaattttcaatgccccaacacttcaccactattttgttttgtttttcttattaatataagaagacaggaatgtcaggtctctgagtccaagtctgcacgtatacattcagatggctgaggcaactgaagaaccagaaaagaagtgaaaatggctggttcctgccttaaccgatgacattccaccattgtggtttgttcctgccccacactaactggtcaagtgaccttgtgaaattctttctcctggacaatgaatctcggaagctccccaccgagcaccttgtaacacctgcccctgtctgcaagagaaaaaacccctttgactgtaattttccactacccacccaaatcctataaaactgccccacctctgtctccctttgctgactcctttttcaaactcagtctgcctgcacttgggtgattaaaaagctttattgctcgtacaaagcctgtttggtgggctcttcacatggacacgtttgacactccttatgtatctttttaatctccatcatctaacacagtgtctggcactcagaatcactcaatatatgattgcagaataagcaataagttagaaactcagttaaaagtagaaagaaatggaactggagcccaagactacaaagcttcaattcttcccaggatgtcttttctgaatgaacaggtgaatataattaaggtacatgttttattatcagttgattctcatgcccagaaaagcattgataccacattcttatgagctcagagagaaaacttgttcttgatgtgtacccaaggtaccagaggtcagtgtggccaccagaagtgacccatctaacagtgagcacaagacttcattgtgagcctgaggacaggctgctcaccaacttctggatttaaaaagcacttgactgccctgaagaggagctatttgttatacaaagtcatctgagagaaaagggttatgttcttaaaataactttattagagcctatttagtaaatgactttctaatggttggaaagtgtctagcagattgcaataaggtgagaaggatgtcgctatttatatactcaacattctcctttctaagagaaaaatgaagtacaaaacaatatttatagcccattagtctagggcttttcttcaactgataactttcacacacattcagaagacgtggcaacctattgcttatatctaaattccaagcagctatactgccagcattctctctactttttctttcactttattgtttttctttctctctcattcactcatacacacacacacacaaacacagacacataagtcacatttacatttgtgtaccatgttcacatatacataacctcatactttatggagcatgatatttaaaaaatttactatctgatatgaaattagttgcttctgatttttctattccaatgttgatataaatacaaatatccttaacctgtggcctagatggaacataaagaaaaacggaaaagctgaaatatgggacatgcattcaataacttggatatggacaggaattcataaccattcattctgctaatatcttttgagcacccatgacatgtcatgaattttactaaaccatgagaccgaatactgagcagaagagagtgaggaaactcagactgacaagctgatcgaatacttaccttgttcattgattctctgctaacattttaagatacaaaactaaacctttattttgtttttattttctgtgtcacatttaaagacaccatacgtagttactgtaagtcctttttattagtgttattaagtattataaagaagaaattaattgatagataccattttataatgaaagattaatgggcaagtccatgggagtagcttagactatcactaacatttggtaacacatatgtatgttatttgttctgttagaaaggaaacgcaaatgatgtgattaaagtattaagagaaatgtatacataaagacaaaaacatgcaagggaatgactaaaatgctacagaatgcaggatgtttgaaagaggtcatcaatgcaagattacttaaatcttaccttaaaattttgtacagaatttgcaaaagatgggaaacctggaagtatttcctaacaatatgaaaagataatatatagaaatataatataaatcagggtcaaaaattatttagaaaacaagaataaaatcaatggaaaggcatccgcctttagagaaataggcaatcatttcaagggtatatttactttaagacattttcatagcttttgaaactacaaaaatattcaactccaataaggcaacatcatttcctagaatatcacatttttaacttgaaatagtcatatgtagctatatattttgtaaacatatctcgaaataacattaaatattttagaaggtaaactatgtaaagaagaggtatatggactcatattactttccctataaatatacacagcacacatgtttctttgtcctcataagaattaagaatgtgttgtgcttcttagggcagtcaggaatgtttgttgcaatggaagaacagatgggtgaaaaaataaatgaaagtttagaaggtgaatgagataagccaatagacctattttatttatttatgactgagtgctaattattcaagaaatatcttaaggggaaaagttcatcagttttattggatgagattaaaaaaacccatggtgatgtcgattttcagtaagaaaatcatatttaaaatggtatcgataaaatacttaattcaaataaaatcacaaaggggatatataaatcaaatacacacaaaaatgaaagcctggtagatatgttcatgccaagaatttttaaaaaaatgaattaagagagtaagagctgagtgacaaatactgagtactttgaggtgagggctcaaaactaatacgcatagtttacaaaatattaaaggttcactagacagaattaggttaccattaactgttaaatataagccctatgtcataacaaaaaaatacattattcaaaatattcagttttagatgtttatgtactacatgacaaatgccactaaaaaagggcgaagcttccaatacattttcctcaaaattaatttttgagataataagcctgaataaatcatatgcatcctctttttaggaaagggatagagggaatttttttaacgaccagaatttattttctggatgattaaagtaacctctgaaaataataaagcttctttagtaaagtatattaaaaagcctatatcaatagattgtgtgtttcgaatctctaaggatttttgcattaaactcctgctcatgagcattaactaaagcatctccttttgtttttttagatgcttccagccactcagtttactaatctggagagatgattaatgtcagagactctaaaacagtaaaacctcagacaccaaattagatataaatccatctgggtaatataaggacttcacgtataaaaaccagatggaagtttggatggattttctctgtgctatatgaggtaagtctaatgtgttttcttatagagtttcttattcacacagcaatattatcaaaacccagcaagccccagatgactccaaaatatttgcatcaatccatgccagcatttgcacatggagtctttgctttagccatttgtggtgctttttagaaacaattactttactagtaataactatagttaagtcacgctggtggccaatgtttgtgccccaatcctggcaaggaacaaaagaggttccctgaacttattgtttttaagaagctaacatatttctatcaaatgccaaattaatttcatttagagacctaggaaacagtagttacctctattttgcttattcttttatgaagtcactgatttctaactattggcgtgatgtctacttgtaagcttttggttatgctccttagcctttttcttctttatatatgtttctaagtctatttagaaaacatattgaccaggtgtggtggctcacgcctgtaatcccagcactttgggaggccgaggtgagaggatcatgaggttaggagatcaagaccatcctggctaacacagtgaaaccccgtctccactaaaaaatacaaaaaaattagccgggcgtggtggcgggcgcctgtagtcccagctacttgggaggctgaggcaggagaatggcatgaacctgggaggcggagcttgcagtgagccgagatcgcaccactgcactccagcctgggtgacagagtgagactccatctcaaaaaaaaaaaaaaaaagaaaacatattttacattttttggttttcttattactcttcattgtcatctcaaattgctctgaaaactccagttgagacctgaacagtgaagacagacagtttttcacacatcttgaaaattccatttcttatttttcctgatgtcatttgccttataattatttttttcaggaagaaaggagaaaggaagaggaggagcaacttctaattaatttaaaattccgcagtgaatccacctctctatgtaattaaaaatagaatacaatactacttcaaaaatattaaaagaatggtcatgtccgttgtttaaaaaaacaggaaaacaggcagtctggtgtcttggagtgtgaaataggacaaactttctggttggagtgtgaaataggacaaactttctacaaggcaacacgaaaaacatttttaaaagcattaaaattttgtatgccctttagcctaggaattccacttctaaagaagaatcttggccaggcgtggtggctcatgcctgtgatcccagcactttgggaggcagaggcaggcagatcacttgaggtcaggagtctgagactagcctggccaacatgtgaaacccaatctctactagaaacagaaaacaatagctgggcatggtgatgtgcaactgaaatcacagctacttaggaggctgaggcaggagaattgtttgaacccggctggcagaggttgcagtgagccaagattgtgctactgcactccagcctgggcgaaagagcaagactccatctcacaaaaaaaaaaaaaaggaaagaatctcggaacaatgttttattacaagattgttcataaaagcattgcttataacaacaaaaattataaattaaaacaagattgagtaataaattaatgtacatacataagttgacctgcagaattctttataatgttcatggaagaagaaaattataaaattgtatggataccataattctatttttattaaaatattgtatgtatctgccatatataatacaaatgttgggaattaacatcaacatattaatttttctctagtataggttctctctagaaggtcaaatacagaaaattttttccttttcctttttttcttgatttaaaaaatttatgacaattaacatatgtaatttgagcagcatgaaaaatgttaatgttatttaaattatttaaaggctgaaaaatctaatgacagtgaataattagaacttttacaaattgcgtcttacttccatatgtttgctgtcaatagatgtaataaaatccaaaagtcaaaattagatttgatcagatcaaccagagcgaggggattaaagatctagatgtgcaaatgctatgacagaaatacaattacttcaattctcagatcactaagatggagttcccaacactgctatcttttctcagttttagtgtaccagcatcacataccttacatttgttattagcaatgctttctctaatatatccaacatacaaaccagaaaaaccctttcctctaatcatcaccccatttggtgatagctttttaaaatcagttggtctcatattaaaatgcattcaaatttaattttttgagaacagtatactcaaaaagctgagtcactgtcattgcatataccagtgatacttgaagaaagcaaatacctacatcatcctcttgcccatcagtgcttgcattgtggatgtcaggataatgtttcagaaactgggctacataggtcataatagatttctcatctggtttatccacatcaacgtctgaaaaaacaaaaaagaaatgtgaataaactaattagcattcattggattttgataatacaagtttggtatctagctatcacaccaaaaacgctaaacgcagaaggaaaacagaagtactatttagaattttggacggggaggagggtaaaccaaatttagtctggatattacatgatgaaaattatattactcagaaagatgacacatttaaacaaacagcgtttaagaaagtagcatatgtgtcatttaaataagacatacagtatctcatgagacagtatctcccaaatgggtgagatacggtatgattcctcatacagtatctcatactagttctattcatactagtgaatagaacacaaataatatgtaaattttagaactggcataaataggaagtacaaaaatgcttacaagtgtgacactgaatgacatatatatatatatacacacactatatatggccaaatatagacaagccccctctctgcccccacaaatttcactttagaagaaaggcagatgccttatattcaatttcctgggcagcctcctctttgtggagcattctctccaaattacagtgctttgagcaatcaagcactcttcgagggaaactcttcgagggcctgagaagccctcaatcactgtgattttgaagcttatagatatttatctaatacaaatggtaaaaatcaggcaaataaattcatacagatttagtaattatacatggaggtaagaatgcataagtaaaacgtgttgtaaacaagtcttttaaatatcaattttaaaggcaatagaaatgattatatcttacagagcaatttatagagcagaaagcaaaccaaattgccacaatgaagtataaaactaatctaatctttcgtaaaagttctttttgattagaggtataatttctagagacttgcaatatagggtttaaagagtgctgcaactcacactatttaaaaggaagcgaagataatgtattctgaaatttgttaaatgactcaaaggtgatgagtcaaaccgttgagtaaaacttttttttcaggaaatatgaaagtggaaagaaaagcaatatttaatacatgatttaacatagtatatgctgttaactatatatgtaaatcataaaataattattataatagcttttggtctacctaatctgtattcctaaaagcttatacatccaagttggctaaataactttttgaaggggaagttctcattaagaaattagaggaatgtcttatatctaggatagccttgtatttaggcaacctcagtttctaatcatcaaagaaaatattaagatcttctggtctggtggatatgaaagaatcatgcatattctcctttcatcccactctaggaataatgtcagctctgatacatcctctgaagtcgatggctggaatatgtgtttttcccttgatttatttttgtgcagaaagaaggcagaaagccctttgatatcctagtgaaagtggggtgggggcagagtgggactcaaaaacagaatcctaaaatggcaaggaatctccatggggcccttcatctcagaggaaacctaactgggtctctgtaacttactcttggaaacacaagtctatcctctttgttttagagctagggaagttcagtctgaaattccatctttaaaaataatttttggtggatcccatgaaaacagagagtagattggtggttaccagaggccaggaagggtagggaggagaggggaaaaataatttgctttcactgtatatttacatttctgcattcactggtagaaatgtccataattgccagcccaaataagaaattatctgtgacatttggaaacttcactttgatacttttgtttcaacataacaacttattagtttataaaagtttatcaaaggcatctaaattgtcttttgaaggcttgaaagagttcactccatttccaaaaagtcttagcactcacgcccttaccaaaaaacgtgccaaacaattgaaatgacaaatattagtcaaacatttgtgaagtttgctgattgacaccaaaacactgcatggttaacaacatttctaagtatgaataatctacatctttcagacctctgagattatatagagtaattatattatcctgtcacctacccctcatacacacacttctaaaactttcattccacccttaagtatattaagtccagttcacccgactgacataccaatgccaaagtgctgtttggagcaatgggatcatattttaccccaaccatggtggtagatatttatccagaagaaaattgatgcaggaaaataccattacttgccacttttctccagctttctggcctccaatagaatcttggaagtcatgtgtatttctgggtttaagacataaaaaccctccgtgttaaggtatataacagtcaatgaatattcagcctaccttcaggatctagcagtcttgggatccccagttctgtttcggcgatagtgaaagcatcctccaaattttctcggttggatctgcctttcactgtctccaagtccaccaattccggtcgaatggcatgaataactgaatgaaaggcaaccccgcttctccaactcttcccaaaatcttttacttctattccagtctgcctttgtgttataaaaacataaaatgatgtcacattctgaatagatacaagcactttcttcaaggcctcatgcaaaatccagtgcttttcaccaacgatatgcagagagctgtatcagttcattgtatttgagaaaaattaagggaaacaaaatttttagggggcaacaagataagatgtcgaaattctggttctatatttagagatttctatgttggatttttcagcaattaagatagttaagttaaagcgtatttttacatttattttatactcaatcccctacagtcctccgctctaccagctgagctattgaaggatgtttacatttattttataaagaaaaatcaatttagagaaaaatgtctgaaaaaattttaagaaaccaaattataaagatgccaaaagtgacagtaattaaccactgtaaatttttgtagaaagagctaacacgtttctaatgggaagcagcactgtgttgtacacaggttatcacagactaagataatgtggctgaatactttcaaatgcagtagaatagacaaatgcaaatattgcaattatatctcaaagtgttcacaaaggaccctgtattccacctaaatgcaaacaataattccaattactccaccaataaaattgtttttaagctcctttttggtaattgtcttgagggcaaagccgtggtggtaaatcttttttctttgatggcggatttgattaactcaaagccagttattaagaaactgaatcaagttggtagccatattttgcccttggaaaagagaagcgaggcaagctcacaatgaatgattttttttcctacatgtaacttatcaattataaaggcagttccgaaaacagagttgtaaagatgattttgagcatcggctgcaccccttgaataagtggagggcctgcaaatatgatcacttaactagggaacattcaatggataaagtcatctagtagcttctttttaaaaagttagtctcattaaccttagagatgtctctaactaaagcaaaaatattgctcaattaatttttactagaatctcaaaattttcatgaaaaaatacaacctgaatggtatgctgattaatataataagtttgtaagtgtccattattattattattatcattattattattattaagacagaatctcactcattctgttgcccaggctggagtgcagtggcacagtctcggctcactgcaacctccaccccccaggctcaagggattcttgcacctcagcctcccaagtagctgggatttcaggcatgtgccacaatacctggctaatttttgtattattgaatacaaaaaatacaaaaaatcaataagaatacaaacattttgtattattcatcatgttggccaggctggtctcaaattcctggcctcaagtgatccacctgcctcggccccccaaagtgctgggattacaggtgtgagccattgtgcacagcctatccttaaattttattgtagacaacttatcattcactttaaaacatgttttaccaatgtacactgtttgcataaaatatattatgcatcattgagcttgatcattggcttcatcaataaatatcctaaaaacaattttatgagactccagaaattgtaaagtaatcttgaatcttctctaattttcaagcttgtctctggtagtacagatataatttttttcagcagacagctgacagtcatgcaggttgaacagtatgtcctttctatctactcatttgtaatccaactctgacttcattttatttttctttgtccacatttcctcatttaaaaatgttttttatcttgttaagccacctcaaattagtttttaacaaaattaagtggggtgtaaataaataattagctaataaatattcaccatgtaattagctatttctaattttcttgaacttatgtattgttttagacattttcaaagagaaatacataatatgcttttctaaatatttactgtaatgaaataattaaaaagtttcagcacattttatttcttctatatttgttgaaaaaatatatgtaggtatgcacacacacacatacacacacactgtttcctattgtaacagttaaagtagtaggtaatattccttaaaagttttagttttagttcaaacctcttatttgagaattttagatatgaaccaaaagaaagacacagcatttaaagaagtgatgaacagtgcccaatttataagcatttctgacctctaatatgtatttacttcaagctgcttttaaataactacatatatgcatatatttatttattttgttaccttactaatttttgtcagaaaatataattgttcttcttataaatgtgacaatagttatgcaaatgtaagatatgctataacttaaagcttttatttctgataatatgtattgatagtggatgaaattagttttagcaattagagggcttaactatcttatgttactgaaatcatttttaaatttatttctcaaatatttttaaactttatacgaaaacagtggatacatcctgataactagtctagtgtttactggatgttttatcatttcccaccatcttcaatcttatgagtgtgatgaacttccaaactagagtcccacgaaatattatgattttaggaataacatcactcatacctcaaaatggatacagattctaaagtcttttacacatgttagataataagttgcttgaaaagtacatactgggatagtgtaaaaagcagtttttagaaaaaattatcaacagtttggtagcatcatggaatcatgtgttcattacagaatttttatggcagagaaaagtcatcgccccaaacctctacaatttatgcagctacaaaagaaatggattttattgcttgctcacgggtggagaaccctcaggcccaggattctggacattggcccagataaggaaagtaaaacttccactgatgttaccaacatataagttgtagcaatgactttgagctgtcaccagactcttgcacatctttgaaacccaacatagcatgcatgaaactaaattaaatgctggataactccaacagcattaaatttgagtttacttcaagctactgttttattaaaagaaaatcaatttgtttttggttaatttaatgtcgtgtgaagcaatggaccacagaatatcaccttgacattattacaaagtttaattgcaatagcatcgtgacacatcagtgtgcagtcaccagtcttctccctgcccagttaagttgtaagagagattagtaatgccactgtggatgcaattaaacagtgttccagcaatgtgggaagggttttttatttcatttctacttcagattctaaagagccacaaagctttgttttcagaaatatatttgactacaacttgaatcatgaaaacatagcccaaattagaaaaccagcaacacactttaaaagttaaacaaaacaacataaactagcaacactaattacatcctttgtttctctttttatttttttatttttgctcttcaaacaccttaaaaatagaactccctatgtttagtacctcaatattttataagtacttgtttacaactattttccagaagtagagaatcaaatttagattacatttaagcatgcaaaacaagataaaaaatgagtaattttacatgttgtttaggaaaatcaaacaaaagcatactctacatgaaaggacttacccctgatcacatcagactacaaaatacttatataatcaactgaaaactccattgaaattgctatgagaaagtactttttgagagcactctttttcttttttctttttcttttttttttttttttttttgagatggagtctagctctgtcgctcagactggagtgcaatggcacaatcttgatctcagctcactgcaacctccacctcccaggttcaagcgattctggtgcctcagcctcccgagtagctgggattacaggcacgcgccaccacgcccagctaatttttgtacttttagtagagatggggtttcaccagattggccaggctggtctcgatctcctgacctcaggtgatatgcccacctcagcctaccgaagagctgggattataggcatgagtcactgcgtctggctgagagcagtcattttctatccactattatcatataaatgtatacacatgtaaatttattatgcctagaggaaaactgaaaactagatgcaaattctcagctcacaaagctagagttgacaaaaaaatctacactctagataaaaaatgagaccaaagggaaaaaatttaaaaactaaaattgctagaaagtttcagaacataaaaaaaaaatgtttttggaatgtgtaccttagttcacacagttcttaaatagaacataatagtctcatgaagagataaccgagtttaaacttcaagtttatttatataaagattatttaataggagcagaaactctaaacaatgacctaaatagaattatccctcatgctactcaaagtttaggattagtcagtttaattaattaggcccaattgcatgaataaagaaaaaattaattttttaagagcattttcctagagtattagtggtgatttgtgtttatatctcaattcaaggcaagagtgaaataagcgctaaagcaaagccattcattcaaatgtctcttcacatttcgcaatcattagaagttgcaattagtaacattcataactcaatttaacggtttcaaatttagacaaactcttgatacttacttgccagctgtgtactgaacccactttaataaagccttcttagcatttccttggatcttggtggtcaccttccgtttacttggtgggctgggagtctcagagctaactatgctgtccacggaggatgcgctgctggacaaagactggagctggggcaggttgctggtcaactcttcaatctgtttgtgagttaacagccagcaaaaatataagcattatctttgttattatttcctcagatgttttacttttccagcaacaaatgagttatgttaacactcttgacattcctgacaaaatgcaagctcttaaagggcatgattgatatcttactcctctttgtacttcccattgcacccctagtgtatcttacatacaataatccatatttgtagaatacatgaatgaattaatcaactaaaacctaatggttagaacaattattctgaatagaatggcaagttcattcctccccttcatgtctaaaaggagtttagaagtgctcctttccaaagaaaaaagaaaattttcctgagctccttctgcaacaatatttcatctccatcttgaggtgctcgcttttcagattgggcacctctgctggagttcttcggggtgtgaggttccacatgcaacagctttgcaagggagaagaggaaattctcctaccaaagaaacaacgtatgtgtgaaaggtacatttctgctaagttaaggatcaaccccaaagatatggcaaatgagagcattattaaaatggccaccatgatctccctctgagacattgcatcaactgaaagaggaactgtagcacaatacctggaaatatagaataatggtccacatcaatccaagaactattgagggtcggccatcagctatatcggtggagttaatgttgactaatttaatctgtttaaaaaagagaaactgtactagtaatgtactagaatattataactcatttaattatgtaacaattaggcctttagtagacatcaataagatttgatcatgcctatgtaatagtacatgggagtaagtagagtgaggcaccgaaacaaacaagcacaaggtttcagtgaaaatttcagggggatttgttaggtgtacaaagtaaaaactataaaatggatttcagaaacttcttttgtttaaagttgaaaaaatataacatgcaggcaattaccaacaaaaatgtcaaacagaaaaaaaatgttattatttatatttagaggttgactggagcttaaaagaaactgcaatgagaagtttaagaagatgcacttactttgaagtttgttaccaaatagcaggtaacttatgttcccttttacctataaaaatcaggagttaagaattctaaaatttgtactaaccggtgatcctctgtgcatggactgacatgaaaaacaaagggagaagataatagatatacataaatcatctttcaaaatcagcattatttgttcaaagggaataaagaggtaggtagtcagtttagaacctgactgtggtaatacgttttaaagaaaaacaaaggaaaggcaagaaatagcaaaacagagcctattagcattcagttccctacttttgggtgatgacatataaagcattaaggagagacgtcaatctatgtacaattgacccaaattattcatgctaatgtttttcatccactacaaagttgtttgctaagtcccaacaaaatggacttacatggttaagtctatctcattcaatttctatagcctaccatcaaaaacatccttttaataattcctaacaaatgaaaacaaataataataaagtacccttcagacctctagctcaataattctcagccaagatttcatgaagtgtgttattaataaaaagctcagatgtttgtacattttttttatttaaatttgtgtcagatgcaaaatcatttcacaaatactttactcttgaaagtttaaatttactagttttacatcacagaggtggagtaaaagctagcacaaaaatcattgtaaatgatttgagatatacctatgggatttttgtctcactggtgaagttcattcatcaggttcaatgacaaaaaataaaaattgagaactggtatagattacaaacttgtatatctacttcctttgaatcaatcagtataagacgtttaagatatctttatggaaaataaagaacatcaatttttttaactttttatgaaagaatctactatgatctctaggatcattttgagagcttcattttacaacttctctagaattttctccacatccattttagcatacatacacaaaaaatttataatatatgctaatatccataagattaatgaatttcacaggggaaaatttcttccttttccttgtgcatcattttttaaaaagtgctattgaatataatttgattatcctacctcgacccagttccaattgtacttgaaattgtacattgttaacatattcaatttattacagaagctaaaggatcttttgcctaacttgtgaagaaaaatgtttttcatgattatctgccccaaaatgtgtttcacaatgagtttagggagcacaggttggtttgtctgtttatttaacctcccatctcttgcaaaatcctattgaacttacaatacattcttagtagcctaggagggtaggatgggcaatagagacacatccaaagagaatgaagaatttccagaagccagaaggaagatgggaccatattgacagataaaaccagagcagaaggatgttgagccagatgttctcaaagggtgattcccagagtcgcagcaagcacgtcacctggaaacttgttagagatatagaatctgagacttcaccttggacccattaaaccagaaactaaggaagtgagcctctggaaagtgtcttaaaaccttcaggtgattctgatgcacattagtgcttgagaatcctggactagaccattgtacctggcccatgtaatctggagaagtctgagttataagacagaggcttgaatggaatgaattattatttgtgtccctccaaaattcatattttgaaatgtaactcccaatgtgattgtatttggagaatgagtctttaaagagataattgaagttaaatgagttcataagcatggggccctaatctaatcagatttttcttttttagattagtctcactctgttgcctaggagggaatgcagtggcacgatcttggctcactgcaacctccacctcccaggttcaagcgattctcctgcctcaactgggattacaggcatgcgccaccacacccggctaatttttgcatttttagtagagatgaagttttgccatgttggccaggctggtctcgaactcctgacatcaagcaatctggccaccttggcctcccaaagtgctggtattacaggagtgagccaccacgctgggcccagtgagattagtgttcttaaaaaagatgaagaaaaactatcatcagagtgaacaggcaacctacagaatgggagaaaatttttgcaatctatccatctgacagagggctaatatccagaatctacaaggaacttaaacaaatttacaagaaaaaaacaaacaactccatcaaaaagtgggcaaaggatatgagcagacacttctcaaaagaagacatttatgaggccaacaaacatgaaaaaaagctcatcatcactggtcattagagaaatgcaaataaaaaccacaacgagataccatgtcacaccagttagaatggcgattattaaaaagtcaggaaacaactgatgctggagaggatgtggagaagtaggaacgcatttacactgttggtgggagtgtaaattagttcaaccattgtggaagacagtgtggtgattcctcaaagatctagaaccagaaataccatttgacccagcaaccccattactgggtatatacccaaaggattataaatcattctactataagggcacatgcacatgtatgtttactgcagcactattcacaatagcaaagacttggaaccaatccaaatgcccaacagtgatagactggataaggaaaatgtggcacaaatacaccatggaatactatgcagccataaaaaaggatgagttcatgttctttgcagggacatggatgaagctggaaaccatcattctcagcaaaataacacaagaacagaaaaccaagctctgcatgttctcactcataagtgggagttgaacaatgagaacatatggacacagggaggggaacatcacacaccagtgcctgtcacggggtaggggactaggggagggatagcattaggaaatacctaatgtagatgatgggttggtgggtgcagcaaaccaccatggcatgtgtatacctatgtagcaaacctgcacgttctgcacatgtatcccagaacttaaagtataatttaaaaaaataataaaaaaaaacaatgaataccaaaaaaaaaaaaaatgaagagacgccaaagattgatcttcctctctacactcacacaaagaaaatgtcatgcaaggacgcaaagagaagggaactgtctacaagccaggaagagaagcttccccagaaaacaaccctgaggcaccttaatcctggacttcttgcctccaaaacgctgacaaaataaatttctgtagtttaagccacccagtctgtgatactctgctatggcagccaaagcggactaatgcacagctcacagatgtttaaaaaaatatttgagaccaggcgtggtggctcacacctgtaatcccagcattttgggaggccaaggcgggcagatagcttgaggtcgggagttcgagaccagcctggccaatgtggtgaaactctgtcactactaaaaatacaaaaattagctaggcttggtggcgcatgcctgtagtcccagctactcgggaggctgaggcaggagaatctcttgaacctgagaggtggaggttgcagtgagcctagtttgtgcctctgcactccagcctgggtgacaaagcaagagtctgtctcaaaaaaaaaaaagaaaagaaaagaaaaaaagtaaaaaatttgaattatttggaaataaatttcaaaaaactctcagtaaacatccatgttactagcttttcttcataaatttgaaaacttaatgaataaatccattactgctttccactagttgctttctacaatgaggtatcaggtacctcattctcaacaataatgcaagtagtcaactgcctgccttatttaatacacaatttaaaggaattttaaacattaattacattttaataaaagtccagacaactggctcttctttgtaaattagaaaaccagggatcacagttcttgcagttcactgaggttactttagttggaactatttgctcccctcttccagacaggacgcaggaccactcagttctcctgttaccacagttagcctggaactcacctcattcctttacatcacctttctggacctcacaggaatctgaatttatgtcccctgtctgcactatgatggtcagtggttggctctctgtattactgtgctgaatgatctgcctgacacctcattggagaaagaaacttgtggcaaatggtgatgaatctgttcaccacagtcacatttacacatttctcatcagattcttacataagttttttcaatagccctgcaaataagagaaaagctaaggacactgttagggtttccccagtaaaatgaggaataccttcattattccctaagtcaaactaaataagaataaaaggattaaataaatgtcctgttatcaaaagaaaaaaaatccaaatggaagacaaagtcagtacaaagatcaaagacaaatttctaaaaatatgattgagacataagttttaacttgtaaagatcaatgctaagataataagtgggagggcactaaagaaccctccaaaactcattacttcccacaggcaaacattttgtgaggccataggatacagaagtgcaagagagtgtggccgacaagaatgtttcagggagatgtggggaggaggtgactttaaaaagattaagagacttgtggggaaaaaagagaaattctttcattttgttctgattctcaagacactacttttggtgcttagcaaatatatttaaactttattttttttactttgggttgttccgtgaaaatggacattgtgaaaacaagtcttctttataaacaatgcctttcataggtgaagttgttaaagttttcgccaaggcttccaagttaataagaggaattttgtttttgtattccagccaatcaatataactcagaatgaagtaggacactgttgtcatacagctgaaatgggagaatgaatgacctgaaaaactctatctttattttttatttttattttttttaagagaaagagtcttgctctgtcgctcaggctggagtgtgatcacagctcaccgtagcctcaacctcccaggctcaagagatcctcccacctcagcctctcgagtagctgggaccataggcgcatgccaccacatctggctaatttgtttgtttgtttgtttgtttagagacaaggtctcaccatgttgcccaggctgatctcaaactccagggctcaagccattcacctacccttccctcccaaagtgctgggattagaggtgtgagccactgcatctggtcctgaaaaactctaaatatcctgtttaacaaggcttcattcagctttcaatgaaaaattaatgaagggtgagcagaaagaagagaaacccttcaataagaaagagattagtgtgatctggaaacactgcctgatattgcataagaagctaaaattgttttgcacactatcctaatgcctggaatctctcttgggcatgaaatttgcacaattgactgaaatgtatactgattcattgcattaccaacttatcaacaatgtagattatttaagggctagaatctaagttttctgtaaatttgtattttctagagttcctgtcttatagaaagtcatcaattatgcatttgtaatctaattaattcagtgcatataaactgagaaggaaataactgaatgggtctattttctaggagtatctggatctccatttataaaactagttttggtattactaagcacaggcttcctcaattcccacaaattagaaaaggctaaatgtaagaggattggtgcaacccttttggagggaaatatggtaatatctaccagaattacatgtgcatttaccttttgacttagcaagcacacttctagaaatttacctaggagatacacctccaattatatggaagcacttatgcacatagttattaactgcatcattgtttgtgttttaaaaatactagaaacaacccaattcccattcataagagagtggttgaataaactatggcatatctaggcaatgggacactgtgtaactgtaaaaatgagtagagaaatcactatgaactgatgtgggatgatttccaggacatattgataagtgaaaaaagcaaaatgcatttatggtatgctatccttcatgtaagaaagacggggatatatgaaaacacatcttatttgtggaaaaaatgcaaaatgtatgtcagaaactagagagactggttatctaaaggtaggaaatgcagttagaggcagggaatgagaatggagtagtagggatgagaaaggagtttgacttctttaaataaaacgtttattattttagaaccataacaatgtcccactctttaaaacaaataaaatcgaccaggatgggggtggggcacaaaatagaacacaaacaacaacaaatgaacctatctctataacagataatgacataatcccactgacggggatggggaagaatagaactaacctaagaacatttcaaaaatagttttttgactggatactgtaatgctaaagacaaaaagaactacacacaaatcctgttctctagtttgtaaatctgtttctcacaggggcatgggttagtgacatactagatgtgtatactaggtgatatagtttgtatacatgtccccattcaaatttcatattgaaatgtgatccccaatgttgaaagtgaaccctggtgggaagcgattgaacaggagggcgagttcttatcaatagtttagcaccatccctcttgggtaccctccacacaatagtgagtgagttctcgtaagacgtggttgtttaaaagtgtgcagcacctcgccccttgctctcttgctcctgctctggccatgtgacgtccctgctccccttctccttccgccatgattgtaagcttcctgaggcctctccggaaactgatgccagagctatgcttcctgagcagcctgcagaaccatgagccaattaaacctcatttctttataaattactcagtcttgggtatttctttatagcatgtgagaatggactaacacactagggttgaaaaaataagtaaatatattgtagatgagagtaagccttctcattatcagagaaagcagaaacaaggacataaggccagagtaaaacttgcagtgtttaacttgaatcagaggtattagtctgaactaatgttttacccacacgtgcgagaagctacatatgtatatgtgtatatacatgtacacacatacagagatagagagagagagaggagagagagagaagcacagatatatgtatatatatgagttaataaacatatacaattgaacaatgagagcacatggacataggaaggggaacatcacccacccgggactgttgtagggtggggggaggggggagggatagcattaggagatatacctaatgctaaatgacaagctaatgggtgcagcacaccaacatggcacatgtatacatatgtaacaaacctgcacgttgtgcacatgtaccctaaaacttaaagtataataataatttaaaaaaagaaaataaataaataaacatatacattttctaatctatttgctgagagggcctaggagaaatgatgccccagtagcaatgaaatacttagcatttagatcttggtttctaaatgccactcatcactaaaaggaacgaagcctctttagagaagtggttgattccaggactggggagggaaaatttaagaaaaacctggaatatctgtagttctagcaaataaaaatctgcttgaaaaattatgagccaatattaaaaaggtacaggtgcaagcctgaaggagctcttagcggtcaaagctagaacaatttgagtgacaaaataataacaatgagtataatgatgaattttaactacgtaacaaaataaatatacatgtgtccctactggaataaataattgaataaataagtaaattgtgggggaggacatctttttcttacagaacaattccaattaataaatatagaaggaatgaggaaaacagaaaatcattaggcaagtagcacagaaataattattgaaggcaatggatactaaaatcagtgagcaaaagtttgaggaaaagcagaaacttagcatagtctcaattatctctcctaagttatttcccaactataaagggaaaaacagtgactctaccataggaaagcatggcagacaccacattaccaagtattcaaagttaatgtaaccagtaataagacatatcagcaccctacatttactaatatggtgcactgggaagaatatgacatcactttcttgggactttttccaaaaatgtctaaactcaacctaatcacgagaaaatatcatacaaactgaaattgagagacattatgcaaaataactgaccagcagttatcaaaagtgtcaaggtcatgaaagacaaggaaagaatgaagacctgtcatagaatggaagacacaactaaatgtaagatgtgatactagagtgggtcctggaacagacacagacaatagagggaacattgatgaacttggactaatgtctatgttttagttaatagtatcatcccaattttaatgtccttactttgataattgtattatggttatgtaagctcttaacactagacactgaaatgaactgtagaaataaaatttcttttttgcaacttctccataaatctaagagtattttataatacaatgatattgtatgtctaggctgtatagattacatgccatcctcctatctgactacagataggagccaatactgaaaacataagtatgcccacaccttcttccttgggcattttgtttttgtttctctcttacctttcttccttcgaggaacttgagtgccgtgccaatgttagccacagcatggattcgcttcatccggcgtccttgttcacaaggctgtaaaaagtggggtaaaaaagggaatgagacaaaatctgcatattaaaatgttagttataagatctatttaaatggattaaaaatatacttgaagaatattcaaaagcaaccaacattgttcactttctataaaggttagcaaatacataaaggggtgttccccatggcactctgaagatatactaattcactcaataagtgcattcattctcagattatctgttaatgcatttgccttttagtcttctgtatgtctaagagcagaaattatttactgagacctctgttagacacgacacagtctcatcattggtctgtgcacagcccatttatttagcttattagttaattatttttaaaaatgtaaaacacacccagaacctgcaacctaaaacaaagtcaggacccacaactaagtatgaaagccatatcccaaaatatgaccaccattaatcccatcctcctatctgactacattgagggcacccgtcatactaactccagtctagtgtttgccattttatagagattcatttctttcacacgctttcttaaaaagaatgcttagtttttaattttatatgaagagcatcactgtattaatcatttgagacctacttttccacattatattgctaagattcatcatatcattgcctttcactgtatttcattcatttcaaaagctacataatgtgctatttctatactcttcttctgatatgaatgtgctatttccaggttattgatattttgatatgttgatgattattcttgtacttctcaccttttgtacaagcacagtttctcttggacatgtacctgagagtagaattgctgagtcgaagggaatgtgacttccatttgtaaagtaatatcaaactctcctaaaatggttgtactactttttattctgatcagcattgcaaaaataatcctgctaatctgtatcctctccaacatttgattttgacagataccttaaacatacttttttcaattgaatatatgtaaaatgtatatgtactctttttcattgcagtctccatttacatttccctgatcagcagcaatggggacttctcctcctctgttcattggtgatgtgagtttcttctgcaaaatgccttttcacatctgttgcccaggttttcctttgggttgtttgcacccatattgttttgaagatgtattttatatattcctgatttaatccttttacaacatgaattgtgaatatcttcaacaagtttgtaacttctgccagttgttttaaaggtttttaatttttaagatagtcttaattttaatatattaaatatagcaatcttttattgtcaatatttttgtgtcttattgaataattgttttcctatccctgtgtctaaaacatattcacccatgttttctaagagtttagagtgttactgtcagtaggtccttaattcatgtagatttaatttttgtataggccatgagataagaattcaattttacctttttctgctagaatgaacttaatttcctgttccattttttttaacttcaataacttttagggtacaattggtttttcgttacatgaaggaataatatagtggtgaagtctcagattgtagtgcacctgtcactcaacatttagtttttgatccctcacccctctcttaccctcatccttctgagtctccaaagtccattataccattctatatgccttcgtgtacccatagcttagctctcacttacaagtgagaatatatagtatttagttttcaatcctgaattacttcgcttagaataatggcctccagctccatccaaattgctgcaaaagacattatttcattctttttttatgactgagtagtattccatggttgtatatatatcacgttttctttatccactcactggtcagtggccacttaggttgggtccatatctttgcaattgtgaattgtgctgctataaatatccgtgtgaggtgtctttgaaataatgacttcttttcctttgggtagacacccagtagtgggattgctgtatcaaatggtagatctacttttagttctttaagaaatcataccgtttttccataaaggttgtattaatttacattcccaccagcagtgtataagcgttccctttacaacacttccatgccaacatctattgttttttgactttttaataatggcgattcttgcaggggtaaggtggtatctcattgtggttttaatttgcatttccctgatgactagttatgttgtacattttttcatgtgtattacttatttgtatcttgttttgagaaatatctattcatgtcatttgcccacgttttgatggtattgtttgtcttttttcttgctgatttgtttgagttccttgtagattctgaacattagtcctttgtcagatgcatagtttgcaaatattttctcccattctatgggttgtctgtttactctgatgataatttcttttgcttgcagaaactttttagtttaattaggtccatttatctatttctattttagttgcatttgctcttagggtcttagtaaaaaattatttgcctaggccaatgtctagagattttcttctagtttttttttctagaatttgtatggggtttcaggtcttagatttaagtatttgagccatcctgagttgatttttgtataaggcgagggataggggtccagtttcattcttttacatgtgactatccagttttcccagcaccatttattaaataggatgtcatttcttcaatctacatttttgaatgctttgtcaaagatcatttgattgtaagtatttggctttatttctgagttctctattctgttccattggtctatgtatctacttttataccagtatcatgctgtgttggtaactatagccttgtagtataattcaaagtcagataatgtgatgcctcaaattgttctttctgcttaggattgctttacctatttggggtcttttttgcttccacgtgaattttagaattgttttttctaattctgtgaaaaattatgttggtattttgataggaattgcattgaatctatagatttctttgggcagtatggtcattttcacaacattgattcttccaatctatgagtatgagatgtgtttccatttgtttgtgtcatctattatttctttcagcagtgttttgtagttctccttgcgagatctttcaactccttgattaaatatgttcctagatattttttgcagctattgtaaaaggaattgaattactgatactgatattattctcggcttggtggctgttgctatataaaagtgctactgacttgtgcacattgattttgtaacctgagactttattgaatttgtttatcaaatctaagaattttagaggagtctttagggttttctaggtatccaatcacatcatcagcaaacaatgatagtttgacttactcttttccaatttggatgccccttatttcatttccttgcctgattgttctggctaggacttccagtaatatgtttaaaagaagtggcaaaagtgagcatccttgtcttgttccagttctcaaggggaatgttttcaacttttccccattcagtatgatgttagctgtggatttgtcatatatggcttttattattttgaggtatgtcccttctatgactagtttgttgggctttttatcattaaaagatgctagattttatcaaatgctttttctacacttattgagatgcccatatagattttgtttttaattctgtttgtatgatgtatcacatttattgacttgcatatgtcaataaacacttagaatgacacataaacttcttgaatacctacatgaatattcacataaagattcctttaaccttcaagaaaatagcttaattcaggaggatatatctaaatggccagttatatcaggtaatcaagggagtatgtatttcaatctaatgactcccacaacctaatgcttatctagtatctttagctaatgcatatgcctatatacattccaaattgcctgttcatatatgtctagcttgattccttccaaagcagagcttgagacaagcacttgggtgcatgtagcttactagggaggtgatcccaggtggcaagaatgaggatgtgtggagagcgagatggggaaggaggaaaagctaacaaaggatgtgctattgagggttactgctattggcaactggaactcagtcccactgatgactctatgggaactctataagacatgtgtaaaatatgcctcagaatcacctgtctcagaattaccctgtaattttagggtggagcatttattcatagactcccatatccattggttgagggtcccttggtactactaactccccaacacttcaaagctgctctgtgcaacttgtgcctttaagaaaagccctgaggcagaaagccagacagatactacgagtgcttgaagaaagaagctgtcagagtatatgggaatgtctaccactgatgtagctgagatgagacatggggtgccagaagcatctgctacctgggaatccaattacttaaacgactgatgcaaaattattaccagtttatgtttttcaacaaacaactcttacaaaagctatttgagggctccctgtacaaaatgaatggaaattaattttgaagaggtaaaaatcctcttttaaaaactcagttatccaagtaataatgattgtgtcattattgccaagatacaagtgataaagaaaaaatggactttcaattttggactctgtgtctagtgtgttatccaacatcttgaaaattatttcctgaattcctttttccaaattatggtaaacattatttataaataatttatgtttacaaactacttaatgctctactactctgaaatgaaaaagagataagcaagaagagataatttattatttgacaatgtagaaaatgtactttctagctcactgttaatgttgtttttcactctgctggctccacagcacataaaaacaactctgaacaggctgttcttgctacaaatgatggatgatggatgatgtcaacaagaatatgaaaaatgccacactggtttcctgcttaattttcaataaacaactatataaatacacagatatggaccaacatttctttctaaatggaagacaaacacttaaagtgaggaagatggtaatttgcaactaatcttcttgtataccgtatagatacaatggttaatcatgttaagttactgatgaagttctttactcttaattgtaaggttgttattataaacataacattttaaatgcactaggggtttgcaggaacaagaagggaaatatattccttgcacctagaagtagaagtgccagcagtgtttccagtatactaccaaccacgacaaataactttcttttacctgggcagcacatcttagcactctcaactccatagtccccaaattccaaatggaaacaatttgacaagtatgatcacacaaaaaaattcttaccagtttctgcccagacaggacctccagaagggcaagcagtttaacaccatctttcatgtcttcaaaaagatcgtccaccaccattggaggtttccgctgtaaaagcaaagaggaataagtgcagaaaatatctcttccctctctgtttctctctttctctctctcacctttgttacttatggtggtgaaatttgtaggagaggcttctatatactttaattctttattttggattgagttgccaattgcctttcgataactgtgagaagaaaaacaatccagtggagataaaactcgatattcaaaaacctcagaagatttaatgcttgagccttaatgtatgtaccagcttctttctagaaagtgatttttgacaagggcaggatggtgtgggataagggaaggaaaagaggatactatcaacctaaaagataagagagagattatagcaggacgtaaaagcagagcaagagctgcatggaccaacctcagcttaactttgtgcaagacacattactggggcttaacaaggtgcagcccttctataggacattctcaccacagcaacctcattagctcagtgacctgctagaggagcactgtcagcagagctaaggttgcaggttcaatcttcctgtgggttagttagctgttatgttgtgttctacagcctggtgaatctagcgaaccttctttcagtgtggcattgaacccaaaagatcataagcacaaaagtacagaccgatcagtgcaaatctatcatcgctgctggaaaaataagccaaagaccacctttaattcatggagcatcttttatttttttatgaaggttattaaaatactcaatatatgggaattcatcaaacattgaattagggtctatcttggctcaggagaaagtaaagaagccattatgccaatgttgatggtcaatagaggggaggtgttcactgatttatcacagaatcagaatttgttttccatttagcatctgaattcaaactttatagctttctgattcttactgaatcttgttaaaggcctaatgctcaattcctgactttcaatgttctttctttctttaaaaaataatgtgttctatgtaagagatttaactccaaatgtttggttggaatgtaactttttttctctaccaactgatgtagagcatttatatttctcttacaactgcatgaattataatgtctgaatagtacaattctaagttaaaatgtatttttctctcattataaaatgaatagctgaatacattttgttctcatgctgtgaaatacatgttcaaaaataacagagttttcatttttgatcattctctttcaaattccaccattcacgctgcttcttacttacatagcaaaaatgtaatagtgactttatattctaagcatataaataaaattcatcagaataaaagaagccattacaaagaaaactatttggtgcaataagaatcaaaattattgttattagccatatacggtcattaaaaatgcagtctatttatcattcaaagtaaccacttgtacccaaattatttaaatcaagcaaaacaatgaggaacaagttcataaatgtttgatacattcagtgagcaaatgcaaataaaatttttcatgcattgttataaatatgcaaaaagtaaggaaagcagggaattctcataaaataataaagatttcaagaaattttgcacccaaaaatgataaaatgcacatcttcatctgtttcgattttaaaaatacacaggtgtctgccactttgaggaacacgtcctctcacctcacttctgcctctcttctttccctcctctgttgctactcatgctgcaggtgctttccttttccctccagctgttccctccacaaggctcctggaattggccttccgatcagcagcgacagctgaacagctcagcagcctactggcccctctgcatgggacattgccaataccattctctccctgatctgttcctacccaaaactctgtgaccagactgcctagttcacagccctttctctttctttctcctctcttcttcctaaccatggccattcaccactcaatcctgagtcctttgttctttacaaatttttttctgcttatacatgactcttaaatccaggtaagcgacctctcctaaactttgtcaaacatgtggcaggcacttcatatctattgctggcttgctggctgactgactgactgaatgaatgaatgaatgaatgtaaatattgtgtgaagccaataaagagactttattacaccagaataaaaaaaattagtaattactggacaagttttgccatccagtttgtataaggtattctttatatataccaaacaatcagttagggggacctttactatgatgactacctcacatttaatttttggaacaatattttaatagaaaatctttcagctaaaatatttctcctgtcacatgtacaaatatttataccaccaatatggtgactttgataagacttgggtcatagtgctgaaggtcaaaagggagagttagagatgcagataatttattggatcttgacttaatggaaaataaagatgtgacttgagctggcttgtgtccatgccagtatatgttagatatgttagtacatacgatgcttctattattacgtttttagtctttcttaaattcacttttagaagttaataaagttagtgtttctagtacagtagcaggcacttcagctgatcagtcagtactttttctattgataataaatatgaattacatttatgggtttgtgtattattcaggaaaaattaatgttaataccatcatttttatactaagcttcctgtctaacaaggtgactcaaagtataaaatcctgggctctaatccgagtcacttagtgtctctgagattcagattccttgcttttaaagagaggatggtgttcccataggtagtggctgtgaatattaaacaagatagcaggtaggagtccacagaatagcactcagcacacttagatgtttaacaatattttattcatttttcttctcttcctattttattatctttctccttttatccttatgaaacactcactaaatttgagtaatatctaagtcatagaaatacctactaaatattggaatttatatattgtatgtagtctatagaaggactattttgtcataattactttatgcatgaacattttttatttcatatataatacttaaatgtgagaacttcttaaattttcatttcatactgtatgtgagtggcctgagctgggcccatcatattctctgcttgggtccagaagatgtctgggattacattgtcccatggcagtgacctagggactagtgtcatcaggtcatgctgctgaggtcccaagagccattctgactgtccttctcacaactgggttagtcagtgtgttgggggctcccaagaacactttcaggcttgatgattcactaggactcagaactcagaagtgctgctgaactcatggttacagcttatgacagcaaaaagatacagattataatcagcaaagcaaaaagacacatgtagtgaagtccaggagaaactatgcacagtctttcagaggtgaatgacctctcccttcccagtggagtcacatgaggatgtacttatatttcctagcaatgacatgtgacaacccatgtgaagtgttcccaaccagggaagttcccccaggtcttagtgtccagggttttactggggggtctatgacatagacaagcaatatccatgtgactgacctcagctactcagctccagctctctcccacaccctcaaccccagcaaaaaaaaagttaacccaaatcacattattagcataaaaagatctatcaaggtggtacagtattgccaaggccccaggacaaacaaaaactgatgttcactataaatatagtgtggctcaaggtctcaggcatagaaaaccacactactggggcagaatattccaagggctcagattatctcccagaagccagccaaggtctattcttaaagacaggcccgtctttggaacacagcatctgagcaccgcaggcctgctgagttaagtctgtcttgcccagttggcttttccttctcatactttgagacaactagtagcctttcaatagctctttcttcttggttaaatcatctaaaattaattttatttacttgcaacaaaatgaggcacaactgacgtgtctaatttcttagtgtgtaaacactattctgagtgtaacaatttaaatatcagtgtctccccactcccactcacataagtgaccaaaagtaaatttgttctgtaaaacagaagtgcatatcttcagaagaacctaattgtatggtttttttttttttttttttactaaaacagtccccctttatgtgcagtttcaattacctagggtcaactgtagtctgaaaatgttaaacaaaaaattccagaaagaaacaattcataagttttaaattgcacactgttctgcatagtgtgatgaaattttttttttttttttgagacggagtcttgctctgtggcccagtctgtagtgcggtggcacaatctcggctcactgcaacctctgcctcccgggttcatgccattgtcctgcctcagcctcccaagtagctgggactacaggcgcccaccaccacacccagctaattttttttgtatttttagtagacacggggtttcaccgtgttagccaggatggtctcgatctcctgacctcatgatctgcccgcctcagcctcccaaagtgctgggattacaggcgtgagccaccacatcccgccgtgtgatgaaatcttaagctgtccctgcctgggacatgaatcatccctttgcccagggtattcatgctgtctactcaacctgacccacctgcttgtcacttcatagttgtctaggttatcagatcaactgcctcggtatcacagtgcctgtgttcaagtcatccttattttacttaataatgaccacaaagtgcaagtgtactgatgctgtcaatttggatatgccaacaagatgctgtaaagtgtttcctttacgtgaaaagatgaaagttctcaataagaaaatgaaaaaaaaaatttgagattgctaagatccatggtaagaataaatcttttatttgtgaaactgtgaaaaaggaaaattggctgtcacacctcaacaaaagttacggccagagtaaatgataagtgctgagttaagatggaaaaggtgttacattggtgggtagaggacatgaacagaaatgtgttctagtggatagtgatcaggttcagtactgtctgtggcttcaggcatctactggggactgagacatgtcccttttgaatgtagtttaactttttaatttttaaatgtgctaaaatacacataatataaaatgtgccatgttaatcttcttaagcatacagttcagtagtgttaaatatttccacattattgtgcaactgatctccaccattttcattttgtgaaattgaaactctgtacccattaaacaacaactagccattccctctgcccttcagcctctaccattctaccattctattttcttttgaatgattttgactactctggatacctcttataagtagaatcacacagtatctgtcattttgtgactggcttatttcacttattataacgtcctcaaggttcatccatgttgtagcaggtgccagaattccatcctttttaaaggctgaatcgtattccattgtatggatataccacatattttgcatccattcatccatcaatgggcatctgcattgtttccattttctggctattgtgattaatgctactatgagcgtgagtgtattaatatctcctgaagaccctgctttcaatttttgtagatatatacccagaagtggaattgctgaactacatgttaattctatttttatcttattttttgaaaaactgacatattgttttacatagtggctgctttgtggaagaatagaaacctactttgaaacattactagcatatcatcactgtatgaggtacaaatttctacaaatcttctacaatcttagaatccgtattgaccaatatcatgcagctataaagtagattttcagtattaataatttagtatttaacaaagaaaatgataaaatcacctgtctcacaccaggaccatctaggacctcatttgccatcatccataatcacttttagtcttctagtaaatggtttttacttttgagaaaagagctctcaaaacattttatcatcaaaaaaagctacaatattttactttaaactactaaacacatatcctatggcttaatatttgtgattgctaggtacctagtgataccaataaaactgaaccagaaaatgcttagaagaatagcgcatgccacagttaagtatttacttcagttgaggcacacacactattgagcacagtcagggttgctgaacaggatgaagagtcatgacctgagatagtcacaacattttcttctgcagagcatgtagggaggtctcaaggcaagggttgactctccatgtgcattctgtgcacccttgaaacctctgtgcacagaacgacccataacttgtagaaccagataaaccactacttctggtttatataagtttcaggtaggaattatttcacaagctaagagattgtatatgtagaaaaattcccatcccaggaccagtctggagttttgcatgctctgatgattatcttctgggtgggaacagcaagttaaacaacagtaatatagagaagtgggaaggaagagaggttaaccagcagatatggagcaagtgacctccccaaaggttggcaaagaaccctccacagtatatgtatcaaaatgccaaagtatccttggaccagatcaagtaaatcatgattataaccactgacagtagtcaaataaaattaatgtccaacaggttttgtcattttattcagcaaatctaattgaatgtttccaatatcttcagaaacaaagtgtagtaatttaaaaactgtatgtgtaatctgcttctctttcactgcctttgtaacagcactgttgtgatcattttccacttctgcttggcaaaggtgggaaggtccttcccattcttttttgtttcctgtgacagatagcataatcctttccacttcctcgattatttaattcaattccgaataaatattccaaaggcaataattgccctccagctcagctttaaatctgcttggaaaactcagctctcaacaattttcagatgtaataaagtttgttttactatatagtataaaagcattattgtaccaagttatttatttggtacaagttggggttacccttgactcctctcttttgctcacactcaatatctgattcatcaacaaatcttgttggcttcattttcaaaagtcttccagtatccaaccacctctcatcacctctactgctactatcttggtccaagtcaccagtaccttggccagatggcttcaataacctctaacttatctccctccttctgcccttgcttctcttcagtctacgttcagcagaagagcttcttgatcttctttactgtccatctcccccattaggatataagcttcataatgagatggttatttttttttctgttttggtcactgctacattttcagcacctagaatattctctagcttattaaacagcattttaaaatatttgttgaataaatgtatgataaataaaatatatttctggttgggcacggtggcttacagctgtaatcccagcattttgggaggctgaggttggtgaattatttgaggtcaggagttcaggaccagcctggccaacatggtaaaacctcgtctctacttaaaatacaaaaactagctgggcatggcggtgggctcctgtaatcccagctactcaggaggctaaggcaggaaaatcacttgaactcgggaggaggaggttgcagtgatccaagccatgccactgcactccagcctgggcaacagagcaagactctgtctcaaaaaaataaataaatgaatgaatgaatgaatgaatgaatgaatgaataaataaataaataaaataatatatttctaaagaaggaactttgacaaatattaatattagcaaaatgtttattagtctgcataaactttgtgagatctagatctttgttatccataaactaatatattctataaataaattaacaaatgctattcattttgaaatgggaattttcctttataacattttaattacatatttggaaataactaatttattagaatgtttagggttgacaaattaaattattttttccctggctttattaagatataattgacaaataaaaattgtatatatttgttatataagatgatatcttggtatgtgcatacattgtgaaatgattaaatcaagctaattaacatatccatcatctcacctacttattgtagcttgagaaaaacaactaaaaaattatttgggggggtgaattattgcatttaccttttcctctttgcctctttatcttcctgtctgagctcattaatagtctcaccaaaatgtgtacaaggaaacagatgggagtaaaattctattcggaacatgtttccatgttatctttcagcactgctggtggaaagacaactaaagaagatgaaagccaccactaaagtgatattttatgactataaagatgtcatttaaattcatgattagcatggatttgtttttagaaaaaacatggaaaatccaaaatgttccttttaaaagactgtatgcatctaacttggtattaaaacaaaatgtgctcttaatggaatctgttataggttgaattgtgcctactcaccagagatatgctgaaatcttaaccccccaaaatgctgcagaatgcagccttatttggaaatagagtctttagagaggtaatcaagttaaaatgaggtcattagcatgggtcctaatccaatatgactagtgccctcacacagtggtgaaatttggacacagacatgcacagaggcagagactgaaataatgcagctacccagagacttagaaggagcctggccttcgagtctccagaactctgagataacaaatttctcattttaagccacccagtatgtggtactttgttacggcaatcccagcaattaatagggaacctaaataatgttttataaattttttttctgcagtttttctgaaaagtgagaagatgctcatatcatgcctgagttcatcccaaacacagtatttaaaatgttcagtgccttttgttgatggctccataaattttaggctgacagaaggataaaggactgctcattctatattgaaaagaagctccatttatagaaacactaaaacatggctatttgagacctatttttcctcaaagggcttagtgacaagcaatctatttatctcacagtcaaatatcataagattgaatcaagggtgtttaaataaagatacaatattccattctatttgataaaatgagagaaaatatgaaactgcaagcatttgataatagaaaataatcaatataaatattaagattgcttatacatgcctaattttaaacatctaactttttacaaagggtttttaaagattgttccctttgggtggctgaagtactaaataactacaacagtctatgaattttatataaaatgtaggaattttttaagatatattttaaaatgtgaaagaactatttttaactgtcaaattttaaatatattcatcgtaacataacttctttgcctaaaatgcaaggcctatgctgttaggcctaagacatccatggtcattaggtgagaattccttcaaatttaagtccatgccacctctgtcttcatctctctgcttatcccaaagttagacacagccacacccactttcctattcccaatgctagtctcagagaaggggagatatctctgctctggaacaaacctacaccctccacctctgctcttgatttcttctctcattctgcctcctcgggcgccttgttccttcagaatcccattcattgccttctttttcagcctctccctctctacaagctcttgatcattcccttctatacagatgcaggctcatgaccaccctttattaaaacagcttttaccaaatccaatgttctgcgccaatatatatagtaatatatatatataactatatatatagtatactaatatatatatagtaatatatatatatttatatatatactatatatagtaatatatatatttatatatataactatatatagtaatatatatttatatatatatacaatatatatagtaatatatattaagtgtactaacatccttacctctcatttactcatcagctcgctagagtctagtttctactataacatggccactcccaatggcggccaatgacttccaaactgccaaatcgaatgggttcacctttaccaactaatttctccttctaaactgaatttcctagctttccccccaagcctcttgtattccctatatctgtgaataatctcaatcatttgctcaagtcagaaatctagaagtcattcttgattccttcccctccaagattccaattaattactcagttctatcaagtccactcctaaacatcttttcagtctatccatttttctccatttaagcttagaactctaagcttctggttcataatctacaaaataataaaaataatgcattttcttgtgtgagggttaaataaataagagataaagttgctaaggcactgtaattggcacgtggtaagaatttaggaacatgttttctcaataagtgctgataagctagatgtgagtcagaaacttgactttgaaaaaccatcactaaaaatcaatattgggctaatttaataaaatactccaccttctttcattaacagagctaacagaatagaaagatactggtttcttcttgaaaagtgagaaaattataggttcaatgtctaacaatagagccccatccctgaaagaaattatcaggtatatgaaataacaacaacccgccaattgttaatgttatatcaacaatttgtgatttgcaatgttttacataattggagaagcattaagacttcaatttgataataaacatcaaaaaagaacagatatttatacccacaagttttaatgatctaacatttgtgtagtaaaaatagaataaaaacacaaacacagaaaatccttaggtttttttcttacttataataagatttttgttttaagaaaagcatatttttacttataataattaacaaatgtaaaaaagaaaaaataataaaagcatgttttaaaaaacagattgcaatcttatttgcatactatctcttcttattgctatcataatatttataaagaaatgttacactagaataaaatgtcatcagtaaaagattttttatttaattaaaagtcaaaagtatattaatttgcaactgagcaaagcagtcaagcacaaaaataaaaattcctattaaaaagtgcccctagatatacaatcgtgtcatctgcaaacaggaacaatttgacttcctcttttcctaattgaataccctttatttctttctcctgcctgattgcctaagcatcttctgaacagctcccagtgctcccaagatagaagaactttaggagaaaaggatcaacttcctttcttctcaactaaacatcccagctcttaaacctgccactacctattattaaagctatatttggaaatggtaaatttaactcataaacggtttggttgtcagtttatctgaaaacattccaaagcacagagctatgtatacctggattaccatgcaaggaaacatcaaacatgaaaggggagacaagctcatcactgccattattccagggttgagttccaacctctagctattaaaaactttgaagggtgttttaatagtgcaaggaaatggggattcttagaagatcttagaatatattaaaatcataattgtgcatagctgttgactacctacttctagaaatttatcctaagaagaaaatatcatacaagtgttcaaacaacgtataccaggactttcactgtagtattttatataatatgaaacaactgaaaaccacctaaataaccctccacaggcaactggctaactcatcacagataaacatgacaaagtttatttagccattacaataattacatagttctatctattgtcatggattgacgtgttgggtgaaatagaggctccagaacaatatcctataaaaccacttatatgaaactgtgtgtagaaaagtgttgtccaatatcttaatgatgactgtatctggattatgtgatataagattacttttactttctttacactttctaaaagtttcattattaatattattttcaattacgtaacctctgtacactatgaaaaaataataactcttttcattttgaaaaaaaaaaacaaaaccttttccccaatcgatgacaattccatagtacaaatagctgccagatgggaccaacggaagctttaaaaaataagccccaaagtcatcaatcctatgtatccactgcctttttacagagcagattgtggggcaactactgggccaaattcccttctcatcaagtgctgtggggaagagagcataggaaagatgaccctggtttatcctatatctagacaggtcgctctaggcttctttcatggctggattgcaagcttctcggggcctgggaaagtgttttactaattttttcctgtcttcaaaggctagcgcagacacaaagtaagcagtgaatctgtagaatgggactaaaatcaactgtcatgctttgtttgcttctgcgctatcaaaatggctttggggaagcccctgatcaaaacctgcttgtagggttgggctttacatactacaggcaccactctcagcaaaagtgagaataaaaaatttgaagataaaattgttttatcatctaattcatttaaccaattattgacttgaagggagagtcaacataacttccactatataatcatatagactactcctttaaaaattatcagcaaatcctctaactgaattcagacacaattgtcccatcatctgaatttatttttacaaatatgatgtctcttggcttgcttattttttcatcagcagtacaagagattaattttattatactgtatcaagattaagatttattttatattagcatttatgttcaaagacattataatatatagacatatagtcacctaatatcagtgaatgacagagtggataatactagaatgattttagccttttcatgtcctattaccatggttacttttttaaatcaaagcaccagagatgagagcactgatactatcataatatctttagctaaaatcttttgcttagcatagatcacttatagcttctttgtgttccaaataggaacaaacacacacaaacaaaaatccagcacaaattctccttttgatatgacacacacattagtattagaaaaaataattggatgaaatagtttctcaagattcacagaattgacatgaagtaactgctcttgactctagctataagttcatttcttcccagaagcaatgttagcaaattccactcttaggcaacagctagaccaaccaataagattacagtatcattgattcgcaacagtgacaacagggacagaagcattttgttatactggacatttaatgatttactggctcaacctaagtaaacctgtaatgctgggtagtttcctttaccttggccagatgagagttgatccattttgtgaaagttcgtttttgtactatctcttgctcatctagaaggaaaaagaaatctggttaaataatgtaatatttcatgaagctgtataatgagaaaaagtcctatttacacaaatctggaaggaatcgtgaaatcgttttctcattcattttaccaattattgtcttgaagggaaaagtcaacaagagtcgatctacataatcatatagactattcctttaaaaattatctgcaaatgctttaaaatttgccatttgttagccctatgtttaccttcatccacttacttaaaattcactgatgacttatacttcaacaaagctgttaaaaatgaaaattcaccaagaccactaagtgctgaattttatgctaagtgcaaaggaatacagagggttgaatagggcaaggtccctgctataaaatatctagaggtggaaatggacaagcaagggctatgaatagtaaagggttacacagtaatgcaataagatagagccgtatacatgaagcaaaaaaggaacttcacccagatgagaatgtggtgactacacactggagtgacctccaaaaattcccaccacatggagtccccatttttgtgtcggcagaatgtgggtagaacctgtgatttgtgtctagccaataggatatgacaaaggtgatgagatgtcacacttgtgatcatgttactttatgatactccagcttagctgactggagtgagagattctcctgctggcctagaagaagcaaccagctaggctgtgaagttcctttgcagagggtcaatggcaaggaactagaggctcccttcaggagtgaagtgcaatctcagtgaacagccagtaagacaccaggcccttgtcaaacagtcacaaggaatgaattctgttaacattgtgacagagcccaaaagtggattcttccacagttgagcatccagataagaatgaaatccagctgatgccttagttatagccttgtaagaccctgaacagataatgcagctaagctttgcatggactcctgacatgcaaccatttggagataataaatgattgttgctttaaacttcaaggtttgcggtactttgctatgtaacaagaggaactaatatagaaaggaaaagaggtagggtttggataggctttaattagaggtataaagagataataatgatgttggtagtttgacaggaacagcgttgaatctgtagattgctttgggcagtatggatattttaacaatattgattcttctcatccataagcatgggatgcttttccatttgtttgtatcatctatgatttctttcagcagtgttttatggttcttctggtagagatagatctttcacctctttagttagatgtattccaaggtattttattgtgtgtgtgtgactattgtaaatggggttgcatccttgatttggctctcaggttacaagttgttggtgtatagaaatgccactgaattggccaggcgtggcggctcatgcctgtaatcccagcactttgggaggccgaggcaggcagattacgaggtcaggaggtcaagaccatcctggctaacacggtgaaaccctgcctctactaaaaatacaaaaaattagccgggtgtgctggcgggcctctgtagtcccagctactcaggaggctgaggcaggagaatggtgtgaacctgtgaggcagagcttgcagtgagccgagatcgtatcactgcactccagcctgggcgtcagagtgagactccatctcaaaaaaaaaaaaaaaaaagaaaagaaatgccacagaattttgtacattgattttgtatcctgggagggggtgtgggttgaaaaactacctattgggtaatatgctcactaaccgggtgacgagaccattcatacacaaaactcagcgacacacaatttactcatgtaacaaacctagacatgtaacccctgcacctaaaataaaagttgaaaaaaaaagagagaaaagccacacagaagtagtttaataccttcaaaagaagaattgaattttatccaccccaccagcatgtactgagtatcagctgttcacaaactagtaaacgctatgttgtgggggacatacacaagaaataatttcaatccctcgccctttgagggatgatacccaaatctctgtctttgtctctgaccttgtctgtgcttcagcccagaccatttgcttgtctactagaatgtaaagcccaggaggacagcaacttggttcccaatgcctgcaagtatgaccaataagaatgaatgagtaaagaaaataaatacaaaaccttttaatttggagaaattttgaatctatctataaaattgacagaatccatgacctctaatatattttaacatgctcattaattttcaagtgtatataaaaaacaaattggtataaaaataagtagcacttcctatataccaggcactgacatttagataaatcaatcacttgatattttaattatcatttatttatcattatatattacatgtaatattatataagtattaatccattaattcttgtcaagatctatgagcagcaactattataatgcccattttacatataaaactgtcaagacactgaactaccaaggtcatccagcagcacagccatgttgtagacttcagatatctagtagtatactatgccattatactgtcactcaagggtagcataaaaattaccacattcatctatcaaatattaatctcatgaaaattataaatttatagttcaaattttttgacctgagaatctttaggttgtataaataaagttaggtagcggcaaaatgatcttaaccaatcaaggtaggttggatggaatttggaactttataatgcataaaatccaattcaaaatctaaaatagacacagttagattatatgtaaattgtttacactcaacttgagattatacattcttttataaacatcacaaaataccactgtttaaaaatgttaatataaattggcataatatgttaatgttatactgtcataaaattaaatatataatctgatgatatattacttcttaatataaattgttatattttcactattataacctttaatgaaataaaaatagtattgtaacaatttcatctgatggtaaatctctgagtttatagttagacttcagctaaatggccttttttagaatcctcaaattatcttttttgtagcacagcatatatttaaatgttaaattctttacgtgtttccttttttactatggttgcaaaaacagattttactaggtcctacaattcactttttgtattatcaaacgtagtcagctgaattctaggtaaatatttttctgattttacttactattttcctgaaagaaaaaaattgtttaatttaattattcagcaaaccctcattttttatgtaaaacttgaaaaccttactcccaagatttggtagttaaatctgataccaacaacataaaatgttcaatttgtggaagtaacagaaacatgcaacgaatgtctatcaacttgtgttaaaagtttaatgaacaataacatttctttttaatgctgttgacagggaacaaaatgaaccttcacgactaggtctataaagttcttaagtacagtcatgcactgcataatgattttttggccaatgacgaacctcatagatgacagtagtgccataagattataaacacaactgaaaaattccagttgtctagtgatgtcctgccattgtagggcaacccattgctttttctatatttagacatgttcagatacacaaaatacttaccatgtgctacaattgcttacaatattcagtacagtcacatgctgtacaagtttgtagcctaggagtaataggctatatcatgtagcctagatgtgtaatagtctataccctctaggtttgcacaagtacaccctacagagttcccacaatgatgaattcacctagaagacaaatttctcagaatataactccatcattaagctacacatgactttatatgtcattatatttaagaaaacagtttaaatatatttaacaagtaacaactttattaacaatgtttctgtcctcagcttttctgcttaagaagagttatgagaattcagaccaattgcaaaggcatcgtaaaatggatgagatgacagcagcgtcagggtagaggagaggtgtggctggggaagccacactacaatttgggtgctgcacagctgtgataggctctgatttaagaccagtttttggtgtgggtgattattactgggtagaattggttcacattctccttctctcttataacctaaatcgtaaatggttcctaaaggccagaccgtgtaacattaaaagcaacaaccacagaggagttccaaatactctctgggtccttcatccttgaggctcacattgcttgtatttcaaaagcagttggtcctacaggcctcaggaattggagtcagctgaggctatataaacacctagctctgggtaatattataccgtagtatccctccgtagaaatgagttaaaaaaaaaaaagggttctggctcaggtattcaatttctgcatttctttgcccatttttagatattttctcagtgttttgccatttcagggcaagatcatgacatacaacaaatgcacaaatgaggcccaatttagcaactgtgattccatttgactattaggaaactatcataactgatgacagttcacatggttttcttcctgatgagttatactaatagtcacctgcgggtactgcacaattgtggtttactctaggtgacttaaacatgcacccggaagcacaaagatcataataaaaggtggcttgggttattgtgcagccattgcaatcaatcacaaataatatattgtctagaaacatgttaaatatacttttaattttaccttacataacaaatgtaccaactaatatgtgatgtaaaactgtgtcacagggtcctatgaccactgccttttaaatagatttactaaattacaaaaatgttaaaatacatgacaatatccacttaacagatggtatgtttaaaatttggacagtaaatgaaattagtatattttaatatattgaatacattcttccataataatttattactgagtgatatagcatctcatgtatcagtatgtacataataatgcataatgtattttcatcagaatcataaaatatcataaagagcaaaatagtaaatgtctagaagtatccatctgtaattaatatcacatttaatatatatattaccaggaagagtccgggtgctgtggctcatgcctgtaatcccagcactttgcaaagcccaggcaggaggatcacttgaggtcaagagtttgagactagcctggccaacatggtgaaaccctgtctctatgaataatataaaaattagccagacatggtggtgggcacctgtaatcccagctactcgggaggctaagaaaggagaatcacttgaacctgggaggcagaggttgcagtgagcagagatcacgccactgcacttcagcctgggtgacagagtaaaattgtatctcaaaaatacataaattaattaatactaagaagaaagaaatgctgtttacataattatatataggtaagcatgaaattgcaatctctggcaaaataaatacataaatagtaccatgcattgatacatttataggagcttgcaataggttatgataaactttttggggttttatttgcagattgttattatgcctaataggtttctttaatgataatgatagcttaaatacatgtcttaaggatttaaattatctaaaaatataaatgtaaatgttcatttaaaacaaatcacacatttaaaatcacattattcctggtagtatctaataaagatttttcatcattttcattgcaggcaaatacacctcaataaaatattggaatgaaattgaaaaaatagacaaatgcagattgaatttcttcccacaaccaaatgacgtgaatacaaaggggaaaacaacagcaaaggcatacagtgacaaggtaatgattattaattaccaaacacagtcaaatgacttgatttgggaacagaattatattatccggattgcatatctacaattactaaaattaccactaactttattatatatgggtagggaataaagtatattgaatagtccaacacaagaaaatggacaatttacaggtgcttataactactcaatgttaagattttaaaattgaatatataaatgaaagacatttacaggaccaggctgtggcagatttccaaatatgaccataaattcttcccattgtgatcagcgcatcctttgcaatgtgattttattgcctcttctcttaggaggtggtctcatttccccagaccttgagtctgggctggcattgagatctacattgatcaataatatgacagaagtgattttaagtgacatctgaggctgggccttaagaggacttgagattccactttggctatattggaattcaactctgctctgagacctctacacaaggaaactggtctaagatcctcgtgaataagaagtcacttggaggatagattctaaacctcaagaataagaaataaaagtacaaattggtgtgatgaaggtatattcctatttttggggattgggaggctttacttatttttaaaaactctattgaggtaaagagttaagctgtaacatacttcattgatttcctcacccttttcggctctgttttactatatcccctaatttgttggttgtgctaatatttgtagaaagaggtcttgtatttgctgcatcataatgacatttgtacttttttgactggtttaagtacaaatgaatgaaataaccatttttcctttagttgactttaccctgatttcacctagtgtttcaatgagtaaaaatacagctaaaagaaaagaaaagaaaagaaaaaaagtcacttggaggagaactgaggtacctcagatggcagccagcaacagctgcctgatacatgagtgagccgccctggacctgccagtccaactgataccccaccagcatgtagccatgtgaatgggcccaggcacagctggcagaaggaacacccaactcactcacagaaacatgagaaatcctaaactgttgttgctccacaccactaagatttggtggtggtttgttgcacaggaaaagctaaccaaaacagaaattgctaccaggagtgtggtgttgctctaacaaaaatctaagacatatggcattggtcttgcgaccaaataggggaaggagattggaaggacacaaagagcctattagcggaggctgattgggcagtgagggaaccgccattggaaattggagaaagagccgtacatattttgtacattatatattctgtcacctgcagtaacttgaactcatgattctggctagggagatttccttgcagaatgctgaaagtgtcagttggcttcttttagctgaacattataaggtgctggaagagacagaaatgagctgtttcatttgcagacacaaggcagaggaaacacagaggcctaggatatgatggactgaaaaataagatattttcttattcctagtctttccaaaaaaaagatttgcaaagtaagaaaacgcttcagggtaacagcaaatcaaaggtatgagtattgttgaaaactcagaaagagtttgacttgtttaaactccacatataaatgatatcacacagtacctttcattctgtatctcacttatttaatttagcataatgtccttcaggttcatccatgtcattgcaaatggtaggatttccttatttttttatggaggaataatattcaattgtatgtgtgtgtcatgttttctttatctgtcataatggatgtgttaattgactgtggtaatcatttcacaatttatatgtatatcaaatcatcacactgtacaacttaaatatatgtaagttgtattcatcaattatacctcaataaggctggggaaaaaagagaacatttggaaagatttaaggtagtgcccagttgaccttctcaactagacaaaccagcttctaagaatctttagggcactgcccacagcagcctcatatgtgtccaatgtttgtttcaaagctgagattttgggggcacagaatgcactacagacaagtttttaggaagccagctttcactgaagggacagcaccactccaaatgaacaggagactggaaccacaactttgtgtgtctaggaagaaggctaagaaaactatcagttgcaatcttgagccatctcttaccaagatagcaaggaacatgccttgcccctggacaaaacgaactggccacgtgtggctcactggatttcagaatggctggaccacaattgctccctctgttcaattctctcactccttggacagaagcatctattgaagtgaccccactcctgcctcatcactgcatgttgaagaagtggggagcaggtaacttctctttttagttaacgggtctatggattgagagaaatttcacctgaggaacctcatctctatctggacaagatgcaaacgatgcaacacaggacttagagcttgatgccaaaccaaaggctggaggagacttttgataccttgagaatggatgaatgtactttccatgcagaaagaaaacaaacagtagtgaccagaggacagattttaaattatggccacaaaatcctgtggtccaactatgcatccttcttttgtatggtgactttgtccttcccatccaggggtagaatcaatttcccttccccttgaatctgaactcgtatggtacttgctttaattaataatgcagcagaaattactttatgtcatctgattctaggccttaagaggtcgtgaagtttctgttttagctgtcttggatctccatcctaaaaccactgtgcaaagaaagcagtttatattagaagatgtttccatctgtggaagaattcagatgtctcatttgttacctagaactaaccaccaggcacgtgaatgaggtcaccttggatcttcaagctcagtcagccctgcagatgaactcagccacaggtgaacccaagtgaagtcaacaaactgaggcctaagacttcgagactgatgtgtctgatacctcctctctctcacatccatacatacttgatacaaattccttgtaggaagaaagcattttcctcaatatcgtattcctaaagatcagccccctgcctggtatattgtcttatatatgtgtccttatgaaaccatccatatttaactgaactaaccagcaaatccacatactgtgagaaagcatgaattctgattggcttaagccacagagttttggagtagtttgttacacagcaaaggctaactgaaataaaggcatttacatgtgtgggggggcggtgggagtggaggggtccttctcctcctccctcactctgttttccataatgaaaagattctaggcttatttctttgggcctgtctcctaggcctttcctgttttaatcagacaagtaatggattaaaagttgcaaagaacaagggcaaccaaagttactctgcatgagttctgacatggattgatgcgaagggacagacgagaagagagaaaattaatagctatctacagctgtgggcttgagggaaaagatgagttaagagaatttttagggagtcttgcctgtgttgagtcctctaatgactgcttcaatttttttttcaagtgaatgtcagtaaagacttacattgctcttaagactttcagaattggagttgcatttcttttgtatttaaaaccagtggctagattgaaagagcccaatttcattaaagttatatttgcaaaatgtagtatcatttcactttaaatctaaggcagatgggatgaaaggaatataattatctccgttcctaagttacagttgcttaacctcagcaatattgacatttaggcaagatgattctttgtcgtgggaggtggtcttgtgcattataggatgtctagcaatgtcattggcctttacacattagatactggcagtaccctacaccctagtgatatatctatttgaaaagtgacaaaatatagtaaatctaagacttttgctgaaaggttacatagaaattacacgatttttccaatatgaattaaagtatcttatgatgtctgaaattatgtcattcaaatctggaaagtttggtctcatgtggtgggaaggtataagtgggagagggtggatagatctgatagtgtgtttgatttatcttataattcttaacctctaaaaaatattttagaactatataaagcaaaatctattttttaaaaaacaaatattttaaaaatattacaatttaccaaattttaatgtatttgtcacaatggtggcagttatataaggacacatatattagaaaatgtgctaggcactgggttggcttctagggtgacaacaatgtggaaatgctttcatctcacgaagaatttgtcatctcgtatgtatgggggtgtgggagagaggaggggacagatgcatcagccttgaagccttggatgggcctcagttttgtaactttgtagtaaataatttggtagcaaaaaattgacctgaattgagaaaagactatttatagtctttcattattccacttaatgtgaaaattcatacttttctctgcagaaatatcaacgtctttgattgcaaggtgctgccacagactctgattgagagtgaaccataataaatagtatgtgcaccgtatcacgtttctaaaatccaaaagattctgagtttgaaaacaaagctggggtccttagactttcggataaagggttgtgtgaatcacacagaagtgcagggatggagatgtgcactcagagagtaataatcacaatagagagcacaaagcaatcaatacagtgggaggaaaaacagcacagcttattgtggcacttcaaaccttttagttctaaatcaagaccacatttgaacagtttcaagcagaacttttgtggattttttcctgacaccttttccttcctctatttgtggatataatgttgcaggagacaatgatcggatagtaaagtaatgaaaataccttttaccttgtatctgtacagcacttgaacttattcatgttttgtatacatttctcatttggattctcacaaataacctgccacgtacacagagaagaccattaactcggatgtgaacaaggaagctaaagaatagtgggggtgaggaaatacgccagaaatctagaaactggaatgaaggctgaagagttacagaataatgaacagtatttagtagtcagactcttaccctaatctaattttgaccagatcaatttgctgattatttgattcactaatttaatgaattccactgtgcccctcacatgtaccagccgttctgctgaccagctgtggatgcaatctgagaggatgggtttggtccctgagagtccatcagggaaacaggaatcaaaaagaattacatcacagtccaagttttgtaaatgcaaagaaaagttcagaacagtgacatgaaatatattagtatatttaaaaaatatcacttctacatgattaaagattattcttgtggaaaacatgaaagcctaccctcctactgtttgctacaatggaagctaaggagaaaatgctgccttcacatctaagagttttcctactgaattacatataaaggtgcatgttaatgaaaacatgaagacaactgatctcttggatgaaaggttatttccaatcagagagcacacacagaagccttgagaaggacttcaagctgaggctggacaaacttgccacatgtagccagctccctcctgtaaaatgtggcgtctcctgcttttgcaagaaagccaccaaaactatgaaatattttcctgttatgagctcttagcaataccagggcaccagaaagaaagggagtcttgaaaaatgtcctgaaatactaccttcatagaaccactttattttaacctgaaactgtattccaataccaagagtttcaacaattcaaaatacattgtttggtgtggaatggggaaaaggggggagaaaagctggtcacagtgttcgtatattttatgtccaatatttaatccagacttttaaaaaacccacagttctctcaaacaaacatgactgttctcagagagtgctttcaaagtttggtcgttgcttttcatcaaattactgctctttatcttaagtaggttcaggattttacaattttacattttcacattttgggattttgcatttcaaattactgctaatattatttcttagtctcaccctgtgatctaaatgttccttctctctctccctctctcatataaatacttatatttatatatttacatatttatattatatatttatatattattttgtcagtatccagcacggatacaataatttgacacaatttcacctatattttatactacctgtccccttgacaagacgtaaagagagctacaattttaacaacaaaactcataaatctcagatggagatgaaatgaaaaacagcaagcacctaaaagagtgaacctgagaaataaggtcaaatcacagagtttaaagagccagtgttagaaattgcaatctcaaattcaacccccaccatgtaattcaattagccacttggaagacctgcactcagtggttaatcctgcacagagcaccaggtggtgctgttgctttccgctgcttcagatctagcgtggcgttagtgaccctcctcataatagaagatctactggactccagaacctgtggccaccgcggcagctgcaggggtttccacatgagacagcagctggtggatgtcacaaataaatttcctgagtgtcaatccaacctcacatgctcaagtttattcgtatagtaatgaataattttaaaggttacttttaataataatagaaatctatcttctatttagaatgtatgtggcaggcatatgttgcatatatttactacacatattatctaattaaaactttgcaataaccgtatgagaaaatatcctccaccctcaccaattttacatgtaaagagactggagcaaacgaggttcatcaactcccttgaggtgacacaagacactaaacgtggagcatggatatctgtctgactcaaaagcccataccttcaatcacttcattctactctcacgtccaaattgcccattggggtttccagaataactttacatatcacaacctatctggagataggcaatgtagacgcaattcccaactcacagatgaggaaaccgtgtcagaaatgggtatctcagcaagcaagtgccaaagtcaaatgaaaccctccttactccctttcccccgtactatattaaaaacgatatggccagaatccagctggtcaatagagcacctccaagctaggccatgatgctcagttatcttcccgagctacaaactataaagagttctcctatccacggacatcttgaccgcctatctccagttcttcaaccttgtctatcctcattctcagcccatcttactactacttgagcctcctcaacagagcaggaaatgtttatgggaactggctcacctatgaatccacagaataattttcctttcacatgtctatatttgcatctgccttggtattattattatatcatgtgtcacaggtcaggataacagggaaacaaattctagaaggaattttgtcagcaggaggttttttagcatgtgctctcaagaactaaaaactttaagtgtggagaagcagaattaggacacagggagatgctggactcatgcaattatgcagctgaagctaggagagtctttcagagatgtccaaaatgaaggcaaggggctgggactttgcatccaggtattggccagttgctggatatggggtggccctgggaggaggtataacttgagaaaggcagatccccggggctgaggaccagtcctggggagaggctcagctgtgagtcttcagcaggcaacatttggagagctgggaatgagggcctcagagctgaggggcatggtctgcactgtgccccagtcatctgctgcaccagctacaatgttaactactaagctctaaaaatttaaacagtcccagtaacaatgagaatagcagcacggtcccaataataatgagatcagtagttctcattagttgtatgctatgttcgatacactgcattcaaagggggtcaagatttgctcctatttctatttgggactacagccaaacacttgaccaccaagagatgctgcctcctccatttatttcaaaatgaacaaagtgttcaaggcccacttttgcacttttctgaggactggatcaaaagtctgaggacttctggatcaaaagatcgatagtgcaaggacagggaaggggccatagctttcttgaggcagccaatcatggagttctccaaaccatcttagacatcttagttttttttatcagtttcttactaattcatatgcttcctcagtttaaccaaccaaacttggttgtatatttctaccctctgagcctgcctatctaaggtaccattttacttctctaaccagacaactttggcagccactatctagttctcccctctgacctccatatcatcatccaccctttgcataactatttctcctgaatatgataccatttttccagttcttaaacatcatcacccaagagcctacacaaataaaaaacatggattgccaagtagtggcatgtaggcagaatctgggccccaaatgtattttccttcatcctgcaaccttccaagaaaacattttaatttaaatgtttgtaggtaggacttaagttctaatttttacacagacccatcactttcttttgtctttaaccagttacttctcaaatcaccagaaggtaatgaggtttaagacatcttaaaagaggaagacttatatttcaaatactcataaatgggaagtgagattttgaaaaagcaacatgatgagaaatcttaggaagagcaaagaagtaaaatagagactcttgattttaaaataaactcatattttttgttacaattattatatctttgtcatagatatgttgtgtctttggggaaattggaaaagatattctgtttacattctcaatccgttcccccagtataagcatatatcacataacatttcagccaatgatggaccacatatacaactgtggtcccatgaaattataatactgtatttttactgtactttttatgtttagatatgtttagacacacaaatatttaacattgtagtacaattgcctacagtgttcagtacagtaaaatgctattcaggttgatagcctaggagtaaaaggctattaacacatagccaaggtgtgtagtaggctatgccatctaggcttgtgtaagtaccctctatgatgtacgcacaatgacaaaactgcctaataatacatttctcagaatgtatcttcattgttaagcaatacctgattgcattttaaattagtatatgtttaagcaagtatattatttcactgaaacccagaacaattggaacccaagaaaagttacttgcaatgatgtaaagacatgaatgaattcatgtaatttgataaataacaatataacatgttggtatttttacatataaacaaacatcataactaaatttcaatgagttataagaatgcatgatatattttatataaaactttagaaaatatgagaatctacatccagagtaagcttgttatcagtaaattccatgtagaaaaaccagaataaaacttactactgtatctacatttgtttcctaataaggaaaatggttcagctacctatgtcctgaaggtagtcactgaagagaaactgctgtgatgccagaggcaaacttgagtgcatctgattatcatcttatatgtaaacatagtgaaaaagaggtaaaattctgaggcaccctcacattttaaaagagatctgaaaacaaagtgatatcagcaagatggcataatagcagtttccagtgctcatttcctcacagagacatcaatttgaacaacccattcacatgcaacaaaaatatctgcctgagagctaaggaatatagtgcctgagtagagcacagaaataaacacatacattgaagagggtatgaagaacagttttatattacccacccatatcacccccttcccaagcctgtactgcataccatggagagataacttccatatgagggagaatagtgaagtgagcacttgacttcaaagtagactccagcacttgccccagtgaactctagtgtcaagttggccccttcagaccgaggatttgggcctgcccatgcagatctgtgtttcaggactgccctcacagacccaagtgccagaccaactccagtacaggatgacccccatgaactcagaccaaaagcccaccccactgcctgactgttttctgtggactcaggttttaggccatcctccacagacccagtctccaggcccaccacaatggaccatagtcccagctttactcccatggtccaaaatatcaactcagcccctataagctaagatgatgagaggaccatctgtcccctgacgaaaacatcaggccagtcctcccaaggatttcagcagcatgcctatccatgaacccttccagctgaccttttcagaatccttggtcaggctgactgatgaagggctttccctgctaaggccagtctgaagactggcaaatgtgcctatgtcttcaaatgcataggcaccagctcaaggccacaacaaaccaaatatcagagaaatatgacactaccaaaggggcaagtaaaatactagtaactgactttaaagaaatggatatctatgaactgcttgagaaataatttaacataatcttctaacaaagaagctaagtgagctaaaggagaacacagaaaggcagctaacccaaatcaggaaacaacacctgaaaaaaatcagaagttcaacagagagacagaaaccatacaaaagaacaaaacaaaaattctggagctgacgaacacaataactgaactgaaaaaaattgcatagacagcttcgacagtaggttcaatcaaatagaagaaagaatcagaaagcttgaagacaggcttgacattattcagtcagaggatcaagaatggaaaaaaaggatgaaaaggggagaagaaagcctatggaacatatgaaacaccatgaagctaatcaatatacatattatgtgagtttcagaggaagcagagatggagaaagaagaagaaagcttgtttaaaaaaaataatgttagaaaacttcccaaatctagactgggaaataaacattaatatccatgaataccaagagccctaaaaagattaaacataaagagatcttcaccaagatacattataatcaaattttcaaaagtcaaagacaaaaaattttgaaagcaactagagaaaagtgatttgttatgtataagggaaactccgtaagattacaagcagttttctcagtagagacttgcaggccaggagaaagtgggataatataatcaaagtgctggtgggggaaaaatactgtcaaccaataatactatatccagaaaagctgtctttaagaaatgaaggagtgataaagaccttcctagataaacaaaaactgtggatgttagtccctactagaactaccttacaaaaaattaatgttagagttctttgagttaaaataaaagaaagctaattaacaaaatgaaaatatatgaaagtaaaatctcattgtaaaggtaacatatagtcaaattcacaatatcctaatactgtaatggtgccatacaagtcactttgatataaaagttaaaagacaaaagtattaaagacaactaaagctacaacaatttgttaatgggtacacaatataaaaagatgtaaattgtgacattaataatataaaacatggggagaggagaagttaaagtgtagtttttgtttgcagtcaaagttaaattgttaccagcttaaagcagactattataactataagaggtttcatgtaagcctcatgttaccacaaagaaaaaatctgtaagtagatacataaagataaaggaattaaaacataccaccacaaaaaaaatcatcagatcacaagaggatggcaagagaggaagaacggaataaagtaactccaaaatagaaaacaacagtttgtcagtactgggtccttgcctaccaataattatcttaaaagtaaatagactaaattctttaatcaaaagacaaagagtggccaaatggattaaaaagtataagatcaaactatatgctgcctacaagagattcactttagctttaaggaagcacatagtctgaaagtaaagttatggattaagaaattccatgtaaatggtaaccaaaggagaacaaggatggctatccttatatcgcacaatgtagattttaagtcaaacactgtcaaaagagacaaagaagatcattatataatgacaaaaggatcaattcatcaagagcacataataatgtaagtatatatttacccaacatcggagcacctaaatatataaaatgaatgctaacagaatcgaaggaaataaacagcaatatgattaatagtagcagatttcagtacttcacgtttgacaatggatagatcatcctgacagaaactcaacaaggaaacaatacatttgaagaacactataaacctaaacaatgtaacagatgtatatagaatattccatccagcaacagcagaatacacattattttcaagtgcacacagacaattctccaggatagataatatattaatatattagaccacaaaacaagtcttaacatatttaatttttatttatttatttatttatttatttatttatttatttatttatttttagagagagggtcgcatctgttgcctgggctagagtgcagtggcactcactgttgcctgggctagagtgcagtggcactcactgttgcctgggctagagtgcagtggcactcactgttgcttgggctagtgtgcagtggcactcactgtagcctagaactcctgggctcaagcaatcctcccacctcagcctcctgagtagctgctgggattacagctgagtgccacaatgcccagctaatgttttaaaatttttttgtagagacagggtctcactgtgttgcccaggctggtctagaactccttacctcaagcaatcctcccacctcagcctcctaaaatgctgtgattacaggcatgagctattgctgtctggcctcttatcatatttaagaaagttgaaatcatgtcttctcttttctgaccacaaaaaaacataaaacaagagatcagtaatatgaagaaaatttgaaaattctcaaatatgtggaaattaaacaattcattgaacaatcaatgggccaaaaaataaaagggaaaccaaaaaatatcttgagatgaatgaaaatggaaatactacctacaaaaacttaggagatgcaacaaaataagttctaagaggatggtttatagtaataaatgcctacatttttaaaaaaagaaagattttaagcaacctaattttatacctcaaggagctagcaaaaagagaaagactaagcccaaacttaggagaaggaaggaaataacaaagatcagggcagaaataaatggaatcaagactagaaaacaagagaaaacaatcaatgaaactaagagttggtttttgaaaagataaacacaattacaaacttttagctagactaaagaaaagagaggagattcaaataaataaaataagagatattacaactgatactacagaaatataagggatcataagagaatatatgaacaattgtatatcaacaaattggataatctagaagaaatggataaattccagacacgtacaatctaccaaaactgaatcaagaagaaatagaaggctgggcatggtggctcacacccgaaatcccagcactgtgggaggccgaggtgggcagatcacttgaggtcaggagttcaagaccagcctgaacaacatggtgaaaccccatctctatcaaaaatacaaaaaataaataaataaattagctgggtgtggtggcatgcacctatagtcccagctactcgggaggctgaggtgggagaatcgcttaaacctgggaggcagaagttgcagtgagctgagatggtgccattgcactcccgcctgtgtgacagagcgagactccatctcaaaaagaaaaataaaagaagaagaagaaatagaaaatctgagcaggccaataatgaggaaggagattgaagtagtaagaaaaaatctttcaacaaagaaaatcccaggacctgatggttttatgtgtgaattccatcaaacatttaaagaaaaactaataccaatctttcccaaactgtttaaaaaattaatgagaatgaaccacttccacactcattttataaggccagcattactctcatactaaagccagataagaatacaagaaaagaaaattacaagccaatatccctgataaacatagacatgaaaattctcaatgaaacactagcaaaccaaattcaacatgaccatggtcgatgggatttatacctgagattcaagaatggttcactatatgcaaattaatcaatgtgatataccataataatagaatgaaagataaaagtcgtatgatcatctcaatagatgcatgaaaagcatctgacaaaactcaacataattttatgattaaaaactcaaaaaattaggtacaggaggaatgtatctcaacacaataaagaccacataagaaaagcctacaactaatagtatagtgaatggtaaaatgttgaacatttttcctccaagatcagtgaaaagacaaggctgcccactctcacagagtgctatgttctattcaacataacactgaaattcctacccaaatcaattaagcaagcaaaagcaataaaaggcatcaaaatcagaaaggaatacatagacttttgtttgcagatgacattatctcaaatagagtaaaccctagactccaccaaaaaaatggttataactgataaatttagttaagttataaggtacaaaattaacaaacaaaattcagttgcatgtctatacataaacaatgaactatccaaaaagacatttttttcaaaaaataaattttaaaaatattctattcacaatagcataaaaaagaataaaatacttaggagtaaatttaaccaaggagataaaagatctgtataatgaaacaataaagcattgatgcaaaaaactgacaaggcaaatacatggaaagatatttccttttatggatcacaagaatcaatattgtcaaaatgttcatattaccttaaatgatctacagattcaatgtaactcctatcaaaattccaacggcatttttaatagaaatagaaaaaaaagtcctaaaaattgtatggaaccatcaaagaccatgaagcaattttaaggaaaaagaacaaagctggaggcatatttcctgattttaaattatattatatagctatagtgatcaaaactgcatggtactggcataaaaaaacaatacatggattggaacagaaagcacagaaataaacccatatataatattcagtcaattaatctttgaaaaaggcatcaagaatacacaatggagaaagactgtcccttcaggaaatggtgttaggaaaactggctatccacatgcaaataagtgaaactggatccttattttacaacatacacacaaatcaactcaagacagattaaagatttaaacgtaagtcctgaaatcataaatgtactagaagaaaacatgggcaaaatagcttcttgatattggactagacaatgattttctggatatgaccttataagcacagccaacaaagcaaaaagaggcaaatagaattgcaccaaactaaaaagcttctgcacagcaaagggaacatcaacagagggaagagacaacctagggagtggagaaaatatttgcaaaccacacaattgataagggattaatatgcaaaatatgttagaaactcaaaaactaaatagcagaaaaacaaacaaagaaaacgggcaaaggacctgactagacatttctcaaaagaatacatacgaatggccaattacaagaaaaaatgctcgacatcacaaaacatcagggaaagcaagttcaaacaaccatgagacatcacctcatgcattaggatgtatattatcaaaatagcaaaagataacaagtgttggtgaggatgtggagaaaagggaacccttggacattgttggtgagaatgtaaattattacagacattatggaaaacagtatgaagatttctcaaaaaaattaaaaatagaagtaccatatgatccaatagtcccactactgagtatatatccaaaggaaatgaaatcagtatatcactgagacatctgcaccaccatatgccctgcacactattcacaacagctaagatgtggaatcaacctgtctattgacagacaaatggataagagggatagcattaggagaaatacctaatgtagatgatgggttgatgggtgcagcaaaccaccatggcacatgtatacctatgtaacaaacctgcacgttctgcacttgtatcccaggacttaaagtatatatttttttaaaaaactctaaatatcaatcatctaaattttcactattcaggctttcactataaatgctggttttaggttttccaaaatgatgaatgtaaatcagtattattcatttcacttccactagttttaggttcagatacaataggaagaaaagattttaaacttttagagttcttttaaagtctactccacacattcatcttttggtacgaagtatttcaactcaaattataatagaggaaaaagagtacacacacacacacacacacacagaaagagaaagagacggagaaacacacatagagacaacaataacaaaatagtaccttttatcatacccggagtcttgtagattgtttttatcatatctcacctattttactgattttggtaaattatcctaattcagtcgtatctaaaccaaacacagctttcaccaagggaacttccaactctcctagcagcattctcctgatattatcactatagcaacatctctataaaagcatactattcttccctcattcttcatccttaccccctgcttactagccaaatgcaccgctccccagtgccagcgtgtctacaaagacagtgctcatatcgatttataaaaagtgcttcagatgcacttttggtgaaaaaaaagagacatttttcattcgatatttagaaaattaggcattttatcttattaaaatcctagtgttgattgtggtaattgtttcacaatgagaaatatatcaactcatcacattgcacaccttgaaaagatatattgacatgatttttatgtcatctcaataaagctggaaaaaattttaaaaatcttaataacttctaagggatttttgttggaaaaaaatcgtccaacttacaaaaacttccagaattgttacttttgaaatttaattctagaatttgggagaagaaattaaatggacattttttagatcactattacataggcatttaatttcttgtatttttacacaagatataatcttgtttatttctgatttgttctttgaactttctggaatttttcccaaatatctaatattgcaaaacactcattacaaattataattgccatactagaaatacacatagcaagttgccaagagaatcacaccatttttttgaaacttgcaaacaatattggagaggtttgacattacttaagcacataaaatatcagttaaagaaagagccttacaaaagacaaacaaatataggtgtaagaatgtacaaagaatattttttaaattccattttatactgcgtaagacaatcaaagactagatttttaagcaagaaatgtttacagatgtgtgagactctccaggtctagaatcaaataatttcttggcctgggatttcaaggaaaaacacgaatcagttgtagcctactcatgcctattaaaacaccaccacaaacaaaatcactggtgaaaatgttttcatttttctgactcatttagagtaagaaatgtttgttttttgtttgttgtggtttggttttggtttgagacagggtctcactctgtcacccagacaggagcgcagtggcatgctctcggctcactatagcctcaacctcctgggctccagcaatcttcctgcctcagcctcccaagtagctgggactacaggggcatgccaccacacctggctaatttttgtattttttgtagagacggggttttgccatgttgcctaggctggtcttgagctcctgaactcaagtgatctgcccaccttggcctccaaaaatgctaggattacaggcgtgagccaccgtgcctggacaggaacgtttattataacatcaaatttgttaacccccaaaagtttgcttataaaaaatgttaactattctcatgatttctagggaaaaaaaaatcaaactcactcttcagtagaggccaaaagaaatatgaatttcctcaacagactttggggtctaggagtgcaacagatccgactcgggatcccagcatcatcatttactgcgagaatttcaaaaggtgacttagccactttatagcttcatttagccatatgtaaactagagacaaaaataataatgaaaacctcctagaatcactgtaaatattaagttagatattttatgtaaatgctgtgtccaacacttatcacatagtattcattcatcaataaatgttagttacttgttatacttgtttttactcttattgatttaaacatgatagcagcaattaacttctcttaagggaatagaacagaccattgctttcttttattattagaatatgtatttaataaagacagggaagcgaagaagtttctagaagccaggagaaacctgatcattaatttatgtggttccttttgcctccactagcttcaacactaagaaagagggcctcttgtggaatttagacattcaaaggtatatttactgagcaaatccaaatcattggtttcaatttatcttgacatgttcaggccaattaagttagttaattactgggaataaagtaatcctgaatccttaaaagctgggcccacaacctagtattcattcctaagggctagcagatttgtcctccagtatggcatatgcagcaatttaaagtcagggaaaagtatggacttattaatactctttggcatttactggcactgctatttaccctctattacgtgctaagtgtctgacgacccaatacccatatattcaacattaaatcttcaaccttataattcttgaaattctcatttggtattcactcaagacccagaaaagggtcaaaggttgctaaactttacttcgctttaaaatcttcccttattcagacaagttccctgctgaagtttaaaaaaaaaaaaaaggaggctctaaggaagggcatatttctaaaaaactgaaaaaataagagggagatggttttcagttgttttacaaataggatttcttgtccttttcaatttctcacttaagccttatttccatttggaaatccagctactcagtgccaactaagggggaggaactgtggggtttaaaagttagaataaacatcgtttgtagccttaaatgaggaccagtcttcttaaatgactcaagaaacatttactgcacacaaattatgtgcaaagcactgactacatacatgggtgatgggagcagagggcacaggggcaaggagaaaaataagatacaaaacctaaacctaatgtccttgtaaacttagttcctttacatccttgaaaaattatttttttcttccacagcactacagctgtgtatagggaaaaacaggggaagaagaaccaagcaaatgtagcagcttctagctccttacccctccagtgttgaacctggggtgtgtgtgaaaaaccaaggttaagcatcacagcccactgagataagagtgaaggaacaagggatgacgcaaggtaacacagagatgctggcaggtttgagaaaaacatgttctcgcttctcaagctgaagcgagcaactagcatgacctttctttgtattttcgttttgcagtgtcaagggcaatgttgtttcttttcaggaagaaacaataccagctttgagaaaaaaaatccacattaaaaaaaaatagcagctattaagaagtgtgagaggaaggaggtgcagaggggacacaggaagatccaagagcagcaaaatataggttcagaggcaatttgagtccaatccaccacctttcaaattaaattaaaagcatggttaaaagagcatttttggcacaaaatcttaaattcacggtgctgtaggataaggcttagtgggattatcaacagagtgtggatgccaaatggacatcaggcaggaagagaaaccacagatgcattttcagcaaggtgtctttataggattactccacctagagcttggcctgactcaaatattaatttcacaaacaaccgcagttgtaagagtgacttccattatttaagggcctaatctcgggtagaataacaatccacaaacactttttttgtggcactgccaagcatcttttgtttttcaacatatgattttaaacattaacttgttattgtatatatttaagttgtattacatgatgttttgatacacatagtgaaataattactacggccaagaaaactaacatattcatctcttcacatactgtgtgtgtgtgtgtgtgtgtgtgtgtgtgtgtgtgtgtatgcgtgtgtggcaactgtataccctttgtcccccatctccctaaactgctccatccctctgcacctgttaactgctgtttcactctctgtttctatgcatttgcctttttttagatttactgtttaagtgtcatgcagtatttttcacttagcgcaagtcttctaggttcatctatgttgtcaaaagtcgcaggacctccttctttttaaaagctgaataatattccattatatatatgccacaatttcttcatccattcatttgtagatggatgaatgctaagcataaccattttaatcattctgttaataactcagccaatgaaaaagatttttttcccattataatataaaactgtacgttattttgttttcctaacctacacagtgcttacatgtttctttaatagtaaagatcgtaattagcctatagtgaagtatatataacagataatttggatgcttctattgatttttttgtctccattattaccactgagtccttctaccatctgctgaagcaaaggcaacagagaagaataaaagaagaacagagtattttttcaactgccatgatgtctccagcctgaaactctccttctattccaatgctaactagttattatagcagtaactttgcacttacagatttttgtgcaaaatccaagaaaaaaaagtaatctttattgtcaaaaaatagcttcctgggtgctttctggagaaaaggagggcggtctgacttcctcatgtagaaaatctcagatatgaaaaggaaaagtaacaagggaagggaacacattgcttgtcctatcaaatattaaaaataaaatgtaaaaggtgcattaattaaagcaatgtggtaacagagaaagaacacaccatagaatgcaatgaaatacacagtccagaaagagacttgtgtctatctagacaaaatgagaaagatcatttgatgaatagtttagggaaaactagagggcaaatgaaaatagaaaaaaaaatcattgagaacctctctttacaccaaaataaataccaaatggtttagggaattaaaataaactataacaactacctgaaaatatagtaaatatgcttaataatgaagacagacattttaggcctaaaaataactaaagaggaataggtttcattgcataaaaatcaaaaatacatatccaacatattataaacataaaggcaaagagtatagtgggaaaatatgtgctaaaaatatgagttaaatttttattttattttattctttttttttttttttttttttttttgagatagcatctctcgctcttttgctcaagctggctgaagtacagtggcgagatctcggctcactgcaacctctacctcctgggtccaagtaattcttgtgcctcagcctcccaagtagctgggactacaaatgcgtaccaccacactcggctaatttttgtatttttagtagagatggggtttcaccatcttggctagagtggtcttgcactcctgacctcagttgatccacctgctttgtgctcccgaagtgctgggattacaggcatgagccactgcacctggcctatttatttacatttagagacagggtctctctatgtacccaaaatagagtgcagtggctattcatgggtgcaatcagcacactgcagcctccaactcctcgtctcagggatcctcctgtctcagactcctgagtagctagaactacaggctcttgccactgcacctggcttagaattttaaataaaatcaatgagaaaaattttcagtcccattacatttgtaagcaaagatatggaccagcaattcacaaaatggtctttaaaacatatgaaataaagttttacattattcaatttaaaaaacaatgagataagcataatatccaggggtaacttttaaacaaaaagaaagagattttgagctgtaataagttgccatttttgaaagccagtatttttaactcttataatgaagattaagtaacattaatgaattagttctttattgctcctagtctcagtattatcatacatcagtggtccttaaagtgcccagagcagcagcatcagcaccacctgggaacttgttagaaatgtaaattcctggctccaatcctgacctacagaagcagatcagcaatcggctttaacaagatacccaggtgattcttatgcacaatcaaattttgggatcactgtatggatcataagctgtagaaaattttgtggtgcagtggttcccagcatgcatccaatttcctgggtttagtttaatcatcaccttatgggcaagttatctagattctcctttcagtttcctcatctgtgaaatggaggtaatgatggcacttgcctcataaggttgttggtaggataacagaagtttatgtttgaaaagcatatgtatcagtgcttatatagcttagcccattgttaaatttagatttttttaagtaagtttaataaagaagagaaaagaccatattttaaagatttaaaagtaaagataatcaataattacactgtgagaaatgacaactagatttgcatatctgtagtagaatagaaaaaatgggtcataagcagctttagggatgatgagaagaaatggaggaagaaaaaagaatatacacaagctgcatccaaaatactctcaaatactctgccagtggagagccacacgtataattaattcagagatcttcttggagatggccctagaagtgtgaattcttgcactctgcctaaaacaatttgggtatataaaccacctctctttgatggtaaagatatgtttgtttgatttttgatgctagtaaaatagctgtagaaacaagtcttgaggccatactttcataaaataaatacacctttattaaattacaggtgatctgaatacgatcttagcctgtcattaagatgtgttcttagttatttcagtctactgaatagactgacctgcaatttagtttacaatttagtttctgaaataatttaaaaacaaaaagcataagtctagcaattatttcgtgttgtctagaccctgtgtgacaactctgctgaattcttcaattatttccatgttaataataactaaatagatcattatgaaatcacagcaaaataaaaaacacaatcttccattttctgttgctcctatgttctttctcagcaccaagctatataaaagttaaaacagtttatttcctctatattatgtaggtatttgattgtcccgaacacatcaaaatattacgctttcagaaaaatcttttgaatctctgcctataaaaccattactatatcatatataaaactcatactcttccttctctgtgtataatatttagattctctcctgtgaacaggatagccagggaattagcataccttttgggtcaggtagatggggtagtcagtgagatctccgaaaaacaaaaaggttgcttgttaaaggccaacgtggtcaacttgacccttttggggaggtgcagccttgccagcactagaggctggacttgctgaggccacgttggatctccagtctcagcactgggttattttagtccttcatcccaacaaacttcgggatgggtggtgtgctgcacctattcccaccaggaagcgggtcttgcagattactaacagctgttcccttaatcagaggcaatcaaaacaatggtatccccttccttctacaaattaataaagggagctatctaggaaggttcagtccttactatcatggtaagaagtctttcttttgtagtgtacctcactaaagagaaagacaaacaagcaaacaaaaaaactcctactcacagcaataagtaaggtaagcatctatctaggagctctctcctaaaggcagccagatgcggaggaattcacgagactgccctgcccagtctcagaaagggatgcacaaagggggattcatcccattgctcagaaagcaagaagggaagggactttgctcagaaatcaagctgcttatttaatttgatgtttactctggtcttttttgacctacacagtaatacagagatatttttcaattgacaactttctatctcagttacttagtttcaataaatttaacctgtaaacattaccttacaatgtgttccattctgaggtttcttttaacccaatggaatagaaatgacccctacttggtttgtcttctgagattgcttaagaacaggaagcaaagtactgattactaggcttgcttttaaaataacagccttggcaatgatctctagctgagaactggcacttgtgttgactctaggtcttcagaaaaggaaaatcaagggaagaaagaaaaattcaatgtgcagaaacaaacaaacaaaaaatgccagcaatttctgaaggaatggagaatacatgtatatgaatcctgtagcaccacgaaatttagagctacacacctacaatccttcagaggcatttcatgacagctgcatgatgaagggggaggatttatatttaatttctatatgtgtatactttttaccctaaaaaaaaggaaggaagaaagcatgcaaattaacttcttgtcactaataaaatggtgtgatttaacccaaaatccgtgactgtaaagtacccacaaagagaaagaaaatgggtctcaggaaacaaaattgttttattatggctgtatctgtattgggtcaattactgtgacgaaagaggcattttccctggcagagaaaagattaacattttagtgtattttcttaaataatttaaaaaggaaagagtaacatgtaactaaatttagtttttaatcattttctacttacttgctatatgcaactaacttgttattttcaatgcattttttaaatttttcaatgctagtttgtgcatcatcacagtttttaaaaatttccttgccaggaaattatcatatttgtaattacaataacaaaactctagtcacttcctgaattaaagaaggggttggggtgggggcagctttatcaccgcaatcttggactgaccttttgcctgaagcatttgaaaaggcaagtagaaatcaaatatatttttgcataatgcctacatctttaatgacacttctgaggtgtctgagtgatatttctattgtcattgcataatataatacttagcattttactgtaatgaagtgtaacaattgaggtaatgttactaccatcttacgtaaattcaaacttttacaaaccaaagtatgttctatttttgtccattttgccaattcagttcttctcactattcttaaaggagggtccattaattacatgtatccaaaatgcacaacaatctaattagctgttagaatgactcacttcagtcctcaatgtcttgctttttgtaaaagtgctcatttcctatgacttatgggagaaattgtttggattggaagagcttcaaagccaataaacagaataaggggactcccagaataatagatttctagaataagagcactttttatggattaggaaacagctccagagtctatgacccgcccaacgtcacaaaaccagaatgtcagtaatactactcatcgttgccagatactcaaaagctcctctgcagttggaaagattcgttccagaaaaagtctttcctgaagggcaactcactttcgctagggatgaagagtaacttaaaaaggagagagagcggaggtaaggggaatgaattggtgtaatgccaaaagctgtggaataaaagttattccatggtatttgttcatgggtgttgtgtgtgaatgatgtgtgttgatgttttctgggtcatttagtttatgagggaaggcaggaaaagccaacagagcatacaaaaacaaatcagccacaaattctgaaagagggagttgcctttggtctaataaacattttaggaatgtaaacaccttctgggaaggattccttctgggaatgtctatttgacattcacacctcattgtcaactgctcgaattagataacaccttgttgaatatcctcaggcaatgaaaaattaaaggtaaagaaagagaaaggaatacttttctaagggcgaggcacttagaggtggagactcccctctgggcattacctacttgaggtctctatagaggaggctgatttttttttaaattttattattattatactttaagttttagggtacatgtgcacaacgtgcaggtttgttacatatgtatacatgtgccatgttggtgtgctgcacccattaactcgtcatttagcattaggtatatctcctaatgctatccccccccctccccccaccccacaacaggccctggtgtgttatggtccccttcctgtgtccatgtgttctcattgttcaattcccacctatgagtgagaacatgcggtgtttggttttttgtccttgcggtagtttgctgagaatgatggtttccaaggctgacatttttaactgaaactgaagagaagtgatgaaaaagcaggttggattccattgctcacaactcttctttcctcagatgaccccaacttaccattctctaattttgaaaacaggaaaaaatgttcaagaagatttagaacctatcttcaagaaatgtcaagaatgtaatattgggactctcataaatcataacttttctgcctacattttctgaagatttccctataaaagtctgttaccttgacactctaattcatatgctcaagaattaggttaattattttttaaaactttgaagaaaatgatcaaactaacagtaacaatagcatctacccatcctaaaagagtatgcatcatatacagcaaacttctatgactaagaaacaaaacaggttcattgttagatacagcataatagcatcaaagctctgcttcacctgttggaagcacagaacatattttaactttacgggctgtgggagctgggggaagcaaaaacattagagatgttcaaccaagctctgagtcatctctttatgagttacagattcttaaaaacaaattaaatgaagtccccagctgtaactatgatttgagcctcataacggggtgagaatggagaaaatgggccaaatctacagttatggaatatataatgggatatacacatatatatgtatatatatacacacatatatatatacacataaatatatacatatatatatatatatatggcagatataacaagataggccttagaagttaatttggtggcaaaaggagtaggtttagagaggaaatatatataatatatatttgttgttttcgtagatgagatctggagagttgcctcagaaacgtgtctgcacctctgcaaaggcatccccaagctcaaccctgtgtaattacctcctctttgctcttgttcttgcctttcctttctgcacctgacagttaattgctgtaattgaacaacaaggactgggatgcccttcctcctcttgctctcacttctttcatgactctcttcagtctttgttggttgattaagcttaagcagtctggtaatcaatccaaatcttatctcattaattggactaaatgaagctttgagggaaggaaaggagatgagcataataggtgctaagtaaataccgtagttgtttctcaaccatggaaaaccccacttgaaggatatacactttatatgtttgcatgaaagtattaaggtatttgaagtaactaaggtaatcaaagtaattttccccaatgtataatctaacttctgtttttttcaggcacactaacactttcagatccttgggacaggcaccattcagtcaaatccttatagagcaggactcttgaaacgtcagttcactcttagctgtttttggtttgttttttgttttgtttgtttgtttttaattttgtttgcttttcatttctgtggctttaggttctttaagccaccatggaagtacttattttaagagaataaccattggaattatgctttcttaagaaaaataaatgtgaatgaatgtaccaaacatgaaatgtaagaactcttccatctaagctataatcccatccctgaatgacacatgatggtggtgggtacagttgatgaggttttctctaactccggtggtataggatggtggtcttcaatctgggaatgtaataaatgccctaaaggactatttcaaggagcaacacctgataaagtttttcctaatgtcatactgcattgagcagaacaattctgaatgaagcttttatttagtggtctgggctgaattacatgcctctagatttgtatctgtcaaaatgtgtttcatggacgaatgacatcagaatgcaatgctcactagagatggagcttcctgggttctgcattagatgccccaagactctctgagacaaggcttagaggtctgcattggaacacactcctcatgtcattcttatccgaactagaattcaaaaaccacagctttagaatcttaaaatagttgttcaacaatttatttatgcaaactgctgaaaacatgaaaaagagaagttatattgcatttcactacagttcagtaatccaataggctgttgttccattttaagattgtggagtcaacataaataaacatgatctttgcagtcagaacagcctagatttgccacaacttactagctatgcaaccttgaacaagtttctcagcctatcagaacatcagtttcatcatcactgtaatgaggaaactattaacagctacctcacagggttgcttgaaagctaaatgaacaatgtatatgcaaaacacatagcacagtgcctggaatgtaataggcatttaatgcatgctacattattactttctatcttagcaacttgaggtgactgtaatctcttttaaaatattcagtgtaaacaaactttctcttataattcttgcagcattattagtaatgttctgggaaacggctattgcataatctgccaaataagaacaaagtggacctcggctaatcagcaaacgtgcctgtgcatgtctttctggtagcaattcagtcagctattaaattgttcctgctgtgttttttcaaaaaaataagtaccaacccatctttctttgctaatgttaactctaatctgcgttagctgcttgcttttgcagttattggtatgcattcacattctgtatctataggatataaataaaatcaatagaacttgctttgcgtgagccagtgttcaaggtccaactacagattgggaataaggaattactaggcatttacagcagaaatactagcacatagcacagtcttggtttttgagtcctactatgcagtttacaacactcccatgtatttagacagtgttaggtttttcttccaatcactcagtttccaagagtacattatactcaaatttcttgatgacaaatcctatgcaatttggtgtgttttcctttctaaacctactccttttgccaccagattaacttctaaggcctaccttgttagatctgtcagaggtaagtaactaaataattaactactaggggatgcaggctaccccaaaaagacacaggtattttccaagtgacacaggggcacacagaacaaaggctttcaaaaccttgtcatattttcagtcacagcaggtataaggacagatagccagattcttgaccttcctattcaaattagctacaggaagtggggaaattattttacactcctctaaatctggctgtcaagaattagtggaaaaatccaactttgaatttgtgcttccctgagtgtaatcacatttagtccgattagattaaagaagagtagatcaccctcaaagcaaacaggaaatggagacacaatttgacttcatgattgagcactaacaaaagatatatggaaaatagattggggtctaaagcaaatagcatttttagtaatttaaaaataacttgagagacacatacacatataaaatgccagcttttattgtcagacaatcaaaattgttcatatgttaagaaggcatttttttgtcatttctttaaattaatttgagcttcagataggaaggctacaatcactgcagctaataaagtgtttttgttcttgacaaagaataaaacttgctgttgcaagtggctcaacgatagaaagaatcttattagaagtataattaatgcagggctttaaagaagtcacattgctaacctagggtgcatggttttaggcagaaatgtgaacacaattgccactttgcaagaactcaccaagatccatgaaaacaattgagtctaagaaatgacatcgttactgcattttaaatcataaaaatattcttgcctgggcgcggtggctcgcacctgtaatcccagcacttggggaggccgaggcgggtggatcacaaggtcaggagattgagaccattctggctaacacagtgaaaccccgtctctactaaaaacacaaaataattagccgggcatggtggcgggcgcctgtagtcgcagctactcgggaggctgaggcaggagaatggcgtgaccccgggaggcggagcttgcagtgagccgagatggtgccactgcactccagcctgggggacagagcgagactccatctcaacgacaacaaaagaaaaaaaaattctctaactatgaaaatgcttctaaactctggtgattttccagacgggagttggagtgaaggtctacattcacttagactgtatcacaactccccattattacaagcttgagttttctgttttgtttttttttttaatttagatttgtaagcaatatgccaataaaataatttacttatttactatactataccttgcctacttgcaaaatgcttatagtatccaacaggccttacttagaaagtaacaaccagaagcaaatgtttcttggaataacaaactccacatcttctctacatcctgcatttttccctgtatattctgtgatttgatgcggtgtttttgtgagtgtgggagtatatgtgtaaagtgtcattatttctactaaatatataaatctagatagcaaaaatggttttttttgctacaataggcagtgaaacaattgcaaactatttttcttttgttaaattcatgaaatctgaaactttatatttttttcacttttcaaaaagtttttaaattatgaaatatttacagattcacaggaagttacatggaaatacacaggaagatcccatgtacaccttcacccggtctgccccaatgttaacatctttcattaccacaatataatatgaaaacttcatatccttggcctggcgtggtagctcatgcctgtaatcccagcacttcgggaagctgaggtgggcaggtcacttgaggtcagaaattcaagaccagcctggccaacatggtgaaatcccgtttccacaaaaaatacaaaaattagccaggtgtggtggcatgtgcctctaatcccagctacttggaggctgaggcaggagaatcacttgaacatgggaggcagaggttgcagtgagcagagattgtgccactgcactatggcctgggcagcagagtgagactccatctcaaaaaacaaaataaaaaaacaaaaataaaaacaaaacccttcatattctttaattccagtatctaactttgatttcaagattccctttgaaatttttaaggcttattaaccctatgaagtctataaccctgttttcctgttaactttcataattaagaatttgacctctaattactatgcatacatctattttatgaatttatctaataacattttatatgactgtcacttctctgtttatttcattaactttttattttttttaacagtaagagccatcttttgtttccaggttatttatttaaaaatccatcaagtctttggaaacagatgttaagttaatattctaatttatttcagaagagatttgacttcatatggctataaccaagaaatgcaaatctatagtaaagataatgatattttacttgctacttctcacaaaataggctccattggtttaaatttagtaactaagagtatttctttttttaagtcatattgtagaagattgcattttccaaagatgacaacaataatatttctggtcttacatgctcttccagaacctagttactaccccatttagaggtagaaatttttttccttccccttgaatttgggtgagctattgggactgctgtgacaagtaggatatgtaagaagtgaggctgtgtgacttctgagactaagtcttaaaggcaaaaagttctgtctggctctttctcttgagtcacctgcctttggatctcagctaccatgttgtgaggatacccaggccacaggcagaggccatgtggcagatgttccagctaaagtctcagccacaggcctgaatcaactgccagatgtattaagagagctttcagaagattccagccaccagcattttcttttcctttcttattgtgtcacttttttttctttccaacttttattttaggttcagggggtgcatgtacaggtttgttacatgggtaaattgcatgtgttgggggtttactatacagattattttgtcacccaggtaatgagcgtagtactcaataggtagtttttcaatcctcaccctcttcctatcctctaccctcaagtagaccctggtatctatgttattctcttctttgtgtccatatgcactcgatgtttagctcccacttacaggtaacaacatgtggtacttggttttcttttcctgtgttaattcgcttagggtaatggcctccagctccatccatgttgctgtaaataacatgatttcattcttgttatggctgtgtattattccatggtgtgtatgtaccacattttctttgcccagtccatcatcgatgggccgattccatgtctttgcgattgtgaagagtgctgcaatgaacatctgcatgaatgtgtctttatggtagaacaatttatattcatttgggtatatacccagtaatgggattgctgtgtcaaatggtaattctgctttaagttgttggagaaatctccaaactgctttccacagtggctgaactgatttacattcccaccagcaatgtataggtgttccctttttctccacaaccttaccagcatctgtcatttcttgactttttagtaatagctattataactggtgtgagatggcatctcatcatggttttgatttgcatttttctgatgatgagtgatgtcgaacattttttcatatacttgtccacatgcgtgtcttcttatagaaacgtctgttcatgtcctttgcccatttttcaatggggttgtttagtttttgcttgttgatttgtttaagttccttatgaattctggatattagatctttgtcagatgcatggtttgcaaatattttctcccattctgtaggttgtctgtttactcagttgacagtgtcttttgctatgcagaagctttttagtttaattaggccctgcttgtcaatgtttgtttttgttgcaattgcgtttggagtcttcatcatgaaattttgccagggcctatgtctagaatagtatttcttaggttttcttctacagttttatagttttagattttacctttacatctttggtccaccttgagttgatttttgtatatggtgaaaggaaggggtctagtgtcactcttctgcatattagccatcagtatttaagtcttctagctgaggacccaggcattgtggagcagagataagccattcctactgagccctatccaaaattcccgatcctcaaaatgtgtgagaataaaagtgattgttttttgctactgagttttctaatttgttacagagccacaaatgaccagaacacatgtacacttagatgtaaacatttgcaggaagagtatttggcattcattgggctacatctgttaatacctgtaatgttgctcttctcttggcttcttatacaatgtgttccattcttcattgatcagttagtctctactttgtaaacttcagcaaaacctacctagttaaaatgaacaatacatcttccagagaggcctcaggaactactgatgtgtgcaaagacctgcttccctgagaatgccctcaacatagcactgacagctctctgaattcccggtgaagtgcagcaggctaaaccatgtatgggcctgaatcaactaggacttttatttgcacaggtaagaggggatgccctagtgggccagggactggaatgttgtgagagggcttctccatcagccacaaccttcagcctgtacctcaaatcaaatgacctcccagttacccagagagagaccagaagtctcaccagtaagtacacaggagtctctgagggtgcaaagaataatgtcattccagaaatatttactaagtagccactgcatcctaaaaggatgatgtagggacttcagagtaggaaaataaccatgtaaacatgcagttaccatgtggtgagtactatagcagacataagcacaccaacttcccactgctcatggcccctctcgctacaccaacgtctcatccgtcacctttgctttcattccttgtcctgtcctcagacctccctttccagttttagtgcaaacacctcatcactttcccttgatgtttcttaaagggaacctagttgtccaccagcccaagaatgccttgggggttttgttaatattgcagacccctggctcgctccagactcactgagtcaaaatcaccagtggtgggatccagggtttgaatttttgtaaatgtcccctgctgattcttatgcatctattcttgtcttccccactctagtctctgctatccgattcactcttcttgtgaacactagattaatttttcagagcttgactctgataatatcactcccttgccaccttaaaatgggttaccagtgcctagcaggctttttgctctatatcccagtactcaaaactttttccaatctggcctcaacctacttcctagtcatgtcaccaataacccacatagagctagttgtatgacatacagcttgcttctgccaaatcgtatccccctccaccccctacttcccaaacatagccaggacttcccaccagctgcctgcctgaagggaagtttttcaagttagcctgacactctgaataccttcagctcttctgtggcagctggtaaaaattctccttagtacctagttcaaaggtaagatctcccataatatcatcatatctggaagttctctttcccttctctgtagcaccttgtcttaaacattctcatagtatctctcacatctctccttgtaataacaatatcattacttacctagtcccactcaccccctaaaagtattcaaatatgtgtatatatacatgtgtgtgcatgagtgtgtacacacactgagttaaattttaagtcaaatttatatatatacacacacacatatattacatattacatatacatgttgccagcttaaaatgggttaccagtgctcaaaactttttacatatatataaataaatatatatataactttattttattttagatccatggggtacatgtgcatgtttgtcacaagagaatataaggtactggtggagactgggcttctagtgtacccattacccaaacagtgaaaactatctgataagttatttttcaatcatcagcctccttccatccttcccttttttggagttttcagtgtctattacttccatctttttttaaaattacttcatctttgttaaagagtatactggccacttacatatattgtggccttttcaaaatttgctgaaatctgtaattctacaatataaatttatttcataatttctaaatactttgtagaaggttgcaatcatatttaaaatttttcatcagagtattctatttagtaattgttttgctatgaatacagacaaaatcatgaagtgctattaaaatcaagtggtcactttgttggagtggagagattctgaagtgttataaatcttatacattttataattattttattgacaaagaccaataaataagctgctactgagtaatataaaagttactttgcaccaaagggaatacattaaatatatattttgagttacctttgctcagatcctaaatcagtgaccctcattaaggaaccactgtgtgttgggacttctagtgtgccccggcttcatgcgtcacatcctaaaatgaaggtcactcagggtggaggggcctttaggatcatcacaactttccctttctcacaccctcaacccatatctgcctccctgggaggacaggctttgcagtgacatctctatcattactagttgggcatcattacctcactgtactgagccccattcccttattatgaggataaaaatagtgtcaccagctttctaaggttactgtgaggattgtgcagaaaaataggaaatctataaatgttgcctgttttattacaacaattccaatgtgtgggacctttatcagaaaacttagagaaacagaagacgccttacttccagagactggtaaaataggctgtgtctgtttttacaggttccagaatttctcctacctcaaatccccctatcagcctccaatcccctgaaagctggcagtgactcagatgagcctgtcagtctggaatcaatggttcatttctgctgtaaaagggacattggaagagagcactatgcctcactggtcatttgactgaatttatcagctcttttcctgagagcaaaagtgggagaattagactcgggtgggcctgcggcagagagtaaaaaagcagggatggactggaggtgaggagtcctaacaaatatgtttatcctactcaacattacctaaaaactagatatagccacacaaggaaggagaaaaacatctcttctgtgtgcatctttgcgatggatttagaggcaatgtataggaaggcattattgcctgggggttatgaacagaagctctggtaccagactgcctgctttcaaatcctggcactggcactccctagctctgtgatctttggcagattatgacacttgtgcctcgatacccttatctgctaaatcggggagcacaataattaaagttttccttagggttctggtgagatttaaataagatgacacatgtcatatacacttgcagtagtgcctggccacaaagtttcaataaatatggagagagagagagagagacagagagaaagaaagagatcacaaaatcggatcatactatactttaactttttatacttaatttagtgtgatttataatttataatctaagtagagataacccaaaatacatatttaatgtattccccttggtgcaaaataacatctgcttctctgtatccctacttattttatttatttattttgttttttgagacagggccttgctctgtcacccaggctggactgcaatggcgctgtcagacctcactgggaccacagtagctgggaccacaggtgtgtaccaccatgcccaactaatttttttgatttttagtagagacgaggtctcgctacattgcccaggctgctctacacttctgggctcaagtgatcctccctcctcaccctctcaaaatgctggggttacaggcatgagccactgcacccggccttatacttttcatatcttatttaatatagcaagttaacgtaatatttatatgtaaccctacactcttgtgaagaaaatatgcagaaaatatttctggaataaaaatgtatacatgcttctgcatcttcacgttacattacatttaaatcttcatcatattttaatagctgcataatgttgcatggtatgaatgcatttttctattcataaagagttccttatagggaaacataagatgtttttagctgatatggcttggctatgtctccatccaaatcttatcttgaattgtagttcccgtaatccctacgtgtcatgagagggacccggtgggaggtaatttaatcataggggtggttatcctcatgctattctgctaatagtgagtgagttctcatgagagttgagggttttatgaggggcttttcccctattgctcggcagttctttccttgctgccgccatgtgaagaagaacgtgtttgcttctctttctgccatgactgttaagtttcctgaggcctccccaaccatgctgaactgtgagtcaattaaacttctttcctttataaattacccagtctcaggtatgtctttattagcagcatgagaacagactaatatactagcattatcaaaaatgttgcaattaacaactttgtggtctagttttgcatgcaaatgcaaatagatccgtgggataaaatcatagaaacaaaattactgactcaatgtttatgcacgtctctaattggaggaatattgcctaagtgcagatgttttcgtcttttgcctattttctactgactggttttcctttttgtaatgatttataaagacctttgtctattacaaaattatataacttctgtcatatttgtgacacatttttctccaactttctcatttgctttttatttatacattttgttgtgcagatatttttaggcactgaaatgtacaaatcagtttctttttggttctgggtttctgacaagctaagaaaggatttccccattactagattataaaagaaaaagaaaaacaccgccatgatttttaaaatagttctatggtttcatcttttaaaatttaggttaagccatatggaatcgtaaaaataagtgattttagcctacaaaatgtcagttgcagacaaatgtatttaaacctttggtctgcttgaaatcgcatgtgtttgtgtttgtgtgtatgtgtgcatgtgtttggggtgtctgtgtgtgctgtgtgaaatacaaagacatgaggtaataagtcagctcctttcctctgcttccctatccaagagtctccaaatgatgacatgaatattctcatctcttacatatgtgggcctattttgaactacatattccaccctgagtatatatatgtctaaattactatggttggcaagtatattccaatatctaatagaattaggtttccctcataactcttcttttgtagacttttttctatataccatataatgtttatttttctgaattaatataattatttctaacaattcaaattttttaaaagtcttgctcaagagtgcaattttagcttaatttgttatctgacatctttattgtgagttttcttgtccaggaacaagttatgtctttcaatttagtccaagtcctcttctatatattcctcaaaagactgtgtcagatttttcctcatataatttctccgcatttgatatcttccaccttcttaaattctcttgctgttttttaacagcttttcagttaattcctttatgtcttccagtcatacattgataatatatgtaactaatgataggtttgccataccacttctaattatttttgttatttatttgtacccaattatattggctggtatgtgactactgactttggtgggaatgttcttaaaacttagcactgatgctggctatatacaaacatactctcatacacacacacacacacacacacacacaccactatgaagattttatacaaatcagaattaagtgcaaatttcatagaacttattttgcatttggatgggtacagagtttcttctttgggttattactaagataaattatattaatataattcataatattgaattatccctacattcctagaagactcccccatttggtaacacattactgtattaacaaactgctaagtctattctaggtcacagaaaataattgcagctctatgttgtcttcttcagccctgattctctgatgttcttcagaaagaaaatcggtctgtattagaacattctccacatctacaatggcttcccatgggccaagtcatatctttgtaaagggttattttgggaccatttcgcttatctttagagaagtccatatcctaactgagcttcagagtggtatgtatcagtctttgatgtctttcacttgatctgatccaattatcactattatttgacagatagagatactcctatcctaaagatttgggtaggagtatgattattttcaagtttaccaatgttgaattttttccacaatttttgcattcctttttgttgcttttgataagtctcagggaaaaataaaaacatccttccttatcatcttttaccagaactcctacaccattattccaagggctagctgctgctcctttgaatggctgtacttaaattatctaaccaatatcccatttttagatatttaggttatgccaaattttcactgtgatacatatcactgaaaagaaagaacattttaaaagaccaatattggagaaaatcaaattcacacaaaatagtgactagtagaaaagcaaaggatgcctgtagaataatgaaaaaactaatgaaaaagagctgcttttgtggggtgagttgctcaggcagaaaggaacagaaagggaactaaatctctttagcaacttcctcttatttaatctcttctctttccccttcccacatcctctcttgtagagggtctgctgtggcaatattgctgtgtgagattaggacacctctctctgatgtgtaaggtgcaagctagattgtggtggcaggcagcattatgtgtttccattctcttgagttctcacttattggaaaatccaggatagccattagtaatcacagaaatggttttaaaaccattgtccggaagaaattccttttctgccacatggaactcaactactataaattatgattttgggaatactacattgatttaagtaagagggacagtcaccttgaatcaaagaaccaactcttacattgggcttgtaaatgtttttctgtttaagaataataatagcaggatttaactggacacttatcttagacatagatgccgtaaaatttcaagactgcttcacctttatcacttgtctgtctgaagaacctagagatttacacagtctagctgacattcaagttctttaacttctcacccccagctgcttcatcagatacagatgtctcaaatcagacttaggactaaggtgggcagcagtgaataaaacataaatgtcaacaacaaaacccacaagaaaatttaaaataactttcttgttgagggtctgtactgggcattaaggataaagaagtatcttatataatctgtgccttgaagaagcttacaccgtgctgggctaaatagagatgacaattttcaagattgaaatgatcagtgatacaatgtcacacagaaaggcaagaactattctattaaaagttctttggtctggattttttctgtgtgtgcttttactccctgagtagatggacagccaatgagagtcctgatcagtagctaactaggttctaggacaagcaatgtcaagaatagacttgcagaagaaaaaagaatcctctcagcaggtcaagctgcccctacattatggataggaagggttggggaggagggatgtgtgggatgtcagacttgccagaggagctcttttgaaactcactgtccaggcttcctcgctttgcagttctggtgaacattagaagggagaaggaaaggcaggcacattttgaagtcttctaggtaattaactttctttcctcttcaccctgcatccaaaagaggctggtagggacaccctgcaaaggcccatccaggtgggtccctgggagggcacccagcactaagggcaccttttgaaaaataagccaggcttaaccctctacagccacataacaagcaagaaatcaggaaagccaagagttttaaatgcttgtattctttttctcttttttttttcaacagagacttgttctgttgtctaggctggagttcagaggcatgatcttggctcactgcaacctctacctccctggttcaagcaaccccaccacgcccggatcatttttgtgtttttagtagagacgggattttaccacattggccaggctggtctcaaactcctgacctcaggtaatccactcattttgggctcccaaagtgctgggattacaggagtgagccaccatgcctggccaaatgctgtattctaatccttccttttagtggcgataatgggtatttgttagccatttcatgggattatgtaatcatgaaatatactattattagttttgattatctgagaaaggctactagtaatctcagaaaaccattttctaccatgaaatttaatataaatattctttattttaaagtcttattttttatggtggctttaagtaaaaacctgttagtgtgaaaactcttcatcttctcatcagaaaatcaatcataaaaatgagttttggtaataaatggatctaaaccggtagaagtgcaggtcagaagttacaatgttaaaggtacaaaaatagaaccatatgggaacttttttctaaaaagtctgcagtcaacatttcatccatcaattcatatcaccattaatatttggaagctttgagtcaagcaagaatcacatgtgcatgtgaccagccctaagggactcccctttagagaggcagcaaaggcccggcataaccatctagcatggctctcttaattaatatgaattgcagttacccacttgaaacattaatgcaaaatgaaactactactttagcaaaccttagctggatccattttttcaatacacattctttcatattccaccagtttgctgtttgaacctactgtctcaatatataaaagcatacttcactcagcagaggaaccagaaccaatttgtccctaaacatttctttttttttttttttttttaaagacagggtctcattctatcacccaggctagggcacctagtggtgccaccatagctcactgtaacctcgaaccctaggctcaagcaaccctcttgcctcagtctcaggagtagctgggactacaggtgcatgccaccacacctgactaattattattattattattattattattttgtagagatgggatctcactctgttaccaggcctcaagacatcctcccaccttggccttccaaaagtgctgggattacaggtgtgagctactgtgcccagctaaaaaaaattatgtcttattactataactttgtaaactgtgttcatctgaatgaaatagtcacctgaggcataacaaaatataatcttagattataacaacacatttaaattaagacatgtatgagagaaaatccatttttttttctggaatattccacataggtcatagcatactacctaattttttatgttaaatgttttattttaccatgtcaaaaagacaaaaactattattattatattattcttataattacaaatgtaatttatatttaccaaaaaactacaagcttcccatagtttctacaattattactttaaaaaaaagtcctgtatggtttcttgttgccaagtgcaaaataatagtcttatctttgtgggtgtggttctggctttcctaacttgtctgtcactgatcactaataaacatcctttgtcccatctaaactgagttataggatgtgtcccaatttaccttaaggtttcccacctccactccattgcttatgctagttctctgcctgccaatggacaatctaattcacttttcctttgaaactcgtctcacatactaattcattaaaaatatcaagttctggctttgttctttttgcttaagattgctttgactatttgggctcttttttggttccacagaaattttagaatagtttttttctaattctgtgaaaaatgtcattggtagtctgacaagaatagcattgaatctctcaattgctttgggcagtatggccatttttacgatgttgattctttcaatctatgagtatgaaatgtttttccatttatttatgttgtctctgatttctttcagcagtgtcttgtaattctccttttagagatctttaacctctttgggtaggtgcattcctgggtatttcattttctttgtggctattgtgagtgggattgtgttgtttatttcactctcagcccagatgttgttggtgtacagaaatgctactgaagaacaaagccggagttatcacactacccatctttaaactatactatacagccacagtaaccaaaacagcatgttattggtacaaaaacagacacatagactgatggaacagaatagaaaatttagaaataaagccacacacctacaaccatctgatcttcaacaaggctaacaaaaacaagcaatgggaaaaggacttcctattcaataaatggtgctgggataactggctagccctaggctgaagattgaaacaggacccctacctttcaccatatacaaaaattaactcaaaatatattaaagatttaaatgtaagacctcaaaatgtaaaaatcctggaagacaacctaggaaatattcttctcaacattggtgctggaaaagaatttttggctcagttcccaaaagcaattgcaacaaaaccaaaaattgacaggtgggaactaatcaaactaaagagtttctgcacagcaaaagaatctatcaacagagcaaacaggcatcctacagaataagagcagacattcacaaactgtgcatctgagaaatgcctaatatccagaatctatagggaacttaaatcaacagcaaaaaaataaaataaaataaacaaaaaaccccattaaaaaatgggcaaaaatcatgaacagacacttctctaaagaagatgcacatgtagccaacaagtatataagaaatgctcaacatcattaatcatcagaaaaatgcaaatcaaaagcataatgagataccatctcacactagtcagaatggatcttattaaaaactcaaaaacaacagatgcttgccaggctccagagaaaagggaatgcttatacactgctggtaggaatgtaaattagtccagccactttggaaagcagtttggagatttctcaaagaacttaaaacaaatctaccattcgacccagaaatcttattactgggtgtatgctgggtatatactgggtattttttgcatatactgggtatatgcaaaaaataaataaatatatcactctaccaaaaagacacatgcactcataggttccttgctgtaccattcacaataacagagacatggaatcaattctggtgtccatcagtggtagactggatggagaaaatgtagtacatatacaccatggaattctatgcagccataaaaacaatgaaatcatgtcctttgcagcaacatggatggagctggaggccataatccctaagcaaattaacacaggaatagaaaaccaaatactgcatgttttcacttataagtgggaactaagcattgaaaacacatggacataaatttgggaacaatagacactatagactactagaaggtggagggaggaagtgagttaaaaaactgtccatggggtactatgttcactgccagggtgatgggatctgtactccaaacctcagcatcacacaatattgccatgtaacaaatctgcacaggtaccctctgtatctaaaataaaagtataaaagaaaatcaaagtccttcacttgataatatcctctccaccttcactcacagatgagagggcagagaatttattagtgcctctcttccggattatccatcatatcacaccttatataatcatctgtgtatttattaagtgaactggcatgtcttcatgggcccagtgtgagtgagtgtgggtgtgggtgtgagtgtgccctgcaatgcaacagcagcctggctggggcagttcccacctgagctcctggggtgggctctgaccacccgcaaccctgaactagaatatgtaggtatttatctttcttaaatgtatgtacaactcatttatttcaatgtttaatatgagaagtattttggtctttatttagaagtttggtgaaacttttgcaaccagaaatatgccacaggagcttgactcctgtttatatcaattaacttgtggtcaaatgggtttccttataagtcatctcacttgaagttacagtttgcagtttccaagaatctattgatagcattcaatgaggacttgtaccataaagaaaattatactacaatgaaatgtgttatgaaatgacatagcttgggctgggcacggtggcttatgcctgtaatcccagcactttgggaggctgaggtgggcggatcacgaggtcagtagattgagaccatcctggctaacatggtgaaaccccatctcaactaaaactacaaaaaaattagggtgtggtgacgggtgcctgtagtcccagctattcggaaggctgaggcaggagaatggcgtgaatccgggaggcagagcttatagtgagctgagattgtgccactgcactccagcctgggtgacagagtgagactcctttaaaaaaaaaaatgacatagcttgaagacatagaggacggaaaacattcaaggactctatagttgtgatctcagtgcattgagaaatgccaggttgagtctaagagagacttgaggtcagacagactgtgatttttaatgttgatggtgccatttgtaaaccatgtggccttgaccaatttactatatttagagtttggggcctttattttctcatttattaaacagagatagaaatgcctacttacagggttgtgaaaatcgtatgagatcattaagtagagcacctagatatgttcgcagcatgttagtaacatgggcctccacaaacaagagctctttaatcactaaggtctggaaaaaaccatagtgagcagaacccacccaccttctcattaacttctttttaccaatgttttagatgaggacaagattcttcccccaccccctgcctccgccccatcccattctgctcaattttcattttctttgtttctggaaaggcttcagtagctggagggaggagtcattgtcaggtgcacaaagtcaagggaagaggtgaagtcccataaagtctactggtcttgccattctgtgtgggacagggatcactgtaaggaatagtcataagactgattttttagtttgaaaccaaatcatacaaagaatggacaggggacataagagtgttgacctgtaagagaggaacgctgaggagaccagcatcacctcatgtgcaggaacagccagacaaggtcccctgaggcccaatgggataaaactaggacacatgaatgaagttacaaagagacatatttctgttcagtatacataaagaactgggttttggatgtttgctctatccaaagatggacagggaagtggttctaaaaggtcagattatattacctttaggaggtattctaaacttaatatccaatgaatctatgaaatcttcaagaaattttattttgatgctacacaagacccagcttataggaaacagggtgaattattttaaattacagaattgtgtcccatatttatcgtaaactatctaaaaacaattcattaaaataaatacgtcccttgatgtcacatctccctccagctaccatcagtttcccaactctcttgtacaaaaaactcttccaaggaatttctactgagtcagtctccacctcctcaactctcagtctctcctgagcctaagccaatcagactttcatcctcatgattttaaagaaaacattcttatcaattcccagtctctcctgagcctaggccaatcagactttcatctccactattttaatgaaaacattcttatcaatgccacaccttcaccgtaccacattccaagcttcattttcagttctcatatgacatgacctttcagcacattaccattgctagtttacaccctcattcttaaaactccaatagcctggatgcccagccatcctcttctcctgtttttggcttgttatttaccatactgctgctccttttcaggttcctttgcggtctcctgtcttttgttctgaactaaaaatactggggaggaccaagtgaacaatgatcacttctacattcttccttcagtaaatctcatctggataaatgtcatctttatgctcccaaatcataaacacatatcctcacccttgaactctcttctgagccccagcctgttcaataaaactgatttctcaacatctccactggatgtgaacttttcaaggcacaactgcttgatttcacacatcatcatccaagctccagatacactggttcaatttattgcaagaacctttatgtttgttatttactcagcctggaatgccttccccgctttcaaggctctgtccttctcatgcaggtctcagatgcaacatcaactcgttagcatgcttttgctgacacccctatctcaagtaggattgtagaagtttattaaatagtaggtgaatgaataaatgagcaatctggtttttttaatcgtaatacttaaaaatgttgccactagctattccaaactgccttgccagaaactatatattctttcccgaatttggaaacactgaaacagaaatctgttaacagagctgttgtgggaaaatgcaattggctctacatctgcccctagtgggaactctggaaactttacagcagcagccaatctagagtttaggctctgacaaagcagtaaacttcaaggtcacacagctgcctcacctgtacgatgcggctgttgggtctatgttctctaaggtctagtcccactctgaaattctatgctattatgtttcaaatattctatatcctgaatagctaaatggggaccttgtccttacatctgcttgtacatagaatgagaagagagatggagctagctgccctgatcaggccatcacagtggagaactgagggctcgaaccaaggggttgattctacatatttctttctgattccttgcacttctatcccaaaagagtgtgcctggcaaaaagggcaatctaaaaaaaaaaaaaaaaaaaaaaaaaaaaagcctcttgtgatctgtgtccctgggtggaacttagagaagaacaattgtcagtatttactttaaggccaattttacattatgaggtattttttgaccattttcttgttttaaaaagttatgattacagttttttgtttgtttgtttttttttttttttgagatgacgtctcactgtgttgcccaggcgatctcagctcactgaaaccttcacctcccagaggagttcaagagatgctcatgcctgagcatcctgagtagctgggattacaggggtgtgccaccatgcccagctaatttttgtagttttagtagagacagggtttcaccatgttggccatgctggtcttgaactcttgacctcgagtgatccgcccgccttggcctcccaaagtgctgggattacaggagtgagccagtgtgcccggccaagttatcattatagttttaacttttttattattattcttatttcttgaagctttccactatgcatggtgactgggagtgttcactgctaactttcaaggtaagtattgtacgtaagcagaatgaaaggaaaaggtatgggaagcatgatatgtaaaggatttatatcttgttaacgatggtattcacaaaacaacatgtttaaaaattaattgaaaagagatctttcttcttatcatcttcccttcctgttgaatttgacagtcaaatacatttggcattacagactttcgaacttaccagagcagttggtttatttcacaaaggactggtcctctctaaaggcacagacaaaggcacaagcaaaaactgctcatcctctgtgccaggaacatgagggcctccatatgtctggggaaaatgtgggcactaaattggtagacaaaataaaattcaataagatcactcttaccctcttctccaatcataggtatttctctaatagcataaaaaatttttgttaaattgatatgaagtggtagatttcatttacacacacttgctctgggaggctctagatattttagtaaaccaacagacatttgatttttgagcaacatgttttcccattgagcatatggagagaaatttatttttaaacattaaatagacgtgcatcttacagtaactaaaactacctaaagcactttcctgtttgcctcaaactttcttttttcttagatacagtgtctcactctagtttccgaggctggagggcagtgacatgatcagggctcactgcagcctcgaccttgtgggttcaagtgatccttctaccacctcagcctcctgagtagctgggactacagatgtgcaccaccatgtctgattaatttttttatttttattttttgtggaaatggcatctcactatgttccccaggctggtcttgaactcttggcctcaagtgatcctcatgccttggcctcctatagtttggcaagtacaagataaacggctgttgaattggatttaattcagcagccagatatctgctgtgttcagaatgagtgagcacaaactccagagaccatgtgactattatacaattatagactgcatgtccactgaagaaacagctacttgtaatgaattctttcttttgttgtagctattatgaatatatttataaggaaaaatccctaaaatacatgcttaaatatgtagtatatattatagtcaagcgatgtttttcttctctagaaaatctccctttttctttcgctatagcaactatggtagtgagtattatttactttttatatcatgatgatttttataaatacatacatattttcatttttctaagactaggaattgatccacgagctccatctaatttagtatcagtatcactgcattgatgaagtggtaacgaaggcaccatcccttattacatttaaacgaggtaagaaaaaggaaatatttcctgggccttagggagaaaaaagctcaggctcagatatacagattcagaaactgatatggtttggctgtgtccccacccaaatctaatcttgaattatagctcccgtgattcccatgtgttgtaggagggacccggtgggaggtaattgaatcatggggtcgggcctttcctgcgctattctcatgatagtgaacaagtctcacgagatctgatggttttataaaggggagtttccctgcacaagctctcttatcttgcctgctgccatgtgagacgtgtcttccaccttccaccattattgtgaggcctccccagccacgtggaactgtgagcccgttaaacctctttcttttgtaaattgccctgtctagggtatgtctttatcagcagtgtgaaaactgactaatacagaaactgaatatacacattaaaatattaaaacaattcttctttaagtaatttaattaagtcacatttgccagtttttcataaactcaatggtctcttagcaatacttcccataatgaatcagcttcaagagtttcaaaatagcatcatgggaatgtggtgtcctcttcatttgcaaagttaaaagaaagtctgccatttgtagagtgcaagaagggacaatgtggcaattagtcatcacagttgatgaatctgaagaattcaaaattcttgaatctgggtaagtctggtctttgtatgcagaaacagaagcaggtaacatataaatatacattcaatatgtgatctatctgacagataatacaatagccaagaagagtattttatgatataattaacagtgttatttttcatctagctgtgcttccatgttaatccagatgttttgctgctgttcatctttgtcacagagagaagcctaataataacaaattcaagtgatgttattatctttcttaatagatcagaggcctcttctgagtcttatactgtaatcaaatagagaacaaacatctggatttaattttcacccttctcgtgagataataaacagcacagtccaaggaaatttactgtttctttaataatttcaatactacaaattcacaggagagaaaaattatcgttctgaatgtattaaaaacactaaatccagccccttgagtcctcaaatgatcaccaattttaaaatggacaagccactggctaataatgactacacaagcctgccaaggaaaacatcactgcaggctgctctagtaagtgcttggaatacagaggaagaatgctctttgtgcagtactatttggatctacttatctgatggcattaggttatcacacacccacagggctttccagaattcctcccacttcccgcccttgacatgctgagcagtcctacattggtgacactatcagatcaaagaactaaaaatgtctttggttcccaaaggaataacgacaaaagaacaataaatgcttggaattagtgctgtggacactctgtctacaagagccagatacatcagggttttttgcctaatttttagataaacatggataaattgtgaaaagttgaaagaggcttggtcaattcctttggtaagaatcccaaactactgactataaaactgctcattatgtaactaaaattctgctgcctttctatagtaagaattaaaatccattggccagattcatttgagtcaagtgtattcaagggtattattttctttacattgctatgtcttctattgtttacttatcctacaaaagcaatggcattatgaaatcatatacgtatcctatagcatagaaagtcagacacaaacactctaacaaggtgctacaagtcaatagatgaagatgaactacatgaaatgatatctggtaggtgaaatgtagaagatgaggtaactggagacacaagaactacctggaaggtaaaaggtacgacttgggttgaaccaaaaaataatgtgagacctgaagagattcagtaaattctataaaatgtctcccctttagtgccaacaagagccagcaaagtccagtaatactcatcaggactgacgactccattaaatgcagtagcagttgacaagccctatgacttcacatatagtatgtaacaaaggcgaacagtttaacaggaggatagctctgatacggcacaaacctcagaagaggtgacgaaacaaaacaacagatggcgagaggctaaggaacagttgccatgacccaggtgagaaggaactgagagtccaaacagatctcacctatgcatggctttcttttagacactggggtataaaatgtataatccaaacaatactttttactcaaatggctggtaaagggtgataattttttttaaaaagctcacaattttaaaattgttcctatttttttaaaaagcaaacagaaacctttctttttggcatcttctcctttgtcttacatagaaacttaagtgcagaattttaaggctgattacggatgagtagaagctatggtaacttttttcccttggggttgaagtatctgtttgctggcaaataatgcaaaaaagaaacaaatggatctgctgaaaatctacttctgtatttctctcttaactaatgacaatcatttagctccaattttcatgttcatgtttccctttcttcttggctttgcttcaggtctaaattttccttgatgttcagagaaacgaagagatgggaaagaattggggtcactggaggaaagttttcctctagatggctctttattttataaagaataaaagagatacagtcagaaaatttttcagtaattcagaatatgaatgtatgcactgtgaaattaaaaactcttacttaaatgaaactacggtaaaaatgatattttagtaaagaactaaatgtccagtgaaggtctgaacaaacagtttcatcttttctagatgggaaacatgctgtgattcttcccacgtatttacaatgtcttaaagttgcaagcttaaaatcagacaatctgggaagatcactttccaaatctaacaaaacagcaaaagaaacttctccctctgagaagtgaggaagctttgctcattcaaatggatatgggatatatgctaaatggtttacaccaagctagggagcagccattcaaatcaaaagcagaaacattggtagagttcaacagtgagtcaagtcaaatgcctaaaaataggaagcaaagcatttgataattactgggagacaagatttatatatgatgtgatcattgtcaaggccatgatcaatagtagacctggctaggcatagggttaatttaattgaagaaattgaggttcacctaatccatgggttaataaatatattttaggcaaaccaaagaagaaggaacaataggctgaggttgacatttaattggcaatgccatcgagatatctggtagggcaaaaaaggcaaatacaagacagcccagtgtcgcctacacaaggtgaggaaacttcgcagcaggattagaatgtggatgcctaacttttccaatatacaaagaacccaggcaggctgctatcctgctgaacaggtatgggtaaaaatgaagttcaggccataggcaggaggagcccttaaacacccacagaaaacacgacaaaccatcattgaaacgcttgcagaatcactagacttagcaatagttctgggaatctaaccggagttgcagtttgaatggaagttaagtgtcattgagaggactggttcctaagatgagatcccagcagtagatgaaatgagaacatctaaacaggagtgaggagaatgtccactcattactgattccatatactcagaagtaggctgtgtgtaaaaagtgacacctgcctttgaaattcatccccggggttcacctggccattctcatcttgcctacccacatgctgcttgtcctggatggtcttgcccctgggtctccactcattttgatccagtgcctgtgctcctttgatgccaaagtcaggagcttggagataagttacctaatgcatcttctgtactctcctctctgcctccatcccaatttcctcaaccctcagcttgagaaagacttggatattgatatgggttaagttgtgccacctccacccactgccaccaccaaattcatctgttgaagttctaacctccaggacttcagaatgtgaccttatttagagataaaagtctttcaagttcaagtaagctcattagggtgggccctaatctacgataactagtgtcctcagaaagaggggaaatttggacacagaaatacccataggaagaaaatatgaagaagagataggaagaagacagccatctacaaaccagggagagaggcttggaacagatccttccctcccaaccctcagaaggagtcaccctactgaaatcttgattttggacttctagcttctagaaccaagagacaatgcatttccattgttcaagccacccagttatggtactttaatatgaccatcctagcaaggtaacacaggtacatctgcacaaagtgaagaatgaaggtgatgttaattagtactttccacaggcccatgttactcaattcttcatttaaacaaaatgcctctgattatatgtgtttttgttattttcaatcctttctggaacaagtagggtataaatacagatttcttgtgatctgaaactagacccacagttgcttcctctttttattcatacctgttgagttttaagtagctactattcatagaaagaaggaaaaaagaaagaaaaaagggagagggagaggaaaaggagggagagacataacaaaaattgatgaaggtgtgtgtgtgcctttctgaggcagcaggaaagagaagttctcctgtaagagctggcttaaatggagaggtgccccttttgtggcatttcaaggaaagacaaacaagccatacccataaaatgaagaaaagaacaggaggagcatatatgagccagaccagggtggagaagcagcaccaggggtcaaccagggcagaggatctgtgaatttcagactcagatcactagcctgcaggtgaaataatcattgccaggaacatgagacaggactttagcttcttggggcccatttctttgaagatttctcccaacttctcactctcactcacagcacaagttgatgaggctgagcactgaggcagttgctgggtgattcaagcaacaggaaaattaactccagtatgcctatatattacatcagagttgagggagacttttttggcctccctccctgatttccacgccatattctgcaacataatgactaaatttggctttaacatatcacaggtggttattttgcaaaaatgagtttacacgattttaaacgaaaatgctatggactgttctgtccttagccccaggatgataagtctgatcaaaggaaatgaagccacatctcctgacataagtttcctttcagaacttcccatgcaagttgggggatgtggatgtgacaggagttattctgtttctgggttaggtagttctgggttaggtagtttggctgcatttgaagaaaatggttggagactttatttgaaaatattccatagtaatggaaaagttatgcaaattcatctccctattctatatctagaatacatatgtatatatgttctagaatatatagatatgtatatctatacatacatatatatgtggattatttaagcccaggaattcaagggttatataaactcatctctctatttattttatatacatatatagagagtatatatatatatagatatactatctatctatacatatatgtatatatagatagatatactatctatctatacatgcatgtatagatagatatactatctatatatacatatatgtatatgtatatagatatactttctatatagatataaatatgtatatctctatatctgtatctatatctgtatatatacatatgtatatctatatctagaacatatatatgtatgtatgttcatatatgtatgttcatatatgtatatatgttctagatataaaagagtgatgagtttgcataaattttccattactatggaatattttcagataaagtctccaaccctttatatgtgtgtgtgtgtgtgtgtatgtgtgtgtgtgtgtatgtagtggtattgggaagggattatcactttattctttatactgttctatgttggttgaattttaaggaacttgcattactatataatctgaggaaattaagctttatttatttatttctttttgagacagggtctcactctgtcacccaggctggagtgcagtagtgtgatcacagctcaccgcagccttgacctcctgggctcaggtgatcctcccatctcagcctcccaagtagctgggattacagggtgtgcaccacctcatctggctaatttttctattttttgtagcgataaggttttgccatgttgcccaggctggtcttgaatttctagactcaaacaatccacccactctggcctcccgaagtgctagaattacaggcatgagccactgtgcccatcccagctattttaattttggaaaaaagttatagaaatctatctaataatttttgggggcagggcacggtggctcatgcctatagtcctagtactttgggaagtcaaggcaggcggatcacttgagcctagaagtttgagaccagcctgggaaacatagtgaggcccccttcccactgtccctacaaaaaataaaaaataaaaaatagctgggtgtggtggtgtgtgcctgtagtcccagctactcgggaggctgaagtaggaggacagcttgagcccaggaggtaaagtctgcagtgactagagatcatgccactgcactcaaacagtgagaccctatctcacaaagaaagaaagaaagaaagaaagaaagaaagaaagaaagaaagaaagaaagaaagaaagaaagagagagagagagagagagagagagagagggagggagggagggagggagggagggagggagggaggaaagaaggaaggaaggaaggaaggaaggaaggaaggaaggaaggaaggaaggaaggagaaaggaaaaaattctattaatggttaatgccattaatagaattctaaaaaataacaactatattttataaagaatatctctgcttaaaatacagaaaccttactagttttccacttgaacttatttctcatctaaagaagcaatgatgaaatcttgtatcttccaggcatcacattttctacgttaaattattaaatagctaactaggaatgaagaaataaaaaatggaatcatgtttcccctcttaaatcagaaacaaaagctacttggtacttcaaaatactgattgtccttgagatgtaaagggagtgtctaatgttccacatcaataatctgacccacatcagaagctattttggataacaggaaatagttatctttatcaaacatataaaagttcacattaatatgtggctgattgtaaagcgaccctgccaagaagaaatgcattagagcatttcagtctggtgacctgtacttgaggctgagtcaacacttccatgatacaacttcatctttgaggcttcaataactgagccaattaaaaccaattccaggttaaaactccacacatagctttctgggcagaaaggctctttttatagaaacaattttacttttctaaatgcacatctttaaaggtatttttatagctgtgattaaggcttggtgtttttgctaatttaaaaaggtattttttttctttttcttggatgtgtatgtgttcattagagtattgcttggttttaaataaaataggcggagtatgttattcaagtagttcataccttcccaaagccaaagttaaaatattaagttcaggaaagtaataattaacaactattcttcctaaatgtcttggacatgaaaccagagccaatttcccctaggataatgtagagtatgttaacattacaaatctgtggtttaaataccctccatgttcacagtctgtggcttggcagtgcttggagagaaaaagccacagtttgttgtctgtaacccagtggccatctgtagtgtggcaagaaggggatctcattggcatttctgtcataatgtggcctagttcctaaaacctggcatgaggattaaagtgatgaagggccagggtccaagccggagatgaagcatagcagtacacagggagactctgggggctacccggcattagcccaggaaggacctaaaccagcttccaaagagtccactgccccctgtccagagcaactcactgcaaaattcttcaagggcaaaattgtggttacaacttgatcgtaactttacagttcctgaaggcccaggacatagctgtcagttgcagagttagaatcttacctttaacagtatctggaccacaggagatgctcaatttatatgtgtcataggaataaagtgtctactaaattgccactctgcattttaccaatagaagagcacacaaatgcaaagaagtgaatcaatcatatggcaaagttttcaaaagagagtgtcctggtttttctgagtttttttgtttgtttgtttgttttttgagacggagcctggctctgtcgcccaggctggaatgcagtggcacgatctcggctcactgcaagctccgcctcccgggttcacgccattctcctgcctcagcctcccaagtggctgggactacaggcgcccgccaccacgcccggctaaattttttttttatatatttttagtagagatggggtttcaccatgttagccaggatggtcttgatctcctgaccttgtgatccacctgccttggcctcccaaagtactgggattacaggcgtgagccaccgcgcccggcaaaaggaaaggcatgcctcggttctcttttttttttttttttttttttttgagacggcgtcttgctctgtcaccgaggctggagtgcagtggtgcaatctcgtctcactgcaagctccacctcccgggttcacgccattctcctgcctcagcccccccagtaggtgggactacaggcaccagccaccacgcctggctaattttttgtatttttagtagagacagggtttcaccatgttagccaggatggtttccatctcctgagcttttgatccacctgcctcagcctcccaaagtgctgggattacaggcgtgagccaccacacctggccgaatgtccttatttttttaaccaatagcctgatagttaaaatttactagttcatgtgactacagtgagtaaggaagtcctatagaaaagtgtttgcaagagcccttctgaagcaacagaaaaaaactgatgtcaagatttttttttttcatgtttgttggccaacatcacggatcattagagaaatgcaaatcaaaaacacaatgagatatcatctcatgccagtcagaatgctgattgttaaaaagtcaagaaacaacagatgctggcaaggctgtggagaaataggaacgcttttacactgttggtgggagtgtaaattagttcaccatgtggaagacagtgtggtgattcctcaaggaatcagaaataccatttgacccaacaatcccattactgggtatatacccaaaggatcctaaatcattctattatcaagatacatgcacacatatatttattgcagcactatttacaatagcaaagacataaaaccaacccagatgcccatcagtgatagactggataaagaaaatgtggtacatatacaccatggaatgctatacagccataaaaagaaatgagatcatgtcctttgcagggatatgaatgaagctggaagccatcatcctcagcaaactaacacaggaacagaaaaccaaacactgcctgttgtcactcataagtgggagctgaacaatgaaaacacacggacacagggagaggaacaacacacactggggcctgttgaggggtgaggggcaaggggagggaacctagatgatgggttaataggtacagaagaccaccatggcacatgtatccctacgtaaaaacctgcacattcggcacatgtatactggaacttaaaataaataaataaaaataaataaataataaaaaacattaaagtgatgaactaaagtgtgtgcgctctcttgcttgcttgctctctctcttcaaaggcacataatggacaaggtgaattcactaatatccattcagtaaatatttagtgactattcacctcattttgcaaagttgaaaaagatactggctatggcctcaatagctctaactatttataataagtgctctaattacaggtaaatgtagtgttcataattttatataaattaagcacacacaaaatattagttatgcttttcaactcagaagagagctaaaaaggccatgtttcttaatgaagtatatattttttatcacaagggaaaatgcttacaatttcataactctggagagggtcagacactctagaatccagtcctattttgccttaactaaatgcttgactttgtacccgtcaatctttaggaacctcagttacttgtctttaaaaattggagttagggcagggcacagtggctcacgcctataatgccagcactttgggaagccaaggcaggcagatcatgaggtcaggagatggagaccatcctggccaccacggtcaaacctcatctctactaaaaatacaaaaattagctgggtgtgatggcacacacctgtagtcccagtttctgagaagctgaggcaggagaatcacttgaacccagaaggcagaggttgcagtgagccaagatcgcgccactgcactccagcgtggtgacagagcgagactctgtggcaaaaaataaaaaaataaaaaaaaatcagagttagacaagctgattttgaaagatttttccagacccattccaagatggccaaataggaagagctccagtctgcagctcccagagtgatcgacacagaagacgggtgatttctgcatttccaactgaggtacctggttcctctcattgggactggttggacagcaggtgcagcccacggagggtgagctgacgaagcagggtggggcaccgcctcacctcggaagtgcaaggggttgggggatttccctttcttagccaagggaagccgtgatagactgtacctggaaaaacaggacactctcgcccaaatactgcacttttcccaaggtcttagcaaccagaagacaaggagattctctcctgaggctggctcagcaggtcccacactcacagagccttgctcactgctagtgcaccagtctgagattgaactgtgaggcagcagcctggctggaggaggagtgttcgccattgctgaggcttgactaggtaaacaaagtgactgggaagttcaaactgggtagagcccacacaggtcagcaagacctactgcctctgtagactccacctctgtgggcagggcatagctgaataaaaggcagcagacagcttctgcagacttaaatgtccctgtctaacagcactgaagacagcggtggttctcccagcacggcgtttgagctctgagaaaggacagactgtctcctcaagtgggtccctgacccccatgtagcctaactgggatacacctcccagtaggggccaacagacacctcatataggcaggtctatatggggatgaagtttccaggggaacgatcaggcagcagtatttgctcttctgcaatatttgctgttctccagcctctgctggtaaaacccaagcaaacagggtctggagtggacctccagcaaactccaacagacctgtagctgagggacctgactgttggaaggaaaactaacaaacagaaaggaacagcaccagcattaacaaaaaggacatctacagcaaaatcccatctgtaggtcaccaacatcaaagacaaaggtagataaaaccacaaagatggggagaaaccagagcagaaaacctgaaaattctaaacaccagagtgcctcttctcctccaaaggatcacagctcctcgccagcaatggaacaaagctggacagagaatgactttggcaagttaacagagtaggcttcagaaggttggtaataacaaacttctccaagctaaaggagcatgttcaaacccatcgcaaggaagctaaaaaccttgaaaaaagattagatgaatggctaactagaataaacagtgtagagatgaccttaaatgacctgaaggagctgaaaaccatggcatgagaacttcgagatgcatacacaagcttcaatagccgattcgatcaagtggaagaaagagtatcagtaattgaagatcaaattaatgaaattaagtgagaagacaaggctagagaaaaaaaagtaaaaagaaatgagcaaagcctacaaaaataggggactatgtgataagaccaaacctacgtttgattggtgtacctgaaagtgatggggagaatggaaccaagttggaaaacactcttcaggatattatccaggagaacttacccaacctagcaaggcaggccaacattcaaatacaggaagttcatagaacaccacaaagatactcctcgagaagagcaaccccaagatacataattgtcagattcagcaaggttgaaatgaaggaaaaatggtaagggcagccagagagataggtcgggttacccataaagggaagcccatcagactaacagtggatctctcagcagaaaccctaccagccagaagagagtgggggccaatattcaacattcttaaagaaaagaattttcaacccagaatttcatatccagccaaactaatcttcataagttaaggagaaataaaatccttcacagacaagcaaatgctgagagatttttgtcaccatcaggcctgccttacaagagctcatgaaggaagcactaaacatggaaagaaacaatcgctaccagccactgtaaaaacatgccaaattgtaaagaccattgatgctatgaagaaactgcatcagttagcaggcaaaataaccagctaacatcataatgacatgatcaaattcacacataacaatattaaccttaaatgtaaatgggctaaatgcctcaattaaaagatacagactcacaaattgtataaagagtcaagacccatcagtgtgctgtattcaggagacccatctcacgtgcagagacacacataggctcaaaataaagggatggaggaagatctaccaagcaaatggaaagcaaaaaaaaagcaggagttgcaatcctagttcctgataaaacagactttaaaccaacaaagatcaaaggagacaaagaaggtcattacataatggtaaagggatcaattcaacaagaagagctaactatcctaaatatatatgcacccaatacaggagcacccagattcataaagcaagtccttagagacctacaaagagacttagactcccacagaataataatgggagactttaacaccccactgtcaacattagacagatcaatgagacagaaggttaacaaggatatccaggaattgaactcagctctgcaccaaggagacctaatagacatctacagaactctccaccccaaatcaacagaatatacattcttctcagcactacatagcacttattctaaaattgaccacataattggaagtaaagcactcctcagcaaatgtaaaagaagagaaatcacaacaaactgtctctcagaccacagtgcaatcaaattagaactcaggattaagaaactcactcaaaacctcacaactacgtggaaactgaacaacctgctcctgaatgactgctgggtaaataacaaaatgaaggcagaaataaagatgttctttgaaatcaatgagaacaaagacacagcataccagaatctctgggacacatttaaagcagtgtgtagagggaaatttttagcactaaatgcccacagagaaagcaggaaagatctaaaatggacaccctaacatcacaattaaaagaactagagaaacaagagcaaataaattcaaaagcaagcagaaggcaagaaataactaagatcagagcagaactggaagagatagggaaacaaaaagcccttcaaaaaatcaatgaatctaacagctggttttttgaaaggatcaacaaaattgatagactgctagcaagactaataaataagaaaagagataagaatcaaacagatgcaataaaaaatgataaaggggatatcaccacagatcccacagaaatacaaactataatcagagaatactataaacacctctatgcaaataaactagaaaatctagaagaaatggataaattcctggacacatacatcctcccaagactaaatcaggaagaagctgaatccctgaatagaccaataacaggctctgaaattgaggcaataattaatggcctaccaaccaaaaaaagtccaggaccagaaatggattcgcagctgaattctaccagaagtacaaagaggagctggtaccattccttttgaaactattccagtcaatagaaaaagagtgaatcccccctaactcattttatgagtctgggatcatcctgataccaaagcctggcagagacacacagaaaaaagaattttagaccaatatccatgatgaaaatcgatgtgaaaatcctcagtaaaatactggcaaaccgaatccagcatcccatcaaaaagcttatccaccatgatcaagctggcttcacccctgggatgcaaggctgattgaacatatgcaaatcagtaaacgtaatccattatgtaaacagaaccaatgacaaaaaccacatgattatctcaatagatgcagaaaaggcctttgacaaaattcaacagtgcttcatgctaaaaaatctcaataaactaggtattgagggaacatatctcaaaataataagagctatttatgacaagcccacagccaatatcatactgaatgggcaaaaactggaagcattccctttgaaaaccggcacaagacaaggatgccctctctcaccactcctattcaacatagtgttggaagttctggccagggcactcactgaagagaaagaaacaaaggatattcaattaggaaaagaggaagtcaaattgtccctgtttgcagatgacatgattgtatatttagaaaaccccatcatctcagccccaaatctccttaagctgataagcaacttcagcagagtctcaggattacaaaatcaatgtgcaaaagtcacaagcattcctataaaccaacaacagacaaacagagagccaaatcataagtgaactcccattcccaattgctacaaagagaataaaatacctaggaatccaacttacaagggatgtgaaggacgtcttcaaggagaactacaaaccactgctcaacaatataaaagaggacacaaacaaatggaagaacattccatgctcatggataggtagaatcaatattgtgaaaatggccatactgcccaaggtaattaatagattcaatgctaccaatgactttctccacagaattgaaaaaaactactttaaagtttatatggaaccaaaatagagcccacattgccaagaaaatcctaagcaaaaagaacaaagctggaggcatcatgctacctgacttcaaactatactacaaggccacagtaaccaaagcagcatagtactggtaccaaaacagatatatagagcaatggaacagaacagagccctcagaaataacaccacacatctacaaccatctgatctttgacaaacctgacagaaacaagaaatggggaaaggatttcctatttaacaaatggtgctgggaaaactggctagccatagatagaaagctgaaactggatcccctccttacaccttatacaaaaattaattcaagatggattatagacttaaatgttagacttaaaaccacagaaaccctagaagaaagcctaggcaataccattcaggacataggcatgggcaaggacttcatgactaaaacaccaaaagcaatggcaacaaaagccaaaatagacaaatgggatctaattaaactaaagagcttctgcacggcaaaagaaactaccatcagagtgaacaggcaacctacagaatgggagaaaatttttgcaatctacccatctgacaaagggctaatatccagaatctacaaagaactcaaatttacaagaaaaaaacaaacaaccccatcaaaaagtgggcaaaggatataaacagacacttttcaaaagaagacatttatgcagccaacagacacatgaaaaaatgctcatcatcacttgtcatcagaaaaatgcaaataaaaaccacaaggagataccatctcacaccagtaagaatggcgattattaaaaagtcagaaaacaacagatgctggggaggatatggagaaataggaatgcttttacactgttggtgggagtgtaaattaattcaaccattgtggaagacaatgtggcgattcctcaaggatctagaactagaaataccatttgacccagcaattccattactgggtatatacccaaaggattataaatcatgctactataaggacacatgcacacgtatgtttattgcagcactattcacaatagcaaagacttggaacaaacccagatgtccatcaatgatagaccgaattaagaaaatgtggcacatatacaccatgaaatactatgtagtcataaaaaagatgagttcatgtcctttgcaggggcatggatgaagctggaaaccatcattctcagcaaactatcacaaagacagaaaaccaaataccaaatgttctcactcataggtgggaactgaacaatgagaacacttggagacgggggcaggggagaacatcacataccggggcctgtctgtgggggctggaggagggatagcattaggagaaatacctaatgtaaatgacaagttgatgggtgcagcaaactaacatggcacatgtatacctacgtataaacctgcacatgtaccctttattaaagtataataaaaaaagaaagatttttttccatcaaaattatgaaattgtataactctttcaggatcacaacatttcaaccattaagtgtcacctaggaagctattttaaaatgcatatctattcctgctagtgaagtttgctttttaaaaaatgcagatcattgtataggtaatgttaacttgtcaaagtaggatgtttaatattattagccgtcttccaaatatttataaatatttaatggagttttgtacaactattgttatcatcatattaaatgcataaagatgactccaagactcaatgttgtcttgaaactatttttttttaaagcacaaagtaacaggagaacaaaatatacaaaactttcaaatatatcagaaataacattccttctttgattattattatggtgctaagaattattgttttgaaaaggagccattttatcacacagttgagacatatttcataagaaacaaaaacataaaatcaaataaaagttgttagagtattatttgtacacatgcatttccagtctgattaaaacatcttttacattaatttgttattaaatttattaattatgcataggtgtttacctacaataattatatagtcaaagaagtgtcataccattagaacacaaaatgatctcagaatatctgactcttactcaagagtttggcaattctttctcaacaaagtgttttcacaccttttgacttttacagacacaagagcaaagcactctttaggaattttttacatcttcactgaataagacaaagtccagagacagaaattttcaccggtgtttttgtatgccatgtatcacatttcctactaattgttggaacagagaaattaaagacatataattagcatgaatgtatccagaaataagcaaagtaattactagtttctcatcatgattattcagtatgacttaaatgtttttggtgggaaacttgatattgaaataattaatattcaaaatgatctttccttgtaaagaaatgtaaaggcaagcttcacttcattaaataaccatgaaatcatctttataataagttattttgaacccggaaagataaagttgtaagtgatgggtgggctcccaggtcctctgtataagtaagccgtagacaggttgcctgacagtgctcaggagctagtgttgggccgggcacggtcactcacacctgtaatcccaacactttgggaggttgggcaggagcatcgcttgattccaggagttcaaggccaccctacacagcatagtgagacctcgtctctacaaaaattttttaaaaaattagccaggcatggtggcatatgcctgtcatcccagctacttgggaggctgaggtgggaggattgcttgagcccaggaggttgaggctgcagtgagctgtgattgcaccactgcactccagcctggatgacagagtgaggctctgtctcaaaacaaaacaacaacaacaacaaagctagtgttgattctggtcaagggagcattgagatgaggatgagagagtctcccttttataagattgattccagatacaatttgaaacagctaatggctctctttgatgttttacttccattcttcttatacttttctacctcttaattcctcttctgcaatgaccctaaagtcttcagggtcccaagtcctccaaattctgacctcctcccaggactagcttcatggtgtgtgacctgagtggttgcacagggtcctgcactctgatgggccctgcacacagttttatgccctgttgtgtattaattactcctaataactgtttattttgtgctggatcctgaaaataaggtagccaggcttgccgcctatccataatgatcatgtggtcattaacagctatgcaaaagaacaatcttgaaagaatatgcatgaatatatgaatactaagttacccctcaattctctcggagactgaagtccctcaaatatctacttaggaactcggtttgccacttaaccactctagaactctgttatttcatctgcaaaataagaacagcaaattatgaactataagttccttcccatctaaacaaccacaccagcctatagggacttgtgctttttaaagggaaggtgtttttgcagagtaaaagatgacatgaaaataatttagaccatccagtagagtgctaccctggttaatttccttaattatatgtgtttgtttttgtagaagttttagtttttcaactattcattaaataaatacttacccatagtatctaccactcagtttttaaatttctccaattattatgtcactctcatagaccacagctccatgaggaaacaaagtctgtaagttacgtttacatttgctttcagaagacttgagcacagtagattcccaacaaatatttgttaaatgcatgaatgtatgattgaataaactaagtgcctactaaatgtcagctgaaaaaaatatgagtacctacttgtgcttagtactggatatccgaagttgaataagacaagatgcctactttcaaggttctaatacactaatggggacagagcttcttgcataaacccttacagactaatgcaaccaacaccttaatagaaacatgttcaaagtagagtacaaacgaggaatcctctcactctggctggtggtattaggaaaggcttcacagaggaggcaggatttgagctgagtcttgaaacttgagaaaggcaaaaggtaaaaagaacatgtaaggcagggaaatgagactgagattggcttgaaggaatctagaaattgttcgggggattgcaacaccatagtttatagaggctgagtagaaatgaaaaaaggaaggttaatcgaagtcaggcaatggacacccttccaaccataatgagtttatctggaaggttatagtgagtccttgcaagcttctaagcagggaagaagacaatggatgtcactgctgttgtgttttgaaagatctttcttattacaatattgggatgtggtctagttgaattcctacgtttctggatgtattgtaagaattccacttttttctgttgaatagtagagcaaggaatgctcatatcagccaaaattggataaaatgaaaataatctgtgagaagccccagaaaagtaaaggagctgaaaaagcaggccatgaatacggaatcagtgtaattcttggcaagatgaacgcagtggctcataacttataacaacaacaacatataacaaatacaacatcaacaaataacaacgacaacaacaaagaacaccaagataggtcctgagaatctcaaaattcttcccaagtcagtaaacaagtcaacagtagaataaagaagagcagatgaaaggaactcaaagtgccagtgacacatgtgaggagaaaggaagcaaatgaatggaaggcaattgcataattctaggtaaataacttttttaatgtgggtggagaccactgtttactaaatatgaaagattaatatcagcagaggaaggaattgtttgtttttaatccaagaggtcattgtgaacaataaaaaacaaaaaagaacataagttaccacagaaaccatttgttgaatacttaacaaatttcacgatatcaaaataattcaaaattgtacatggataatttgaaactgaatctgtctggggcagtcaccaacttctttgagatgtttccatgtatttatttgagaagaaacaaatagaaaattatcattgtctatcctcagcattatgggaaggctgcatatattcttatacagtaaattctcaactatttaaaataaattactacttatgattaactgaatacttatgattaacactgaatacttatgattaacaattgcttaattaaactacagactgtcatacaaagatcagaaactaggtatttaggtgtgagaatcacacacacacacacacacacacacaaagtgtaatatcctcattagccccaatctgaaagaatataaaagagaataataataacctgggatgtgaattgtttttctaagtttcttaagatatatgagggatttgtcacatgaaactgaaagtctggttcccccctttataagtacatattaccttaaattatacattcatggaactctaaacttcatgggctctggcgtggtcttcactcctcttacagagaccacgccaaggcctcagctctgatccaacataaacagggtcacacagccaccagcacagtggctaacagagtttttccagatgcagatgcaatttccccaattcaattgccttacttttggggagggttccatccaggttttcatggagaggaaatcccagagtttacaatgttccagacaatccagcacctgtagtgccatactttctcttttcttttcataaatttgagccctggcagagctaattaaacaatgatgaaagcaaggaaaatagacatttctgactccataaagaacttccccaaaacacaagcaggaataatactagtttagttacatagcaaagatctagagaaataatgtcaaggggtgaaagtggagacgtctaaggggagggttgcccaaggaaagaaggcactgagaggcggggcagtgacacacaagtgtccaagatggtaccgacaggagaatttctcaagggtcattgtcagctcatagcacggtccccaactcaacaagagagggaggctgattgagggagggcctgaaagaagagacgtcttactctgaggacttatgtctaaatgggctctacataaggtatagaattatatttaacgtgttcttaaagaattgctcctaaccagtgaatttctgagcatcttgaacctccttgtgggcaatgcacaaagccattctttatttttccagaaatgattttaaatgataggcaggcacacgcgcaccggctcagacctgatatttatatataaaatgcacatactctttttatatattatgaacatgtagaaacatgtacatgtaaagaaaattaacaacattaacacagttgatcactccctccttgaactcattctttgtttggctttcagaccttccttttgtcttttttcttcctaccacacaggctgcagcttcttagtctcatatgtgggactctcctcattccccacttccctcagtgttgagtgcccatttcacaaacctcttttcttcttatctgtccgggctccctgggtggtgccaaccaatctcacagctttaaacactatctctgtgctgacaacgtccaaatgttttctcctgctgtgtctcctccattgatctctacagttacatacatatactcaactcctttcctggaaatctaccaggtatctaaaatgtaacatatccaaaataaggtctcagttttcctcctcaatgctgttccacacaacagtttttctttatttcaaaactaaaagtgagaggaccaagtttaatttttttctcttatacaccaaaccgaattcatcaacacattgttttagtcttaccttcaaaatatatctagaatattaccacctctctccccatccaccgttcaacccatcatctgtctcttgacttgtcaaaaataacctctattccggcctcccagcttcccccattgaaaataaatataatattaactatttatattatatgcacttaacaaatacttatgaagtgtccatattatgaaatgcactatgctagacaatatgtagggcactgatgtgagtttgacccaattcctgtcctcaaagtttttatattctgggtgaataggttagatacatacacacaacccaatacaaagcaacagaagataattgtcatattgtgctataaagagctagaggggtttagaggaaggagaggaaatttctgattgtattggcaataaagcctttgctgaggaggttgcattgaaggtgggccttgaagataagtcaggttttaggaacagtgacttgagctcattccagaaggtgccccagaaggagatgaaagagtcaggacatcttccgagcatggaaagtagtaacatttggctgacataggtggatatatagaggagctagaggaaaaagctgttacagttaaaatggacttagaatatggaatcccagccaaagaagttgggactttaacagggaggtcaaagaagtaattttgctatatgtgtttaatgttacatcataagagtaacaaaagtaaggtaatatgtttaaaaaaattcatgtggaggtaacaagatatagagggatactttatgttttatttgtagaccttagacactcttacttttagaggcctgccacacactatatcaaaggtgcaataaagtgaatttacattacatgccatataaaatatactgacacatatataatttttgaattgatttgatttacatttgactgcttgccataatttagtatttgtaaacctttgcttttttttttttatttaactgttttctttttctatttgagagcgaatattttataggtcactgaagaccctgaaggcctgaagcactttctccatgaagcgcgatggatgaaataggttggcaaacagagaggcttagaggaccaagcactacacaaatgtaaacactttcataaatttattaataaaagtgatgtgaacaagtaatataccatttaaaaggaaaatgtgctcaaaacattgtatctacaaaaacaacaaacacatcactcattcaggcaagatgtgtatctttaaactgattttatagtaaaaaaccactcgattaaaacaaaaattcagatacacattcttcaaaaagagggcaggtaaagtaggacccaatgtaattgatttaattggttaattgccttgatcaattttatcttcaattcattaagttaggcataataatttattcatttatttatcaaaaatgtatttaactataatgttccaaaatataaagaaatgatcactgttttgtatcatacttaaatttgagataattttacacaatatttatgtgggaaaagagagattaaacccaaagggatttcagcctaaatacaataaatgagtttttgacactgttttgtgttttaataagaagagtcattaagttagagtaataaagtataaagttttttaaacttttattttaagtttaggggtacatgtgcaggtatgttacataggtaaatttgtgtcatggaggcttgttgtatggattatttcatcatccagatatcaagcatagtacttattagttatttttctgatcctctccctcctcccagcctccaccctccaatgggccacagtgtctgttgttcccctctatgtgtccatgtattctcatcatgtagctcccacttataatgagaacatacagtatttggttttctgttcctgtatcagtttgctaaggataatgacctctagctccatccatgtccctgcaaaaaacatgatctttttctttttatggctgcatagtattccatggcatatatgtaccacatttttttgtgcagtttaccattaatgggcatttagattgatgcaatgtctttactattgtgagtagtgctgcgatgaacatatgagtgcatgtttctttataatagaatgatttatattcctttgggtatatacccagtaatgggattgctgggttgaatggtatttttgtctttaggtctttggggaatcaccgcactatcttccacaaaggttgaactaatttacactcccaccaacagcatgtaagcattcctttttctccacaagctcgccaatatcagttactttttttactttctagtaagagccattctgactgttgtgagatggttttggcttttattggcatgtctctaatcatcagtgatgctgagctttttttcatatgaaagccaaggcgtcctaagcaaaagaacaaagctggaggcatcatgctacccaacttcaaaccatactgcagggctacagtaaccaaaacagcataatactggtacaaaaacagacacataaatcaatggaacagaacagagaacccagaaataagaccacatagcaacaaacatctgatctttgacaaacctgacaaaaacaagcaatggggaaaggctttactattcaataaatggtgctggaataactggctagccacatgcagaagactgaaactggacctcttccttaccccatatacaaaaattaactcaagatatatacaaaaattaactcaagatatattaaagactaaaatgtaaaacacaaaactataaaaaccacagaagacaacctgggcaataccattcatgacacaggcacagacaaagattacatgatgaagatgccaaaagcaactgcaacaaaaacaaaaattgacaaatgggatataattaaactaaagagcttctacacagcaaaagaaactcatcacagtgaacacacaacctacagaatgggagaaaatttttgcaaactatgcaactgacaaaggtctaatatccagcatctataaggaacttaaatttacaagaaaaatcacaatgccattaaaaagtgggcaaaaaacatgaacagacactttgcaaaagaagaagatatacatgcggccaacaataattagtataaaaattaatcaaggcattataaaaacatttcaatcttcacaggatgccaagctttttcttttccaagctatgatcatagccaatgatgctaaattaaaagaaagttacattttcatcaattatttattattatttcatttgacttttcagtatacttctgttagtctgaagttttcttttgtgtaatgaacttataagaaatattatacttaaaacaaaaaaggtttaaggtttttattactcataaaaaattttcaagaggagattgtgattactttatactgaacacttagcaaatttcatagctatatctccaagggtaaatgcttatccttttttgtttgtttgtttctctttcaatctattcacaaggtttaataatcaaaatttgtccttgcagtgaataatcctactctcctattaatttttttgtatatacaacacctaagcatgcacattttaatgttttctggcatttaccactttttctgtaagattgcgttgatgtcaccccatcctacaataaccaacactgatatgttcattttagaaacataaagtttaatacagtatgttcacatttaaaatgtagttaataaaagtcagtcaacaagttctttttaagtaactataaaaaattacaaaaaagccttaaaatgttgtcactatctaaaagaagtttataatccaaagagttcagccatttattttcttagttgtgactaagtgactccgtaagccacctgttaaatggatcccctttagttggtcttgaatagcagaaaatgtatgtactaattatgtgcatttaaagttttaatacccctttattatactattgtcctgtatttgcttttacggttatatttaaattgagtaaagttccagaaacattcattattcttaaaagcaaatgaaactctgcattgcagtctgactgctcattcataattcagtatcccagcctaaaacattatgctcaaacaagcacaaatattggcaaaggtgaaatattgaatggctactgttgcagctaaattatgtagcaatctctgtgtgtgctttaatttcctagccctagaaataaaaattaaaagcaggaaaaatagtcagcaattatgggtgtaagctaaataagcaagggagtagtgccaagttgcaattattcaaagctgcatgctctttattagttatgcacaggtctgaaatgacaatgaaacccaaaaatggggaaaaaaaacctcaaacacattagttactcattatacatatctagacaaagaaaaaggattctaggagaatgttcttatgaatttgaactttgaaaattagcaactctggttctgtttacgttaatggaaatttacttttcctcaaatttgtcttaattatctgggcaataataccagccctccatttattaggatcttgggcacttgtttggaggttccagcaggtaagcagggttactaaatacccttgacagaggacagatctcctctttctgtggagattggcccctctttggacttaaagcattagtaaatatgcacagtgacaactgagagcaagagacctgcacgtcaccaactgaatcagcagaattaatccagctgatcaatttgtgaagtcacactcgccagatcactttcacttcctgccatttcacccagtttcctttgatgcaggctagatgtgttgcattttgtagcagtacagactttacattttgtagccaacataacctatagacatgaagtaattgataccaaaggctagtgataagtatctagtgctcaggagttttgtcttctgaattttcaggcttactcttctaactttgtcaggtacccttatgccaccttataactctctcttttatagaaataaaagctaattaatgcaataagtatagttactttattgtgtaataaaattactagttttatacagcacagagtgtacaaaactattaacattcctccaaaaatccggatagttagaaaaatttgcaggaaaaaattgaacaaattatcaggctgtgccttctcatccagttttcttccatgactatttgaatggctcaccatatcacagcatttataatttttaaatctcctttagtaaattatctcattgagcttcacaacagttctgagaggggctaagcagatgggagcaatccacattttgcaaatggggcacctagacacgtagatgttaaatagggcatccactgtcacaggcctatttgtgtgatagggtgagaggctctagctctttcctccatgccacagatttctcaagcaaaactaaatctactaaaaaacataataaaacacaacattaaatcatccatactcttcactttcctctcacccctaacccaattatcttaataaaaaggacttccactcaaactaatatcagaatgaagagtagagtgtttgtaggaacacagtctgattctgattgagtttattcaaatttgctgtttgcaactttcacttatggtcaagatgtatgtcatccagagaatgttcacatctaatatattcaaaggaaaatctgctttactaccttattatcttccccacacttttgtaagggactcaccgacttcctttccatcatttcatagatgatgtcattgaggcacaaaatggttcaacaatttaccctcagacaaacagccaagacaaacatagacagtggaatggaactcaaattcagcattgcatctacccaggtgaagatgtacaacttaaatctgagatccttggtgctggtcagacccaagcagagaaattttcagcccatggaaaaggtctagacccatctatatattcagcaaggatattttatctaacaaggctctttctggcatgacatgtgggattggtcaacaagaaataggaaacatgtaccactcacactgaagcatcacaaaccagtccaggcagataaacacgagtggggggtcacttgaacacagaagctctcaatcaagttggtgatctctggacagacgtggagaaactcctagttccaccaatatcctgattttctatagctgtgagcatgttctgggtcatgaataccccgatttaagagcttggtatgtatttgaaggtcaagaatgcttaactggaaattactgctatgcacagcaaatgcattataagcaaagaaagtgggtctgtgacaaattaatatcattgatactgtgcaaacccacaatgatcatttgttggagatactagaaaacctaaaagtcaagctataacattatgtttaagctttcttagcaaagactagcacaaaactcttctaaattggggtatttttataccttgaaaccatgcatttgaaggctgggcttatgacattgaatatatcgttaggattctaacaatgaagcagtgaatatatcattgggattatgacaaagaagcaatatctttagataactacaggtgataattatatttgtttcaaggaatattgaaacataaatgtaaagaaaattgacaattagaatctgttcacctatgagtttctatagtatttccctgttagttttcttctagaaagcagagaagagcagccgggcacggtggctcatgcctgtaatcccaggactttgggaggccaaggcaggcagatcacctgaggtcaggagtttgaggccagccgggtcaacatggtgaaaccatatctctactaaaaaaaaaaaaaaaaaattagccgggcatggtggcacatgcctgtaatcccagctacttgtgaggctgagggaggagaatcgcttgaacagggagatggaggttggagtgagccgagatagtgctactgccctccagcctggaagacagagcaagattccatcttaaaaaaaatcaaaagcagagaagagaaccactgttgtttgttgttggagaagagcatcactgagggatgcaggactagtctgtaccctgccacgaacaattcatcttatcacatcgtttcatctctttgggcctcttttgcctcatttttcttaaaaaaattctaaatatctaagggtcttctagttgggaaatgccactggttcacctatttgacaatagcatatagctatatgtccacaacttgtccataatctatcaaaacaactgaggatgtattgtcactggtattattgaacaacagcagcagtacatttgacaataactcttaattcccaactggacaatgaataaccatgtaagacatgctaatgcagacacaaaattacaaaaaaaaaaaaaaaagctgtatttttatcttttccttctatgtaatgaatacagcatctgaagacagcatggccctgtttgaaaacactggaataaagacatccatcccattctgggctataattccatgaaattgagtaaaaccccaaacaaatttaactgattgtgggttaagatggtatttgaatttttttaaaacctgaaatttcttccccctaccttgcagcctctgcatcacattggcgatatcccgaggacaccgggaggcccctctggaggttgccatggtccctccggaagcacgaagccaacaccaagagactcttcactggaggcagcacagggctacaccactctagaaaacatgcttggacttttctagatctattctgtcataaatgaattccaggcctttgcagcactcaacaaggaggcagctctcccaaagactgaactgcttctttttcttcttccgttttaagactgtcctcttacatgaactcaagaacctgaaaaacaaaaaagaaaaggtacaacataaaaaaaaaatctacgaaggtcaccacagtgctaaaaggagaaatatttctatttaatttgaatgcctggtccattatcaagtgaaacaacttagtgaaaagcacttataaactacaaagtactatgcaaatgttaggaattcccatgatatttaataaaataaatacataaatgagacatataaaataaaattgggttgctaaaagaagaaatgttcactttcattccatgttttctttttaaactatcaactttttccattgatctatgaaagtggtttcccttatactaaaaacactcaattctagttttcaatatgcacgggttctctagtctgctaatttagcctgctttgcacatgttttgctctgttgcgttgtactctttccaggaatgggaccaaatccttgtttctcataccaatttgatgaattaaagcagtataaatgtaaaaaccatttaattctaaaaatttgagtttcaagtactccaattttagaagccaaatgggtatgatttagtttttttcctccctatgtataaagactcaagagttttaaggctagggtggggtgggtgaagcagagtggacattttccttctaaattctctgcattggttaagtttttgtttttgtttttgttttgggacagtctcactctgtcatccaggctggggtacagtggcgtgatctcagcaagctccacttcccgggttcaagcaattctcatgcctcagcctcctaagtagctgggattacaggcgtataccaccacgcctggctaatttttgtgttttttagtagagacggggtttcaccatgttagccagactcgtctcaaactcctgacctcaagtgatctgcccacctcggcctcccaaactgttgggattacaggtgtgagccaccgtgcctggctggttaagtttcattgccgggggggggggggggagggggaggggaggagggggtgcagtgggctttgggaagaggtaggagagtagtcgttgaaatcttgatattgcaaaatgtactttaaataagaatttcctaaccctaggtttagctgaagagaaggtattgccataaacgaaataattagacagaaagaagagggggtgaataatgcaccaagagaaagaaacggcctccgaagaggcccacagggaggtgatacttgattacagttcccattgcatttctaggttatgatgatgaaggttaaaaaaggaatgggggaagagaggaagaaggggagaatggcaaaagcaaaactcctaaagaaagctcatacatgtgagatggtgcaccttcctgaaggaaaaaagaaaatgagaggagcctgtgagtgctgtaaaaattatattataacttggattatagtccataaaaggactttgctcatgaaggattggttaaataatagagtgcaattatgaattacaatttattttaaaatggcattactaatactattatatattggtatctggtcagaatgtatgaatgcaaagctagtaacatgctttttagcctattatctaaaaaaaaaaaaaagatgcaaacctttgcacattgctgctgccccatgtgcaatgcatcagaaggatgtactggagcaagaaagcattactaacttagcaagacatgggacagcgatgcagtgaatggaagtcattggtaggaagatagaggcaaacttctcttggctacttgaaaggagtatatactagaagtaggacccaatacttggtgtcttataggctagagaggtacttctcagtgggtgactctccaagggattcttcatggagaaataattacttgtggttgggctgtcacatacatacctatagccctgctggaattgtgtgcccattagcagcctgtatatcctggggaaaaatattccacctgcccacatacaaaagctatcttaatttgggagaataatagatagtgaaaagtgcctgaaggaccttataaatggatcccctaagctattaggaagttaggttttcaaatgcaaaaatataactttctgaaatcaatcaatcaaccaatctacctattatctatatcatttatctgcatgtatgttaaagacattcacttcatttcagataccccactccaagctgggctcagcactggagctcacagatgattaacacacagtccccaccttcaatcaagaattatggaattaaaagggatttcagttaaatcattgcaacagaaatcactctgcctctatcctcttctaattcacattcacatagcttggtagattaatctgaaatactgtgcatgccctctctctctctcgttacattaaactcagaatttccctgcatgtgcccagtattcatccagtcttactttcacagcataactaacacattcagagtgccagagctcaatgctgggattactaaggtggatatgacacagagactatttttgaagagcttaggacacagtgggagataaaacatagaaaagataatacaaaaataccagggctaagtgcaaatacaaagatgtgaagatacagaggatggtggctaagccagtgtgggtgttctggaaaggtgtccttcttggcaaggagcagacacttgagctgagtcttggtaaatgggttagtcactcaggtgaaacatacgaaagacacatcctgggcagggtgaagagcttgagcaaaggcctcagcatgagaaacagcatgactgggacatggaactatcaccagtcagacactgagaaactctacaaggtgacattgtggaaaagagggcggagagtgaggtggtgtccagatggcgcagggccctgagtgctatgctcagaagtttggttctggttctctagcaggcaacaggaagccactgagagatcttaagctggaagtgagaaggtatgattgggattattctagctatgattttaaaggatgtatttgagaaggacaaaactggaagatccagaaagatcagttaggaaagtatctcaggaatccaggtagaagatgaccaaagacggaaatcagacagaggtagcagagtgagtggagaatcaaatataacacagctttagggaacaaaatttgtaagacttggtgattggtcacccaggggtggaggtgggtataggtagaaggaggtggggtttccagagtgtatatctgaggagtctcagatgactctcaggatttggggtgccattaattgagctcagcagaagaggggccttataggttttacatccaaacactctccccttcatgcttcatatctttggaacaactcaggagcaatttcttcattaccccttcacatcacccctctgaagaacactttcagctgaacaaatggaaatacctagcccaggatccacataccacttgaagcttttcctaaacacaccaaccaacactcaccattattttccactgaggcctctaacatcaacgatccatactatcctaggtacaatttggcttctatctttcactactgctagtcttacctcactctaaagaaacagtgaacatttcactggtatagaggctataacattgcaaaatctcattcattgacaccaagtatatccctgaccacatcctaggcccccgatatatattttttgtttcattgaatcaagttcataatactttacatttatgagaaaatccccagaaaacctcttcctcttcaatgcaaaaaaaagtggatgcaatatccttcctttttcagacattaaacattttgctttcatcattcacatgtacacatatttcctattttgtgaaatcatgattttcttgctttttactgatactttatctaattacatgatttaataagaaatttaaatgatgttaataaaaagaaggtaataaaaggagactgggaattaggaaatatcagttctaggctaaactttatcccagctagttgggtgattttgagctggttctatgcatgaaggtcctcaacaactacctattggaggagagtgtggtaccaggaaatgcacagactttgatctaagaaagacctggagctgaatcttaattctatctcttactgtgcacgcaggcttaagaaaaatgagcttttctgagcccttctttcatcatctgtaaaatgaggtatacttatgccaaattaggtttaattttatcctgcttaaattaatttttttaaaagataaatatgtcatgtttccagcagattgattggcatgtagcagagtttcagcaaatactagtttccattttccttcccctgttcccagtttctccagctgcaatatgagagacggccctaaaatgcagaggtactcccaagtgtgctcttctgttccaaaaccaatagcagcacaaggcagagctaaaacaacgactggtgcaaggtcatgagatcctccaacagactgtttacctagcagtgttctggctatggacatgacagaaccagaacaccagaggcagatccagaacatcaataaactcactattcccaagattattaaaacagtttttaataggtgcaggatactgcgggagcacgaaggagagggaatgaagagtgaagctaggcattgggatggaattggagaatttgatggacattcatgggctgtataccaataaatagtccctgcaccatctccaaatttttccaggggaaggaactaagattatgatgcagctaaatacattcagaaaggtaagattcctgtatttattatttcacaataaatatgtattgagtagctatttgtaagggaccatggtactgagtaaacagcagtcaacaagagagacaagcccctcttacagcttatgtgccggtagaggaagatgatataaacaatgttacaacaaaggagggcaagtattgtaatggaaaagtccaggctactatggaagcaaacaaaacacccacccaatcaataaccatctgctgcattttttttttgttcaggacacagagagaatttggactatctgctatttgggatgctcccagttgaaaggcatactcttcttaggaatttggactacctgctatttgggatgctcccagttgaaaggcatactcttcttaggaatttggactacctgctatttgggatgctcccagttgaaaggcatactcttcttaggaatttggactacctgctatttgggatgctcccagttgaaaggcatactcttcttaggaatttggactacctgctatttgggatgctcccagttgaaaggcatactcttcttaggaatttggactacctgctatttgggatgctcccagttgaaaggcatactcttcttaggaatttggactacctgctatttgggatgctcccagttgaaaggcatactcttcttaacatcactccctgtgaaaaaacacagttgtgaaatagcacaactcaattttttctgtctcttggcagaatggacattggctcttaaagcagtttcttgtttgtgtgactaaaaaggaatacactaagaaaagcactgaagaaatactactgagccacaagaatatatataagcaatgcaactgaatttctaggtattaggaaactactgcagaaaatttcaaaccctgcaatgaccagagacaacgtggctcatttctaaccaaaaagaaaatgaactgagaacataaacacataaacagattcacaacagcaggaagtacagatattaattaaatgtctaaacatgtataagaatagcactaatattgaaacccactattgaataaaatttttagtcatgaataaatttcagtttcccttctattcaagtcttttgctgaagagagttcacatactgtttaattttaaatttaattatttttttctctattcacccattaataatggtactaattaatgaatactaagatggctaaaagagaagaacagggatatctttgaattaatgtaagtatattactaataaatgtgtgcaggttatcagggaacaatgctgtttcttattcactagtatgaattatacagagtaacaataagaaatgatcttttccatagaagaacatgaacaagtaagcaaaagacaaagtgtatagcagaaatcagcatgaaagatgttcagtgtcataattaaattttgtttattgtaagcctaaagtataaattacaaccaaagacatctgcaaccttctttttttcccttgctacagtatattgcacaccttgccaaacattagttctcgttagattagaccacaaagaagtacacatttaagaggagacacacagaggacctcgcagaggcgtttgggccctgcatgcctgtcacattcagaccacagggtgtggctgcagtagctagagctggagttgtgaaaatgccaccaaccttgcccagttatgggcttcctacatcctgtgacagtcacacctcctttcatttccaagatgctgtgtgtgcagcatagttatcagaaagtaggcccagtgcagcaccaaacaattcttgaacatttttaaatggcaaactagctttttccaatctcctctccctggcaggaaggactcaagtaaaaaagagttcttaaatgaggtcaatgaggacagaagaaaaccagtttgtgaaaatcattagttcagaaagatgaaagtgagactataaaataagagctaggcaaatatttccaaagcctagcaaatattgttatctgggtcagtctgaagctgtttcttaatcttcagcatgaaacatattaagttagtatagatctctcacattttgttctaaatctgccacaaagtaatgaacagaaaagaaaaaatagatatgtattttgtcacactgttccggtgatatcaggaactttttagccatactacaaatcttttttcaccatggggaataaaaagcctctcaaagaacaatcgtcatgactcgtgattaaattcgcattttatgaagatgtaggtcatattaatgacctttgcctcattgaaaattattatactttctcttgcataggtctggcttctgtatacgaatgttgtctttaggaaagtcattctcagatgaagacaaaaaatggatgggcattaaagaagagaaaaataattcatttttaactttcttaacattcacaggaacatttcagatacaagttttccaccccaaaacgaaaagctcagaaatgaacattgtgggatgctaaggcttcattgctgatatttccctctgggctggacctgactctatttacggaagggggcagaacttccagcatccaaagtctgggatcccagtcagcacacccagcctgccttcccaaggggcttcttcctgtgcggctgatggctgcttcgttttgcacggatgcctgcccgttgggatgcacctggccgcctgtgcaccaccatttcccagaactcctccgccagcaatgcaagatctctctatgtgaaacgtatctttataaagaggagacgaaagttctcttgccctctagtgcaggctctgccgggaagcaactgcaccatgacagcgccgctggagtctgacgcgccagggcctccgcgcagccttcaagccatttccctcccccagcccttcctaaaatagtcagggggtggaggaagggaggctcctagaatctgttcaacgccctacctctcccatctgatagtagcaacagtaccgaccatcacaataagaggctggctgccttttgcttctgcaccattggagcccaggagatgtgccacaagcggaaatgacaactcagagagggggatattaatagggacatctacgtacgagatgcaaagaggctccccaacctcctagtctccttatctatgagtatcgcacacgtacacacatcactgccaccaccccctcccatcaagcacgcagagccccagcgtgcaggcacaaacttgctgacaatttgtctgcaatgtgttcgtcttgcacctctctctcctctccctgtctctgtctctccctgtctcccagtctctgtctttccttttaccttctctctcggcctcgttcagtttcccagcagcaaggcgaagcgagcgaacgcttcctcccggctctctgcgcccaggctcggcgggaccccggggatgcgcggctgtccgcccgccctgtcgccgggatcgggcgcggtctgcaggactgcgggagcccagccgccctggtgacagaggacaacaatctcagcccgctgcggccggcggccgcggcccggcgcccgcgctcaccctggctggctcgcccacactcactcccgcgccgggctgctcagccgcgctccccgccctccgcgaccggttcctcctcccggctgctcgctggggggtgaggcctcccccttcgccctcccccacgcatctactgctcctgtcgggaaggaaggtcgcccaggccggttcagcctctgggcagggtccctgcaccgccctggcccgccacaccccctccccggctccgtgccccgcgccccgcgcccggctccgggatgcgccggtgcctggaagagctgggggcggggacccggaggctcgcaggcttccctacctcctggagatgcacggccttgggcgtttctccgcagctgcaaagctgtgctgtgacccacccgctcagcgagcctttataccgggaccacctcccgggggtcgaggtgggaaggaaatgtccctgagagccgggacgcgctgcctccgctgcctggaggagctgcgctgtcctgccagctaacttttgcccacggtttccactgcccgggtgacctttctgagcggaacctatcctgaaaggctgggaggttccctgatggtcccaggaagggcgtgatgcagagcaaagagcaaaacccgctggctcctttttcatcaacttccgaaagatcctaaatcgttttggctgccaagtcagtagcaaataacttaatttgagggagactggtcaggctttatagatcttttttaatgttatgtataaagtttagacttcttgagaaagcgcttgacatctttaattcttgactgtttattatgatgattctaaaaaccacttttaggttcttcaggtgcactgtatgcaccctgtacattgcggagccatttgtatctttggccacaagtccttctcgtggtgtaagagatcttggtgttgcctggtagcattcaggagaatttattttgttgtggttttatggtatccaggcaaagtcaaacacagtctctcttcaccaacagtgaagtccaagtccaacaggatgattgcagctaaaataatcgaagccatgttgcaataatcttaaaagtaataatcccccccttgaatctccaatctgaacaaaacagtcatttatcctctaaatttgctgaaaggaaggagcagtttataaagtagatgaagtttctctttgctgcctgcctttcccttacctgctgccaacattcccactgcctagctttccattttcttcaaattctccttcttctggatcgtgtcaaaataataacatctgaaacaaatctggtaaaccaatctgatgtgttcctcttctttgtgctgacttttgtttttttttagagagagaaaccaaacaatggatctctatttgcagaacttgctacctccaaaagttgggcctggaggaggagtgtttgggatcactctcaatgtatgccctgcctctgcctgagggcaacaatcctggggcacccccagagccccttgtggagacaaccaccagagcataattattccaggtcagccctctgtgcccagtggccacaaaatggggtccagatttccaggcttgccactcagaagaaacagatcagaatggctcagctcaccctctcaatccctaccttcatagaatcaatccaccctgccggcttttgaagatgggtagaaagttattgtgccaactttgccattctttttgtttgtttgtttgtttgagatggagtttcgctcttgttccccaggctggggtgcaatggtgcaatctcggctcactgcaacctccgcctcccaggttcaagcaattatcctgcctcagcctcctgagtagctgagattacagggatgcgtcaccacacctggctaattttgtatttttagtagagacagggttccttcatgttggtcaggctggtctcaaacttccgacctcaggtgacccatccagctcggcctcccaaagtgctgggattacaggtgtgagccactgcacctggccaccaacttgctattctacacgttaagcaactactttcttgggtttacttacttgagaagtgagccacttaaaacacaagcctgaaacattgcttccaccaactaaaactcctctactaggcctaatctctgttctcacaggctgagacagacagaagcatagagctgtcttgctggcattgattccctatacagctgaaatcccattctcagctaaactttatcctctgtagaaggactaagcacattttagagttttgcaaagggcttgtcagtttcacacaccccagggaagggtgttgtagctccatttactcaacagctattgcttgaacacttaccacataacaaatattgtcctaagtgctggggctaccgtggtaagcaaactctgaccgggctcttgccttcatggagcttacagtatgatgggggaagagccagacattcatcagagaaccacacaaatacttataaaaccccattctccaagcaaaggcaaatgttgctatgagagctttcaagaacgggagttggccaggcatggtggctcacacctgtaatcccagcattttgggaggccaaggcagacagatcacttgaggacaggagttcgagaccagcctggccaacatggtgaaaccccatctctactaaaaatacaaaaattggccaggcacggtggctcatgcatgtaatcccagcactttggaaggccgaggcaggcagatcacaaggtcaagagatcaagaccagcttcaccaacatggtgaaaccccatctctactaaaaatataaaaaattagttgggcatggtggcgcatgcctgtaggcccagctactcaggaggctgaggcaggagaaacacttgaagctgggaggcggaggttgcagtgagccaagattgcaccactgcactccagcctggcgacagagtgagactctgtcaaaaaaaaaaaaaaatagccagcgtggttgtaggcgcctataatctgagctactcgggaggctgaggcaggataattgcttgaacctggaaagcgaaggttgcagtgagctgagatcgtgccactgcactccagcctgggtgacagagcaagactcagaaaaaaaaaaaaggaggggaattaatttatttcagggattagaaaggctttgctaagggagtgacatctgaacagtgaggtgcaggaactaggtgaacgtgagcaggtgggaaattgggagagcgctccagacagaaggaacagcatatgcagaggctctatggaagaaaagcacatggtgcattgcaggaactgaggaagactgatgaggttgcagaagaaaaagcaagggaggggccaggaggtttagggaatggtgggcccagtacagctggaaacagagccaagggcagactatgccagtcttaaaaactgaaccaaagggatggccctttacaagaagccattaaagtgttctcagtgcaacatgattagatttatgttttaaaatgttctctttggctaaaatgtgaaaaaacagattagaagtggagccagaatcaataaacatggaccagttaggaaggtggtgctgtaatcctttagaaaagactgtggtatttattattagagtgatggtggtgggaaaatgtagacagatttgagagatatttaatagataaaacttacagggcataaggccatgttgtgctatagactgaataggtatgttcccccacccccaaactcatatgttgaaacctatccccagtgtcatggtattaggaggtgtggcctttgggggtgattaggtcataagggtagaaccctcatgcatagaattagtgtgctaataaaaggaacttggagaagtccttgccccttccaccatgtgagaacacatcaagaagacagccatctatcaaccaggaagtgggttctcaccagacactgaatttgaaggtgccttgatcctggacttccagcctccagaactgtgagtagtaagtgtctgttgtttgtgagccacctgtactatagtattatgttacagcagcccgaacagactaagacatgtgtcaacaggaagttagaaaagtataatggttaaagtattgggttttaaagcaagaaaggcctgggtttgagtcccagctttaccattaagtgcctatgtgatttttagctaggaatttaacctcttgtgaattcaggtttacaaccctgcaattcaggattctaatagtatctcattcatagagctgttgtggggactacatgagctaatgcctgaatagcactcagcacttcagtgcctggcatgtggtcaataaatgaaagatattattagcatcattattatgcttctagttattattactattagtctagatgtttctgaagttggcaaaccatcactctccatttcacattgcaatagcctaatagagctaggacaccagttcctgagagcaacaaaatacaatcccagggccatcacaggctgagagacagctgccaggacagcaacctgacttcctcctccaccaggcccagggcctgtcctcctcatccgtcttttcattctgtctcactttacaaagaatcttcttcttatatatcactgtagttgggcccccaaggtcccctgtctgcattagcaagaggtaccaaagatagcaacagttgcagattgccttcagcccagcttcatcccaatgcctgcatcatggtgttctatacatttgtaaaatatgagacattgtgcccatatgaaatcagagaaaaatcatttctttcctttttttttttttttttttggaaacggagttttgctcttgttgcccaaactggagtgcaatggcgcaatcttggctcaccgcaacctctgcctcctgggttcaagtgattctcctgcctcagcctcctgagtagctgggattacaggcatgcgccaccacacctggctaactttttgtatcttttagtagaaacagggtttcaccatgttagccaggctggtctcgaactcctgacctcaggtgatctgcccgccttggcctcccaaagtgctgggattacaggagtgagccattgcgcccaacccgaataatcatttctacttctgtcattcctactttaagtatctgtgttgataccatgacaaaacttgccgtaattaaaatatgttgtggatttatcaaaagcagcggccccaggatctaccagaagtgcatctttattcaaatgaacacgtgtgcaactcaacaaatggctctcttcttccacctccctcccttagtcttaaatctcttcaaaaccaacttgtacacacagtgcagtgaaacttcaatcaaagtagctctcttactttttaaaggttaaggggcattttatcagtcagggtcttgatgtagtcagtagaggtccggcttggtcttctagaaatctaggagccacttgttacgtaatggcctgtagtggaatcaatagtctgttgacaagggagaaaggacaaacgaggacagagggacttattttcctgacaagtaagtgcctcaggaggatttgcattcaaagtcctcggattcacccaaatcctacaaatgcccctgttccagttctcatagcccactctttacaataagaactttagctttcatgtaagagacttggcaagtctttgaatttattttatgctgtaattttgcaacatgcagaagcggaccttaggtctgatttttggctatatcagcaatgtagctacaagggtcctagaagtcctctagtccttgaccaggccttgatccaaaagtgtaaagtttcccagcttgccattttctttctatggtctctggtgcagtcagaagtagatgacacaccccatggtctttctcgttctctttcctactttcagactctagagcagcggtcaacttagtctccacaattcttgatttcaataggtccttcacttccgacaaccacaggtgttaattcaaggaagtgtttgccaccatgtgccatgtctcttcataattctattttgcactagaattaggcaattaggtcatcactgtaagcaaatgcaaccaggtcaaacaacaagattctcatctttgaagctctggaaccaatcttggcatgaaatattgtgtcagtccagattcattaaagaaaaatcaaagcaacttaaggagtgttggaaaggctagagaagtgatcatcatcaggctgccttcagctttcaggtaagcaccattgcaagtgcaatccagagctcggcaagttgctgctgccacccagaggtcaagatactgcagcaaaccgccaacagcatcacagctgcccttgctcagaggctaggcctggtgagggagctgggtgttcagccagcctctgtaaaactactgccgttgccgctggagggagaatttctcagtgtctacattgccttccaaatctcatgtgagagcactggcagaatgcaaatttcacccaaacccctcaggaaagggagcctgagaaatgtaatgcccaaacttctagctccagagatacaggagagagcacagaaagaggagtgaatgcaggttgtttgccgagaaacagtatccagtacaaacacagacttgggtgaactggtgaatgcaaatgtttactgaaattaacatttacagaaattctaggctggccgcggtggctcatgtctgtcatcccagcactttgggaggctgaggtgggtggattacttgagtttaggagttcgagaccaggtgggccaacgtggtgaaaccctgtctctactgaaactgcaaaaacaaaaatagctgagtatggtagcacacggctgtaatctcagctactcaggaggccaaggcaggagaatcgcttaaatttatgaaacagaggttgcagtgagtcaagattgtgctctgtactacagcctgggccacagagcaagactgtctcaaaaaaaaaaaaagaaaaaaaagaaaaatgtacagaaattctactttaataagttaaatcttttaaatctcttataactctaacattaatattgttttagaattttaaaagttaagattttaatactttttaaaaaatgaaacattttagcattgctgaataaattttaaaatattaattccccagtgaaatgttcttgtccctttctccccatgcttccttcgggagttgatcttcttagaccattggtctctcctctacttagccacccactcccgtgatcatagtcttgaccttgtcatgatgaacagtaacaattatttgtgatgataatctcaactggaaacactccactctctgatcactgactcttttgttcccagtactctccctgttgcattccaattccaataacccctcaactgaataggacctcacatccattgggagggtcaccgatggcccttgggatgcctttgtttgaattcttcaagatttttttttttttctgtgagacagagtctcactctgttacccaggctggactgcagtggtgcaatctcagctcactgcagcctcgacctcctgtgctcaagcaatcctcccacctcagcctctgagtagctgggacttcaggcgcttgccaccatgcctggctgattttgtttttattttttgtagagacaaggtttcattatgttgcccaggctggtcttgaacttctgggctcaatcagtcttcccaccttggcctcccaaaatgttaggattacgggcacgaaccaccatgcctagcagatatttcaactccatcttttggaaactattgtaaaagatcacttttgataaaacaagatggttgagtgccatctttcagaaaattacaatgcgtacccaaatcttaaattccatttatggatgatgcccacctgaaagatgttaccttacgtgtatgtagtgcataacccacattaaccatatgtggctgctcagtgacagttgattctgcaatttttttcattgtctatctccccctttatgttcatcccttttaaaatggtttaaattccacatgtaaccatcctactcacctcttgaatttatcctcaagcactgtccctcttgccttgtcatactcacttggctaacacacatcccttgttaaattcagctctgcctacttcgtgcctgcacccacactgctgaatatggctgggggaacactaccttatgctaactggtctttgcctttatggcaaatcactaaatcaaatgcccctgaatgctctatttctctaaccaatatactctcccacttccctaaacaaatatcatactttttcctatcttcccagatttccccaaatgttcccccatatctaaattttcagctattaactttgtttcctatttactattttaagcaatcaaagagaatttccacaagctgccactagcatatgcatgcatgttgtcagtgcctgcatataatgttccaatttgtcttctgttgctaggaatgaactctttaagctcctagttaaggccacctcctccacttatatattcgatctatcccttcctgtcaacaatgtttttctctattcctagcatcatgactttcttttctctttgctagttcattcccatcagcatataaacatgctattcctcccatattaacaacaacaaactttcttgttcaccacctaaactccaaatactacctcatttctctcctaaattttaagaaaaatttcttgaaagagtggtctacactctgttggcaatttctctcttcccacttgctcccgaactcaccacaggccagctttcacccccagcatgccaccttagctaggttaccagcgacttctttgctaaacctaatattcctatctctgtccctatcttgatctattagaagcatttagttatttcctctttccttctcaagatagttttctcacttggcttctgaacctgcctcttccctcactttctctcttctggctgcttcttggtctcctttgctgcatccctcttatctcctcaacctctagactttgggggaccaagagctccatctttggtgcttttctatttcccagctgcactaattcctaggggattttattcaatttcatggtgttaaatatcatgtgtatgctacgaactcccaaatttaggtatctaacccagatatctcttctgaactccagacttctatatccaattgccttcccaggcagtttaagaggcatcccaaataaagctggtccaaaactaaatctgtgaccttttcttccaaacttgcccctttgtttgacttcctcacatcatttaatggtaacttccatccttttcagttgctcaagcctaaagtcttggcatcatacttgacaattctttttttctcattgctcaccttcagtccattggcaaacatgttgattctatttttaaaacatattcagagaacatccttgttcttagaaaatagactctaaaatatttagcaattgtagggcatgatgtctctaacatcctttcaagtagttcagaaaacataatataatgaaacatagagaaggatggttaaagaaagtaaatggagcaaaatgtcagcaaactgatgaatctggttggaaggcatacagggagttttgtgtaatactcttgaaacttttctgtaggttacaaaaagtctaatgaatctaaaaatctattacttatcaactccaccattactaccctagacatcatctctagccttcaagctaccctttttttcttttttttcttttttttttccttttagacagagtctcgctctgtcgcccaggttggagtgcagtggtgcgatttcagctcactgcaacctccacttcctgggttcaagccattctctacctcagcctcccaagtagctgggattacaggcacctgccaccatgcctggctaattttttgtatttttagtagagacagggtttcaccatctttgccaggttggtcttgaactcctgaccttgtgatccaccctcctcggcctcccaaactgctaggattacaggcgtgagcttccgtgcctggctgccttcaggctactcttaacgtaacagtcacataaatcttattatatcataaaccagatgatgtcactcctttgctcaaagccctctaatagcattccatattacttacagtgaagtcctcttatgatctataaagccctatatgatttgccccatctcctcattaactacctagccccatctgcaaccctccccttcacttactgacccgcagcttgcatgcattccttgatgttcctgaaggttactaggcaagctcccactgcaggacctttttccatgatattctctctgcgggcaaattcaattctgaaagttgctcatattcacatgtctggccttctaacttttttcaggtctttcatcaaagcattaccctctcagtgaactctttcctgaatgtcctgtataaaatttttaaacaccctccactcttctttgaacattctacctttatgccatactttatttttttctgcagcacttagcactaacattgtatatatattttcttacttatctaatttattttgtgtctgtccctaaaatgtaagctccatgagggcagctatttcagtatatttgttaactcttatgttcttagcatttaaaacaagcacataaaagatactcaatttatgtttgttgaataaataaatgaatgaacataccaatctcactatgccttatggaattctacataccatcaattataaagttacgttattgtcaaacccattagaaactgattgctcaaatctctgggacatcctgatcttcaatgggtcatcaattaggatattcccatgtttcatggtataaagtaatagaaaaatatatttttttcccttcagctcttaatattatcctttcttcttggttcataattttttaactactctaaagcacttctgtcattgtacttttggctctgtttggatatacagttctatgtctgaaatggtttctgataagtagacagctctgaaatcccctgatacatccacttctgagatgttgtagagcttttcatattccccttgagtttgtgtaattatttaggaatattggcaacttttctttgcctttatcatatattaattaatatcatctaccttttgtctgcccttatttttattttttttctcaaaggttcttaacattttctggatcatttaaaaagcttttttataggccactatcagtctatctgacttgtgcataatggctttgctaaatactatttagaactgagcttttgtttacaagataactgtgccagtaatgacattaggttgtagctgagtttgcagtgggagaggatcatgtggattacataatttcttaactggattcctaccaagagtgttccagagtgactgaatgaactcactagcacacacagttttatccaccacttggaaatacttcaaggagcctccgaaaaggaaagacgatctttacttgtgagtttctccttcctggtttatttcattacccatatctatttccagctggaaaatttgtgagaaatcaccagatgaacatgtatcagttcagatgcattgtgatgccaggaaaagaaaagccagtggacacaggcaaaaataaaaataaaggagatttattagcttgcaaaaatccaaaaggacaagtttcaggattcattccagtttacatcaacgatctggtttctttctattcttcttttctgctgtccacatgttgagttcattctaaggctgatccttatgtttgttggatgtgtaccggcaataattagactggtacatacttttgtttcacccactgagagagaaagtatttgtgtctaaaattccatgcgaatgtcttgaatattgctctaattaggctagcttaggttgtgtgcctagtggcctcctcccaaccactttggtgaagaaaaataaaatgttctgattgcctttcacccagtcagacccatcattggcataacatcttcctgaagcaaatggcctacatagcaaagtgtagatacctgtatttggccccaaaaggaaagggaagtcagaagtcacaaacactagatgagggtaatttgaggtgaagtccattttattttggtttgttttattcaaagggccaaattacaaagtgtgaagggggaatagtggaaccataagacatagccagggaacttggagtgagcaagagcagagctgctattgatcccaggcccagaggaaatcagggagggagagcttactggaatgcaaaggaagagtcctgtagagaataatatattgataggagcaatgaccctgggagaacacaggtaacctcagaggagcttagggagggaactagggaaattagcactctgatattcttgttttctcctgtttctactgggattccccattgtttaaaacaaaccagaagcctgaggatgcaggagcagtgtgatgctgcccacgctggtcattctttcaggacagagcagaatggaaaaggacaggaacaaatgggaagtattctgtgcagtatctgaattaaaatgtgggtactgcaaagaagataggagaggacaataaatgctggagagacagccaatcaatgctgcctacagaccagaagtgtttgactcactaatcttacctagaggccttcagataattatgacaccacttagtattccaaaaaataatacaaaacaaaaagccttttaagtataatgtctatctatctatctatctatctatctatctatctatctatctatctaaatattctcctacctcagtggtgagaagcatagacaaactatttatcttaattaaccatattgattgtcatcagctatatcagcagttacagaaaggatattaactaatgatgggtcatattgcttaacttctaggacagcttcatggctgaaaatgttctgtatgtgaaagatgatcatgtggatgatagagaatttatattctctctttcttgaagatcaaataagagaaaaatgagtttactaagcaggaaatattttgataaaatagaggtagacattcttgataataggatacattaaaccctaaaaggttttttttttctcctgattatctttgagcaccattttgcaatttctctgcctatgttctaaaatccatctggcaaccaacggggcctaaaatggatataattaatttcggctccccaagcacagaattgctatgtgtcccggggggctcccactgtgacaactgctgtggttgtaggggcagtggacttcattccatctccatccagagctagccttgggcaattcagatggccaagccattacactgcagagcagggtcctcagctgcctccttcattcacttcatgtgtcatgatagggacaaaagcataaaatgataggctagaccagcaaatgcaggtctcaaaatccaggcagatatgccgagttagggtatacaacattcgttcagtcactcaatatttattgagtacctactacatatgggccaggcaatgttttttggtgctttctagagcagtgcacgggagaaaaaagaaagaaagaaagaaagaaaactttgcattcataaagtttatcttctagtggaaaatgtagacagcaaacaatgtctatacaaatatataccatattggataataatggctgctagggagaaaaaatatagcagagaagagacaaaagatgtgtcaagtcaatggctgaaattttagtgtaatttctgaaaatagtcctgaaaaaagtaaatgaggatgtcgtaaggaggatagctggggaaaacattctggggagagcaaagagcaagggtgaaggccctgaggttgaaaattccttgctctatttaaggaatgggaaggaagctagagtagccagaatggagtgggtgagggggagatgaagtcatagaaatgatggtggtggtgaagcataaactgtataagcctggtaggtcattatagggaatttgccattattccaagagaggtgggaatcccctggatagccctgaacccaagaatgacatgaagtgacttgtgtttgcaggagataactgactactgtgttgagaatagatggacagattcaagtcagaaggagagagaccaattaagagtccattgctgcaacacagtgagagaggatggtggcttggaagagggtggtggtgatgaaggtggtgagaagtgatcaaattctaatatgtttgggaacttgtaagatttattcacagtctggatgtgaataaagatagaaaaatcatcaggatgttaagatcagtggaatgtttccgaagatttctcacgaaaaaattggagttctaacaggtctgaaattaaaagggcatcattctcatagggtaagttccaagtgaaattctgggccaatcaaaatgtgcagaataacaaagattctaagcccaggataagatccagagtgaatcaaggtgatgtaagaatggctgagaaagtgattggcaattctatatcagatgatcggcacatctccaggcaagaaggcattaggcatatctaagaacatgcatcatggtaattttgactgtggcaaatgtggagtattaggcagtagtttggtcattgtggaaaaagacagccactcattggttcagagaagggtctagttacagagaattaaggctagatctgggctggcagcataaccaatatgctgcttagctactgagctacagccctacggtcctctttatattgctttagctaatcaaggtctgatattagaggccggggctgggctgaaacctaatgggaagtatagcgggttaaatgacaggaagccaggcaagctaagagccagaagcaatgcacctggaagtcttattctcttgaagacttcaaatactaacagaacaggaaggtcagtaataatgacagaggcatttttatccttctggggctcctacagcctctactgcttcggctgctgccccaaggactttctgatggtgcatcagtctgcgtatactagaggtggctcccgggacttctttagactgggttcctgctactcctggctgttattgggttaaagaaaagaagtaactttccagatagagatatgtaaattgcaaaaagcatggaagtaagaaattatttggcatgtgtagaaatgatgaggagtcatattttgttgaaataggggactggcaaaaggtgaatccaggaagaatggcttttaagaccagggtgattcatctctatgtggagtcattaatgattcgtgaggaaagaagtaacagcatgggtgctgcatttgaaaaagctttatgcaacctcagggaaaggatggatttgtctgctacggctgccagagcaaaatacctgacactgagtggctgaaactacagaaatttattgtctcacagttctggaggctggaagcctgaaaccgaggaactaccagcattggtttctacgaaggcctctctccttggcttgcaggtgggtggtagccttctcactgtgtcttcacatggccttttctctgtgcctgagcatccccggtgtctctatgtctcctcataaggacaccagtcattttggattaatgtccccatccttataacttcacttaaccttcattacctttgtgaagaccctatctccaaatatagtcacattgaaggttaggacttcaacatatgaatttagggggcacacaatcaatccaaaacagaaggccatgaaagcaaagccaagaatattgttatcagtttactgcggggaggaaattgggatctgaactaagctgatcatagtggaaaggaaaagaaggtggctctgaaagacatttcataggtaaaagctataatgactgagcagctgattgaatgtagaagccaagaaagagaaatcaaccataaatcgtaagtattcaacctgggtagcaaggagaaagatattgaccttaaacaaacatgggttctttttctatgtgtatttgcgtctttcactttgtccttcatttattttctctagataccacacttccaccctaatttatttctctatttctatctcctccaaattgctactgcagcagaaattctgacattctccacttggttaatcttccttaagacaattccaggaaacaaatctccatataaataaatccaacatatcacttctactgtgccctgttctgtccctcttcctacgttctcaggcagtgcagttatttctttttgattgctttatctgtttactagttcctctgctgctcttggttaatattcctccctcctatttctgttgtcattttttattcagtctcagctattgccaaaaccatcatgtccaagttattacttgatgatttacatataaagaaaccattttaaaggtagtttattatcaaggagggaaacgcagtacaaataaaaagaaccactttataaatgatctgttgtacttttggaactcagtctcccaaaatagtactgactaaaatatggtaggttacacaaactcagaaatgagggaccccacatagaagattatgaaagaggtggattagacaaatttatggacagttgttaaaaaaacaggttataattagaccaatggaacagaacaggggcctcagaaataacaccacatatctacaaccatctaatcatcgacaaacctgacaaaaacaagcaattgggaaaggattccctatttaataaatggtgctggggaaactggctagccatatgcagcaaattgaaactggaccctttccttacaccttatacaaaaattaacttaaggtggattgaagacttaaatgtaaaacccaaaaccataaaaaccctagaagaaaacctaggcaataccattcaggacataggcatgggcaaagacttcatgactaaaacaccaaaagcaatggcaacaaaagccaaaattgacaaattggatctaatcaaactaaagagcttctgcacagcaaaagaaactaccaacagagtgaacaggcaacctacagaatgggagaagatttttgcaatctacccatctgacaaagggctaatatccagaatctacaaagaactcaaacaaatttacaaggaaaaaaaaacccatcaaaaagcgggcaaaggatatgaacagacacttctcaaaagaagacatttatgaggccaacaaacatatgaaaaaaagctcatcatcactggtcattagagaaatgcaaatcaaaaccacagtgagataccatctcacaccagttagaatggcgatcattaaaaagtcagggaacaacggatgctggtgaggctgtggagaaataggaatgcttttacactgttggtgggagtgtaaattagttcaaacattgcggaagacaatgtggagattcctcaaggatctagaaacagaaataccatttgacccagcaatcccattactgggtatatacccaaaggattataaatcattctactataaagacacatgcacacgtatgtttattgcagcactatttacaatagaaaagacttagaaccaacccaaatgcccatcaatgatagactggataaagaaaatatagcacatatacaccatgtaatattttgcagccatgaaaaagaatgagttcatgtccattgcagggacatggatgaagctggaaaccatcattctcagcaaactaacacaggaacagaaaagcaaacaccacatgttctcattcataagtgggagttgaacaataagaacacatggacacagggaggggatcatcacacataggaccctgtggggggtgttggggcaaagggagggagagcattaggacacatacctaatgcatgcgggcttaaaacctagataggctgggcgtggtggctcacacctgtaatcccaacactttgggaggctgaggcaggcagatcatgaggttaggagttcgagaccagcctgaccaacatggcaaaacaccgtctcttctgaaaatacaaaaattacccagcgtggtggcacacgcctgtaatcccagctactcaggaggctgaggcagaagaattgcttgaacccgggaggcagaggttgcagtgagcggagatagcaccactgcactccagcttgggtgacagagcgagactccatctcaaaaaaaaaaaaaagaaaaacctagatgatgggttgataggtgcagcaaaccaccatggcacacgtatacctttataacaaggctgcatgttctgcacatgtatcccagaacttaaagtaaaattaaaaaaagaaaatagattataatggaaattgtattatttgaagatattttcctctacattttctgacttatgtgttagcactgctttccaaatgttatatctaaattatccaaggaaaacaaaagataaaattaagaaatgggcaagggacctgaatagacatttttcaaaagaagacatacaaatatatctagccaacagatatatgaaaaaatgctccacaccactaatcattacagagatgcaaattacaaccacaatgagatattatctcacacctgttgaatagctatatcaaaaggacaaaagataacaagtgttgccaaagatgtggagaagagggaacctatgtacactgttggtggagatgtaaattagtacagccattatggaaaaaagtatggaggctcttcaaaaacctaaaagtagaattaccatattattcgataatcccactttcgggtatttacccaaaagacttgaaatctatatgtttaagagatgtctgcactcccatgtttattgtaataccattcaccatgttcaagttatggaatcaatctaagcatctatcaacagataaaccaataaacaaaatgtggtgtatatacacaatagaatactagttatccttcagaaatgaagaaatcctgtcatttgtgacaacatggatggaagtagagaatattacactgattgaaataagccaaacacagaaagacaaatactgcgtgttctcacttatttgcgagatctaaaacaattgaactcatagaagtacagagtagaatggtggttatcagaggctaggagataatagtcaaagggtaaaaatcttcagttacataggagggatagtctgatattttggaagtacattccacagtatggtgaatatagttgataattgagtattgtacattttgacattgctaagagagtaaatttcaaacgttctcatcacaaaaatgttaaatatttgcagagacggatgtgttaattagcttgatttaatcatctcatattatatgaaaaattataaccttactttttaccccataaacatatataactagaatttgtcaatataaaaaataagagtatatttgggttgaagcacatgtaaggctagtggagtgaatgtgcatgaactgactatcacattttctttgctataaattgtatcctatgatcagaggtgatatgtggtatactatcatgtcttagtctgtttgggctgttataacaaactattataaaccaggagtcttacaaacaacaaaaacttatttctcatagttctggaggggaggagatctaaacacccgtagattcagtgtctagtgagggccccttttctggctcatagatggcacctcctcactgtgtcctcacatgatggtagggacaaggcagctcttggggctccttttataagtcactaatctcacccattagagcactgctctcataatttaatcacttctcaaaggcctcacctcctaatatgatcacattggtgattaggtttcaatatatgaatttggaagggacaagaacattcagaccacaggagatggtacagacaatcttaacattgatgaatggaggagatactaatgaagttaatgagtgaggaggcaaatcttgacataaattttgcttccattcctatatgtatagataaatcactgtcctctgtatgatggaagaatccagtaggtggctggctgtattgagtcacagttagttgttgctgtttgcagactgggtacctagcagttgtagcagacaggtcagccttagtgatgggaagtccatgtttttgagttcatgcctaggctgcatctatgtcacatggtcactttgcacataggccctatcagcagcacagggcatgggaaaaagactgactcacatccattgagaagtaatcttgtctaccttattactgagaattttctccacctcggtgtgcccttggtaagcattaggtggaaaacaaatactttcatatttcatactttcttctttttacaaagcctccaactaactaaatatatatatatatatatagttagttatatatatacacacacacatacatatatatacacacatatatagttcccctccaaaccactatatagttctcctccaaattttcttataatcaattttctaattttcttcttttcaagtccctcttcaggtgacaaacctgctagtttgtccaagagtcatggtagatcaatagctcaggtcctctcttcttctacacaaagtgaactatcatctgtaacacttgaaagcctgccagccgggaggactttccatcactactatttttccagaggcatctctgtgtgagctttagtacatcagctgctcactttcaactgggctggcacagcaggaattcatctttgtatgagacccaagattttcttgtaacttttcataggaaattccccaggaagtcctcggtttgggacaagggtgaggcagcaaagtagtaaactgagagtctgcgcttcatgcaatgcatttgccttccagacaccctggggccagccctcatggataccacttccgctttacaatgtaattttgctgtgtatactcaagtttatggtttcatggtcagttcaaaacatgaaacacaggtcgcatggtaactcattgtattagtttcctagggctgccagaacaaagtacaacaaactgggaggcttaaaacgacagaacttttttctcccataatctggaacctagaggttccaaatcaaggtgttggcagggccatactctccctgaaggctctagaggtgaatttggtccttggctttctcttggcttccagtgtcgctgccaatccttggtgttccttgacttgtggacccatcactccaatctgcctccgttgtcacatgacattctacattctcctcgtgtgtctggctttgtgtcttcttcttttcttgtaaggacacccatcacagtgggttaagggcccaccatattccagtatcatctcaagtaagtacatctgcaatgaccctactttcaaataaggttgttctgaggttgcaggagggatatgaattttaaggggacaccattcaacccagtatacctatggtcccatggttgggtgttcagactccaccaaagccaaaaatccttcttttctaatgaagaatggtggtttggctgaacgcggtggctcacgtctgtaaatcctagccctcagggaggctgaggcaggtggatcacttaaggccaggagttcaagaccagcctggccaacatggtgaaaccccctctctactaaacatacaaaaaattagccaggcgtggtggcacctacctgtaaacccagctactctggaggctgaggcaccagaatcactttaacccaagaggtggaggttgaagtgagctgagattgtaccactgcactccagctgggtgacagagcaagactctatggaaaaaaaaaaaaaggatggtggtttgcagaagagggcaagacgaccttgctccccaaatcccaagggtctgcactattattcttttaatgggactattcagaggctttatacatctgtctgccccagagacttctgctacctgctgcatcataaggcccaagggtcaggatggctgccagagcccagacctgctgcagagccttttcttcctctgagccctattcaaaactagtagctttatcaattacagtaaatggactagaacaacttgatcaaagctggtattgttacctccaaaatcccaggaagctcaacacatatcacacttcttgttccacagtgagctgtgcaaggcacagcaacaatcctgttactctagaagggatattaccatgtttcatatcactgggcccctagcaatgtaacaagagagttaggctgctgaacttacagaacatttattttttatctgagtatgtaatgtttttatttatggatgtaataacttaaatcactcttagaatattaatctggcttcctctattggtttcctctaagaacaattttgtttgtttattaatgtatgtctgtctttcccctttaaacagccaattattctcatacagctgccaattcttgagtatctgtttacacttaagaaagaggacaggagaagggtgtgggttttctttctgtgatacataaatgtctttattctttttctctttttgctaattaagaatttctaattaagtcctgtgtggggaaggggtgggctatgtgttattcaataggcatcacttttgttgagtgattatctagttgcagattagcagattgaagagaactttcctcttgggcatcaacattgacaatagaagccttagtctcctccagaaagctcattaaaattatttaggaggagttctaggatttgcttctccccatcccaccctccttaaatcttaggcaagctgagacagttaatcgtcttagttagggcacctatattggcacaatcaggtggggaaaaggtataggagtaccacctggagtatttgttgtgtatacacgtcttcaattaacttcttttcagcattacttctcattcccactctgcttatcttcctgactttgaggtagggttcctagtttgctctatagaaaccaagttgggtattcgtgactgtggctttcttagctggtttcatccttacacgtgcgcacgcacacatacacacacacacacacaattcctaaactctcccggaaatctgttgtagtctctccccttctcaaggtattaattcctaatatatgtctcattttgtggttattccttttttgtgtttctattctttgatttcactgtgatgtcagaaaggatgggggctcacgaatatgctctcttgaagcaggtatttctttttctttttattaacaagattctatttgtggctttctacatttttataataaaacatttttaaacaaatatagaagtagagagaactcccatatgcccattatctaattttaacaatcttcaagactttgctatatttgtttcatccatacttaaaagttttttcatttgacaaatcatttttaggcaaattgtagacatcaagttatttcacccttacacagatcagtatgcatctctaaaaatgacattttcttatataactgcagtactattatcagtaacaaaattagcaatagcattttgatgcatctaatattcaatctataattaaatattcatcattgttcgaaaatgctttttacagtgattttaacgtgggatcaaacatggttgaattatgcatttggttgttaaatctctttagtataaagcagttgtccttttccctcttatttttcctgccattgatttcttactgaaactggatcaattgtcttgcataatgtctgaaggcatcagtcagcgctctccagagaaactgaaccaataatcaatcagcagggtcttactttcacccactctgtgactgtcaaccttttaactggaaggtttagagctttactgtccaatacagtagctattagctacttgaaatgtgcttagtccaaattgctatacacttgtaaaaatacatactggatttcaaagatgttccaaaagaaagaatgcaatatttttcattaataatttttagattgattgcatgtttaaacaatatctggatatatcagcatctttttatttgtttaatatggctaaaattttttaaatggtaaaatgacttactatattcctattagcagtactattttataacattaactcttaatgcaattacttatatagtttcactgaagtctactattttgttatttgttttctacttgttcccctctgtttttaaattctcagttcagtatttttcatagtcctcaggtaggcttttctttggtgctttggggagtggattttccaagagtttttagttgtaactagcagaaaggatgcgctgcagtggacttacgtgcccttaagagaactgaaactagtctaattacatttgaaagtaagaatgctgctagttctacttttacttattttaatttactgagattgttattgtggtttaatgtaaggtcaattgcctttaatgttccacaggagtttaaaaagtaaggtaattctctatttttaaggtctagtttttgatgtgtataggaattagatttataatattgatttttttttttttttacatatggctggtggcagaaactgcccttcaaacctatttcctcttatttttgagcactcaacaagaagcctcatttgcaatgaaataaggactatgtgattgagtttggaccaatggaatatgggcaaaaaatgatgtaccccacttcctggcctggaccctagaacctcctatacaaccatccatgatctctttcccctttgccagttgagtgaaggtgacaaggttccagatgatggtgggacaacgtgatgatagagcatgcatccctgaatgactgcatagagcagtcttcctctccccactaatgtgcattggacagcaattagagtgatcaataagctgagctttggaggtagctagtaaaatagctggagtttcttaccctagctaacatagaactctactatcctattgatatggtttggttatgtgtcccgactgaaatctcatgtggaattttaatccccatgtgtcaagggagtgacctagtaagaggtaattggattataggggaagattttctcatgctgttcttgtaaattgtcagtttcccctgcattctctctctctcctgccaccatgtaagacatgccttgcttccccttcgcattctggcgtgattgtaagtttcctgaggcctccccagatatgaagaacagtgagtcaattaaacctcttttctttataaactacccagtctcagggagtatctttacagcactttgaaaatggattaatacacctatgtaatgggttgaatggtgaccctcccttctccatccactacaaaaacatgtccacctggaatctgtgaatgtaacctgatttgggagagaaaaaaaaaggttttattcagatgtaattaagtttaggatcttgaaatgagggcatcctggattattgaggtgggctctaaatccaaccacaagtgtccctctaagaaggggagaaaacatggaaccacagagaaaaaggtgattaaggaaggaggcagaggtcgaagtaatgtaactacaaggaatgccaaggctctttatttacacttcaaacctactattctgtactcagatttgtgatctgcagcctcttaggtgacataggagcattgtatccctgatagtactatatttttgttgttgcttatatatgaggtaactatatgggaggaaagtgcagtaattactttttgaattcagcatattaaaagaacaaaggggagagatgagatcttcaaaatatttttgaggctggatcatactgatctagttaactttctagtggtgttttgaagaaggcgttttattgttttttaaaaggttctttaacattatttgaaatagttaatataaatattaactctttaacccacttttctctaaactctaaatagtttatttagttagttgactaaaatttagattcatttgtggcttacactgaatgaggttgagatgcctgaatgcccctgacataagaggtcctatcactaaggcattgagaaatacctggtgaggtgagtagcagcatccttgaaaagctctgtgttggctgtcctttgatgcctggatatgatggtgagaggtgggctcattgatttttctcaggataacggtgtgacataatggtgcggcagaggttatggcagctcctaatcaccaaagacaaggtgagtacacttaccttagtggataagaggttgaaaatatcagcatattttgtcctgaaggaatctttgctgggggctatttatttgatcacaatatccctagggttgaaatagattgatagcctacttaaatgttcttgatccaaataacagaaaaatatttctaagtttggattccaaatagaagaattactttacatacagcctcttaagaagggaagatgaaattctttcgaggaaggacactggagaattaacacaagattatactgtagatcttctttccaagacattttctagagtcatgtgtagagaggaaaaaggatatatttggactttatacggactgttggacactagctccaagttgatgtaagtgccgaaggattcaaaatgctgttttgtttcatcaatcaacaggaggtctatagtggacagataatgaatggagttttgtcccaaatttgaagtacattcgttcattagtccatctgtggttagttctccatttctggaatgcataactggaaaagacatatgcagcaacttatagaatcccactttggctctctgacctatggaagaaggacctttatggtaggaaggatcaagcagaagctactgaaactttctcttcttcaaaatagtaagcccaagaattgctttggattctgccttcagacttgagaaatacaagcttgctgaaacttagcacattcccatttattttttcagagatcttggtactatgcccatgtggaccctccaccaagcttggaggtaccagcaccagccaagcagggctctttactcagggtttgagttttagctctatggagctgttctttgaaacttataagttttataactccaatctctttcctttgcttcctcagctttaggagtggtagctgcttcctgaagttgcactccctgtgattccttggtgttggtgttccttttggcctttcagttctttaatactgaataaagggcctgactcgatatattttgatgtttgtcacctttctttctttcctttctgctcacctgtgggcaagctgatgagaaaccctgggtgttccctcctttagttctagagggaagttcaaactatagaaactctgcccacaccagaattctcaccttggccccgccccaccctctaaatatcacaaaaacatctatttgtcttctttctctgttttctaaagactttttggacctttctggtaagtttgccctgctgttcctagaaaatcccatgatgtgatgataaacttttctatactgtcttggtgtgtgtgaggcatcatcagtcttgacatctaaacagaattttggttgggggtccctcctgtttctgagaaataaccacaacaaatacctagttaagaattcttttttttttttttttttttttgagacggagtctcgctctgtcacccaggctggagtgcagtggcacaatctcggctcactgcaagctcagctccgcctcctgggttgaggccattctcctgcctcagcctccccagtagctgggactacaggcacccgccaccacgcccggctaattttttgtatttttagtagagacggggtttcactgtgttagccaggatggtctcaatctcctgatctcgtgatccacccgcctctgcctcccaaagtgctgagattacaggtgtgagccactgcgcccggacaagaattctttatattaaattatctctgttaaaataactgtgggttcctctctcttgactggatgcaaactgatacagtaggtgaattaaagacttccattcctaatgtgtttctattttctttttatttcctgtggtttacattttgcttaatgagttctgatgtgatattagttgataaacatcccatagctgtcataatttcattgtgtatttctcactctatagttataagatacttttctgttttgtttaatgcttttttttttactttaatttaccctgtctgataccaagagtgtgaatttgttatttttgttgttaatatttgcttggtacttttttgcttatttaaaaatacttcaaactttcagagttattctattttaaatgtatctcttgtatacaacagactcaaattttgttttgagagtcaatctgaaatttcttttcattaatagataagtttagactatttgcatttcttcatataaaagatgtagttcatctttattctatcatgataatttgttaatcttgcttgtttgtgtgtatgtctttattatttccttccttctgctaaatttgggcttagttcttctttttctaattccttgaggtgtaaagttaggttgcttagttcaaatttttcttcttttttattataggtgtttatggctatatatttccctcttagtgttacttttgctgcatcccttaagttttgatgtgttgtgtttccattttcatttgtctcaaggtatttttaaaattcccttttgattttgtctttgattcaatttccacatattcgtgttgtttattttgtatgtatttgtgaatatgctgattttcttactgttatcgatttccagttttattccattgtggttggaaaagttatgtagcatgatgtcaatcttcttaaatttgttgagacttgttttgtaatttaacattatatatcctggagaatgttccatgtgcaccttttcatccttttactttcattttatgtgtttcattaaatctgtagtgagtctttagtaaacagcactttactggaccctgtattttaaatctattcagccattccatgccttttgattgtggagtttaatatctttacattttaagtaattattgatgagtgagggcttactattgctagttcattaattgttttctgtgtgttttgcatttgtgttgtttctctctttctctcttgcttttttcctttattatttgatatttttgggtgagtgatttgattcttttctctttatactttgtgtatctattataggtatttttttcctttgtgattacttcaaggcttccataaaatatcttatagttataaccatctattttaaattgatgacaacttaacttgaatcacatacaaaactctacacttttattgcccaccttcatactttgtatttttgtggccagagttaatttctttttatattgtgtccattaacaaatatttatcttttagcttttatattagggttaaaataacttatgtaccaccacgacagtgttacattattctgtatttgtccatgtgtttatctttaccagtgaaatttatgcttttgtatgttatgttccttgcagagtgtttttgttccaatttaaagaactccttcaagtattttttgtaatataagtctcctctggcttgccatagatatatatgtatttttttttttttttttttttgctgagagatccattgatagtcttatagtgatttccttatatgtgatgagttgtttttctcttactgcttttaaagttctctttttccttgatttttattataatgatttgattataatgtcttgaaagagtcttctttaggctaatcctctttggaaatgttgagcttcataaatctagaggtctattttcttccccagatttggaacctttttggtcattatgtcttcaaataaccatctttccctattttctctctcttctccttctgggtatcctgtaggcataagttagttcgcttgcttgtgtcccataagtactgtagggtttcttcactctttttcattattttttttcttctctgacttgataatttcaaacgatctgtctttgagttcacttattcttttttctgtttgattgggtcaaccattgaagctctttattttttaaactcctttcattgaatttttaaactccacaacttgtttagttcttttttatgatttctatctatttgttggacttctctttttttcatgtattgttttcttgattttgttgagttgtctatctgtattctcttgtaactcactaagcctctttaaaacaattattttgaaggctaggcatggcggctcactcctgcaatcccaacattttgggaggccaaggtgggtggattgcttgagctcaggagttcaagaccagcctgggcaacatggtgaaaccccatctctaccaaaacacaccaaaattagctgggcatggtggtgcatgcctgtagttccagctactcaggaggctgaggtgggaggaccacttgagcctgagaggcagaggttgcagtgagctgagattgtgccactgcactccaacctgagtgacagagtgagagcccacctcagaaaaagaaagaaaaactattctgaattcttcattttgcaattcatagatctccatttctttggtgttggttactggaaatttactatgctcttttggagatgttatattttcctgatttttcttgttattcaaaggcttgtctgtgtatttgatggaacactgaccttttccagactttatgaactgacttctatgaggaaagatcttcacatgctggtgagtacaaggatgctaggtgggtgggatgcacaaattttggggacatttgcgggcaccagtttcagggatccacagggacactggttctgggggcacacagtagtgatggatctgatttggggtgcattgacatttggttcaaaggatatgggcagcatcagatccagggtggatggcatcagatttgagggatggttgtgcatgtggtggtgccagggcaggagggcagggcacaatggcatggactccgtgtagctcaattagctgagatctgcattggcaaagactgtggggattttctgtggtgaaggctgtggttatctgtggcagtggtaaggaccacggtatctttctatcctcctttttcaccaggggatgaagtggcaaccaagaagatttctcttgatgctgagctatgcaggcctgagatatgaggttacacaggtaaaatgcttcctactgttttctatgaggcgatcctcagtttttgtgctccacgggcttggtacagcttctttattagactctggacctctcccagagttatttttggcctacgaatagtggttaagttactgtttttgtagaaagacaagggctgagattgcctactccactatcttgctgatgttacatctacctaactctatttagtatttccatagtctctatatgtttagacagtatctattgactcttagatatgagcaatgcagatttagtgtattttttcttcttttcctcctattatctagcctacttacagcaatatcatattatttttcttactgcttatccttatatatttaataaatttaaacttaaattacttggtttattaactcttatttaaagtttgacagaggctgctcatcaaatttggtaatatttatggattcatattataactgataacttttcaaaggattcctggaaatatcaatggagaggaaaattatggcacagtcaggaatttttgctcattagagatggtacaccttcaagatatagaatattactcttaatgaatcaagggtagatatagcattaacaaaaatcaggacatctggattacaaattgatttgcctgtaaaaatatatacttttgagctacttagttaaatcttttttcaaatctgtaaaaatttttttgttattattattactcccattaataatgcatgcctggttttctggattcaccacaaaaatagaacttccctttgcagagaaggggaaaaccattctttctgttttttagtatgtcagaacaatgataagtcactgatttcatttcttatccagttccatcattttatagtgactaaaatttctcctaaattatggatgttgtttgagtttcattcccacaattttgactggttttggtgctctaatgtattttagtgttaagtttggaagaaatgcaacaaatactgcttgagtatttggccattttctacatagtacacaagaactttagtgcatttattttttacaaactatttttacaaaatagagataggcctattcaacctatctctattgggagctatagtgtattttttacttccataaagagaagagcaaacttttacagtttttattatgtctcccttttttttagagttttaactctaatcaaccacaacatcagctgaaattaaacacaaatccttattattcaaccacttttagatgtctagggtaataatacttttctgcttgaatagataataggtttcttccacattttaatgaatatgactgattcactcatgattttagattattattgctatattcatattaaggataactcagttgacttcaatagttgaatatttagctggttccattaaacaaactgacgaaataactgaaatatttttattttgagtttaaaatggaaaacaaaacctactttgcataactaattaaagctaaaattttgaattgcctttcaagaaaaataaaaaacacttgaatatttttatgatacaatacatacatattgaggctaaagtttcaaatgtaaaaacaactaatttttataggacaattgtattaatactttatattcataaattttgccattgttgaatcttctacattgttcaaaataagaaaagggtaaagagagcaagtagaccaaagagatgtcttgctatgggccttcagatctgagatttttataacattgcactttttagctacctacttatcaataaaatcctgtaaatctgataatacttatactgcctcgtgatcataatatacatagcatgcctgatgcaaacaactaaaataaaaagtgttatttgcaattgtaatagaggtgtcataggagtttttaggtttaccttttggccttagcaattataacagcagagataggaggttatgtattgccatcttctggtgagtttcattaactccttgcagtacttagatggtggataaggttttacaataggctctttatatgactgatttttccaaacaaatgcctttatcaataagaatatatatgtttattaaactaacaatattaacagtgattgaaataaaattacctgtttttagacacagatggttaagtttcaaaaggctggggttgtgatagttttggtcatcattgcatcctcagtacttgatacttttatgccaaatatggggattcaatacacacatgttgggttatattaataggtctcaattttatctttatttgatcttgactttacttccccagatcaaatggaaatttattgctgagtctgagaactctgggctgtttcaaaattttctgcccaaatttttcactctgcttcttgtttcatccaaattctggatgttaaaaagccccagtcttatataaaagggctgatttgctttcctttccaaacaccttatctcttccagtgtccaggttaaattcaagcagctggttttccccatggaatatacaggcaatgcctgagatccctccctagctctgcagctttatcacattgactccttaattctccattatggaagctttggccacagtgacatgtgactcttctgttctccattactgtgttatccttcatatatgcccctcctggcaattgaggcacatgactttacaggagtgcctttttgtgatgaaacttctcagagagtgcacattttggtcgtcaaagccaaacttcttaccatgaacaatatatactaaatctggagggattaaatatctaattcatcttactcatattatgtgttaaaaacagtggcacttcagtttagaagaacatgcataaggttaaaaacacaccagaagtagatgttctgcagcagttttgccttctttttttctctttaatcttttagatttatatgcttctctagcacaggaaaaataattttatagaaaagctgtttcctcacagtcttgtagtaagaaatcattttcccttccctatttgattgtgtcattatgttttcacatatctttctggtatatttccaggaggaactgtatctgagattatttcttcctttctattcttgcatatttgtgtccttctttattatctctgtcttttccgcttcataccatttaaaattctcgttatcctcttcctgactcactgattcctttgtggttatatattttcctatccttgcttggtcatttcctcactattctgtgattactatgatcacaaacatttttggtgtgatactatgaaaatgaactgagcttataagatacgttttctagaaaataaagattcaccttttatgcaaaagtatgacttgtgtctgtgaccaccgacagctttactgtcttctcctttgttaattaataaaaacaataacaaccataagttaataccaactatgtgtcaggcaccataggaagcacctttacgtatgttatttctgatatttataaacttcttatgaggcaagcattttgctacctcattttgcaaatgaaggaacaaaagcttagaaacaaaaagtagtatgtccaaggtcagtcagcagagttaagattagaatctagacttatgtgagtctgaattttgtgttcttctcatgaggttacagagcctttcaatactatagaagaatatttctactatgtcattgctattttacagaatacggataacctcaaatacgtaatacataatttcatgggtaacttaaaaaaatctggtgattataaaacagcactgtccagtagagttttctgtgctgatggaaatctgtatctatgatgtccatatggcagctgctagttacaagtgaatgaaagcttgctagctacaagcatatgaagcatgactagcattactgaaaaactgaattttaatttaatttagtcttaattaacttacatttaaatggacaaatatggccaccgtataggataatgtggttatagaataaacaagctttcttgtgattgttttataattattccagtattatagcatcaccggcccactttcaggtcttccgttccgctcagccactttgaaaccattgttagaaggacagaaaaaatgaattcttgactgtatccatagtaatgagtgttaatggcaatcactttgaaatgtcaatttctaagagcaatattatggcatcacaatgtatctttgttcatgtctagcttcttttcacttaatgtgaaaaaggtaacatttttgtctttaattgagacaattagcatcaaagtgtaatgtaaagggtttcctttaacaccactacttcacagcttattttccttgttgcagagcatcatttctttctgtctgtatgttccgtggttatatggtgcaaagaggctgaggttataccttctacaccctgggttattatctccatgtcaaaaattacatgttaacatgtacagatgctcttggacttactccaataaacctatcataagttgaaaatattggccgggtgcggtggctcacacctgtaatcccagcactttgggaggccgaggcgggcggatcacgaggtcaggagatcgagaccatcctggctaacatggtgaaaccccgtctctactaaaaatacaaaaaaaaaatagccgggcgtggtcgtgggcgcctgtagtcccagctactcgggaggctgaggcgggagaatggcgtgaacccgggaggcagagcttgcagtgagccgcgatggcgccactgcactccaggctgggtgacagagagagactccgtctcaaaaaaaaaaaaaagaaataaaatttaaagttatgtaaaaatatagacccacacaatacatctctatcttattgtaaagtgtcccttatttgattcttttctattataaaattagtcattatgttacaaaaacaatcctctaaaagctcccttaaatcatgaactcccaagtgttattaaaagattaccattatttttaaggaagcatatctattgcctgtatgatacacctaaaattagtttgatgagggttaattcaggttataataataaaccagagttgtttcaagcaatagtttgcacttcagagtgtttaacacaatctcagttaggagatgaaaagtatttggaaattgagaactttggatttttggggattcattacccactaatgtaaactgtgtgtgataaaaaaaaaaaaatcactcccagtggaatacatatccactgattacacacacactttcaaggatatttctctactgtgtccttccctggaattcctctcataagggtgtgaaccaagtaagaggaaatgagtctttaatatgcttaaaaacaactacttcagcactggcttgcattttgctttcaaaatttcaatgaccagtaagagacagagaagagactgatggaagcaaaagtcagaggaaaaaaaattcattattatatttactatggtacctttccaaagctcagacagcatttttattgatgacaaaaaagtacattctgtagacaacgctattgggaacattttgtatctggacgatttatctgagccagttagacatatgcttctacatgtcatcaattcccctggaacaaattggtataataaagacgtattttttcttcctatgggaaaacgcaaactatcttctttattgtttacctacattttttcaaggtaaaattattttaaattattcaaaagcattaaatcatgctactattcccatgtaaaaattaataatatatgttcaaatgtaacatttactgaaaacattttctaccgttgttttactgtttcctttttctcagtttctactagtcatttaattttcagtgctattgcataaatataatttctacaaagatactgattgagacattgaataaacccgttttgtctctgttaaagtccactaccattgtttcattttaaataactatcttctcatattaatagcctgacatttaaaaaatacacaagaactcactataattagataataattaccataaaattaggtcaaaataatagctagaatagcttagagattttctaatacaaattctttcataagacattaataataggactttgtgtatatcaggcactaattacagctgctgtatactgacctaatgatcgaaatgctttaaatgggtcatttcattagatcacttctcagttctgtgtgatgagtgttattgtcacccctattaacaaatgaagaaatttaaattcagagaagcaaacatggaggaaagagtggaaggaatgaaagaaggaaatcagttggcaaagaaccaaggatgtaaaatgccagtgatgtagtcaagacacgtgccagctcctaaaacaagaatataaacagaatataaacagaaaaatcataaatagtggtaggctgctggaaaacttactaataacagaatgcaagttttagctaaaaactaatttttgtttattaaactttaagttctgggatacatgtgcagaatgtgcaggtttgttacagaggtatacatgtgccatggtggtttgctgcacccatcaacccgtcatctatattaggtatttctcctaatggtatccctacactagccccccagtccccgacaggccccagtgtgtgatattcccctccctgtgtccatgtattctcattgttcaactcccactcatgagtgagaacatgtggtgtttggttttctgttcctgtgttagttttctgagaatagtggtttccagcttcatccatgtccctgcaaaggacacgaactcatccttttttatagttgcatagtattccatggtgtatgtgtgccacattctctttatccagtctataattgatgggcatttgggttggttctagtctttgctattgtgaacagtgctgcaataaacatacgtgtgcatgtgtttttagagtagaatgatttataatcctttgagtatatacccagtaatgggattgctgggtcaaattgtatttctggttctagaaacttgaggaattgctacactgtcttccacaatgtattcgaagttctggccagggcaatcatgcaagagaaagaaataatgggtattcaaataggaagagaggaagtcaaattgtctctttttgcagatgacatgattgtatatttagaaaaccccatcatctcagcccaaaatctccttaagctgataagcaacttcagcaaagtctcaggatacaaaatcaatgtgcaaaaatcacaagcattcctatacaccaataatagacagccaaatcatgagtgaactcccattcacaattactacaaagagaataaaatacctaggaatacaacttgcaagggatgggaaggacctcttccaggagaactacaaaccactgctcaaggaaataagagaggacacaaacaaatggaaaaatattccatgctcatggataggaataatcaatatcatgaaaatggccatactgccaaacgtaatttatagattcaatcctatccccatcaagataccattgactttcttcacagaattagaaaaaactgctttaaatttcatatggaactgaaaaagagccagtatagccacgacaaccctaagcacaaagaacaaagctggaggcatcatgctaattgacttcaaactatactacaaggctacagtaacaaaacagcacggtactggtaccaaaacagatttatagactaatggaacagaacagaggcctgagaaataacgctacatatctacaaccatctgacctttgacaaacctgacaaaaacaagcaatggggaaaggattccctatttaataaatggtgttgggaaaactggctagccatatgcagaaaactgaaatgaccccttccttacaccttatacaaaaattaattcaagatggattaaagacttaaaagtaagacctaaaaccataaaaaccctagaagaaaacctagacaatatcattcaggacataggcatgggcaaagacttcatgactaaaacaccaaaagcaatggcaacaaaagccaaaattgacaaatggtatctaattaaactaaagagcttctgcacagcaaaagaaactatcatcagagtgaacaggcaacctaaagaatgggagaaaaattttgctatttatccatctgaaaaacggctaatatccagaatctacaaaaaaaaaaaaaaaatcaaaaagtgggcaaaggatatgaacagacacttctaaaaagaagatatttatgtggccaacaaacatatgaaaaaaagctcatcatcactggtcattagagaaatgcaaatcaaaaccacaatcagataccatctcactccagttagaatggtaatcattaaaaagtcaggaaacaacagattctggagaggatgtgaagaaatagggacacttttacattgttggtgggagtctaaattgttatatttaagaagaaatacaaattagaactgactttaaagataaaaatgaagctcttatggtttcccatagaagtgttctattgtaaggcctttggcacttggtaactaattattatgtaaaatgagcttttaaggcaaatagaatttagtgatactggctttagattaaattgttggagccctttttactggttaggaaaaaggctcactggagttcaatgaccaccagtgactcctttagtacctgaatgtcgacgagaaagtctagcccagggtctggtgtctcagaagagattatggaagggggaaaaaaaagagatgcttacctccttcactccttagagtcatttccaacattccaattatttgagaggaggaaagagttcctgattccaactctaccagctgccttgatgtcacggcagacaggcacagaaagaatctgggcaggtgatctgaatgtgaatcctcatgaaaacaaaaccatggagcaccctctggccaagtgaaaacctgagtgagggtggaaggggcgtagcaggagtggctgcattgagaagagaggactatgggctgcggtagccactgcacttagcactttagccatctctagtcactccccactcccacctggtgtcttcagccctgctctccattttgctctctcctccttagatttaacactgttgtcgttgttgccgtatttttactaaccaaaccttgcatagcctgctacgtgttgcgaatctggattcatatctactcccttatttaattcttgccatactcatatacaccaaatattactagaatcctcattttacagagaagacctatgctttattatgagtggatggggagatggctgttgctctatgaaatcccacaaatgctagggttcataggctttactctggagcatggaccccctagactaggtgtcttgcttttccctaaaaagttcacagaacctttttggaaaggacatcactttttacctggggtgaggaaggggtgggtgaggaggggtgaggagggagaggagtggagagtggcagtagaggagtgggctttggggacatggtatgggagaatgcctggataccaggctgtcagatgctcttctcaggctggggacttgtaggggaaatggggagcagtctgcacaaggaacatacttatagttaatctctttatttacattcccatatctcacacatacttttactcaaatcaggcatattcatgtcccaaggttctttgaggtttggcaaggtagatggatttgattcctaatgagcttctctctgtcttcttttactcaccatgccatcattcatgtcagtcttcagaaagcattgaaattccttactaaatccaattgtgtattttttctagtgaatttctatactctcattcttttttttaaattaagctttttattttgagataattataaatgtgcatgcagttctacgaagtaatatggagggatcccttgaatcatttacccagtttcgcccaatagaaacatcttgcaaaactatagttttgtaatgtgcaacattacgactgggatattgacatggatacaatccattgatcttatttagatttttccagctttacatacatctatgtgcatgtgtgtgtgcatgcatttgcttatttctctgcaattttatcacatgtgtaagttcatgtatccaccagtcaagatacaaaacagttccatcaccacaaagattttctcctattgctcttgtataaccacacttacttccctcccacccccaccctccattcctaacacctgaccaccactagtcagttttctatttctaaaattttgtcattttaagaatgtcttataaacagaatcacgcattatataaccttttggaattggcttttttcacgcaatataattcccccaagatccaaccaagctgttgcatggaactacaatttgtccctttttattgctgagtaatattccatggtatggacatatcacaatttgtttgaccatttacccattgattgaaggacatgcaaattatttcccatttggggctattatgagtaaagctgctatcaacactcttgtactggtcctttgtcagatatatggtttgcaaatatttcccccaaatctgtagctttccttttttatcctcaggttttttccagagagcaaaaattttaaagtttgatgagatctaatttttacatttttccttttatggattatacttttggtgtctaatctaagaattcctcacttagtcctagatttcaaatttttactcctatgttttaaaaaaaatccacattttttggttatatattttacattctcatagttttacattaaagcctgcaatttatttttagtcatttttgcacaaggcatgagacttgggctgaaattttgctgttgtttgtctgcggatgtccagttgctccagcactacttgttggaagatgaccctgcactgaattgcttttgtacatttataaaaaaaaatcacttatgcatatttgtgtgcttctacttctgggtctgtatcctgttctttgatctgtgtgtctattgctcaccaatgccacatcgtcttgattactgaagctatgtagttaaccttaatattgagtagagtgactccttcaactttattattattttttggattgtttcagctaatctgtagcctctgcctttccatgtaaattttagattaaacttgtctatgtttactacaaattttgctgagattttgacaataattttatgaaatctatagattaatgggaaaaattgatatccttactatattgagtttcactttctttttaaaatatattttctccttaacgtccataccagtacacccatctgggtttctctcttttgctgctacctttatcttatccttctgcctcatcttcctctacctagattttaagtatcagtttcttgaagttcaatcctagaatcactttttcctctctatgtgctctcagactgaacacatcaacacccatctcttcaatgaccatcaaagcaaaaataatgacacacacaaagactcactcaagtttatatccacaagctacttctcttcagaaccctggacattatatgaaattgcctaactgaaatctctgcttgaatatcccagagacaccttaaagtcaacttgccccaaactaaaccattgacctttccaagaatctaccctcatccaggtctccttaaccatcatttacatatgccagcaatcctgttctattgatcccatccaattctcaacaacatctgttcatttttgtcttctaaatatgtgttgaatatgagagttttctacagctctattgccactaggttagaacatattacaaaaaatacttttcccaaatgagtgcaatagcagtcatctatatttatttacttgttttcctcagctacacatccctcagtctagtttccattctgcagacaaaaaacaaaaacaaaaacaaaaaaacctttctgaaatgaaattattccatctcccctcccctcacacacattctcttcactcctgtattcctccaaatcaatgaacatttctcttaggataaaaataaaatcaatacttttaaatgaatttctgagctctctggaaagtaagagacatgtccaaaggcaaaaacaaaaacaactaatgacaacagacataacaaacaatagggaactgaaactgtagaaggaagcaagctctaaagttagggttggttaggaacaaacattgaaagaaggaatttacagtctggaaaattttgatttgacaggatataagaaagataggccttgggccaggtgtggtgcctcatgtctgtaatctcagcactttgggaggccaaggcgggcagatcactagaggtcaggtgtttgagacccacctggccaaaatagtgaaaccctgtctctactaaaactacaaaaattagccaggtatggcggcacatgcctgtagtctcagctactctggaggctgaggcacaagaatcgcttgaatccaggaggcaaaggtggcagtgagccgagatcatgccactgcactgcagactgggtgagagagcaagactcaaagaaagacagaaggacggaagaaagagaaagagagagacgaaagaaagacagagagaaagaaagatgaaagaaagaaagaaagaagaaaaagaaagaaagaagagaaagaaagaaagaaagaaagaaagaaagaaagaaagaaagaaaaagaaaagaaaagaaaagaaatggaaggaaggaggaagggagggagggaggaaggaaagaagggaaaggaagggagggagggtagaagggaaaggaaagaagggagggagggaggaaggaaggaaagaaagggaaagaaagaagagagagggacagagggagggaggaaggaaaaagaaagaaagaaaaagaagaaagaaagagaagaaagaaagagaaaaagaaagaaggaaagaaagaaagaaaagaaaagaaagagaaagaaagaaaagaaagaaagaaagaaaaagaaaaggaaaggaaacaaagagaaagagagagaagggaggggaggggagaggaggaacctgaaacccttgcatcaagctgcaattcttaacaaaattccaccttagtgaaagagtagtcaaaaaaaatctgcctgtaggcaaagagagataatgagaaaaacgtctgctctgctcagctatagctccaaggcttccagagagctgttttccctgagaatttgtaatcattgatctgccctcatgctgtatgggcttaaaatttacagcacctgtggaaaaacgctacaccatgataacaattaaagtggtcccaggttggaaggacactcaccgtcagcagagagaaaaatgcaaatctattctagaggaaagcagcctcaatcctgccactcaagattctcataatcttcagccaaacatgaacttacaactaaaaaaaggaccaaatacatgaggaagtaagtaagtatgaatgaaactcgattaaaaggacaaaaaactacatttacatcctaagaacttggaatcagaatcaaaattaactccaacgattatgcatgaaatgtttaaagaaacaaaagacaataaaaatgagcagggaacaaatgactccaaatatgacccaaggtgtgtctatgaaagagacctttaaaatgtgttcctcattaataagtaaaaaacggttgcactcaccacagaaagctattgaattgaataactgccatacaacagaccagatgttcacacagaaaaatggatgggactgaaaaacacagtgccatgtggaaaaaggtaagagacaaaatgaagcttaaagtacaatgatgcctattaaaaatgtatgcattcaaaccctctatatgttttagaggatcattccaagtaaatgatacataggtcacacattagaataatggttggagtgtaatgcccaacctggtttttactaaccctgttttcagactttccctctcctttaatcacctagccttgtttccacctgaattgactctcccttcgctaaaagaaccagacagactccatcttggctctttcgttggcaagcccttcctcaaggacttaacttgtgcaagctgaatcccagcacatccaagaatgcaattaactgataagatactgtggcaagctatacccgcagtccccaagaattcgtctgattggtaacgcccaaagcctcgcgtctatcaccttgtaatagtcttaaagcctctgcacctggaactgtttactttcctgtaaccatttatccttttaactttttgcctactttacttctctaaaattgttttaactagacccccctccccgtcctaaaccaagatataaaagttaatcaagcctcttcctccgggccgagagaattttgagcgttagccgtctctcagtcgccggctaataaaggactcttaattcgtctcaaagtgtggcgtttttctaactcgctcgagtacaacaagagcaaaggaaatagaagtgctgaatgaggatgaaaggagtaaatcaataataataaatgatgggtgaaaataaacacaaaagaatgttagaaagcatgaactgatgatgaagcatcttatgaagggatgagtatggccaacccaatcctctaagtctaaggacctctgcctgaaaaaagcagcaaaattaaaggacatccccagatcagcacaacccactactttactggctctcactctatgaaaaatgtgcaactacctagagaaacaggtcacagaaacaatctgtcaggcctctgagcccaagctaagccaccgtaacccctgtgacctgcacgtatacatccagatggcctgaagtaactgaagaatcacaaaagaagtgaaatgtaaatggcctgttcctgccttaactgatgacattccaccacaaaagaagtgaaaatggccggtccctgccttaactgataaccttgtgaaattccttctcctggctcatcctggctcaaaagctcccccactgagcaccttgtgaccccaccccgcccgccagagaacaacccccctttgactgtaactttcctttacctacccaaatcttataaaaacggccccacccctatctccctttgctgactctcttttcggacttagcccgcctgcacccaggtgaaataaacagccttgttgctcacacaaagcctgtttgatggtctcttcacatggacgcaagtgaaacaatcctttgctgatgaattccatttagagaagtatggggtaagtatagtagattgtgaaataaaatgatttttaatgaacattttaattctcagatgaagatactttctaagtttgctctaatatttcattcagaagccttcaaactgtcaataaggctatactccattctctcaagaatcaacaaactttatcatgcatcattaaatatacattgtttttattatatttgtataagtgtataatagaaaattactagtattattttaatttcaatacttaattttattaagttaatattcaataatcaaaatagttaataagtcatacatcatatcaattattgaataaacaaggtaaatatgatagttattaagtaactattttatgccagagagacagtgtaagatttttaaaatatgaaggagacacacagcatgcatcatgatctgaggagaaaaactcaacttatggaaggcatttagaaaataatcagttagacaatttcataattaactaaaatttcaacaggaattcagaaaaggataagaaaaggttttatgaaaaatggagctgaagctaactcaggaaaaaggcaatatatggctaggcgtggtggctcatccctgtaatcccagcactttgagaagttgaggccggtggatcacttgagtccaggagtttgagaccagcctgggtaacaaagtgagagcccgtctctaccaaaatacaaacaaaccaaaagctggatgtgatggcctgcacctgtagtcccagttacttgagaagctgaggtggcaggattgcttgagcagaggaggtcaagggtgcagtgagctatgatcgtgccactgtactccagcctgtgtaacagagcgaggccttgtctctattttgttttttttttttttgagacagagtctcactctgtcccccaggctggagtgcagtggcacaatctcggctcaccgcaagctctgcctcccgggttcacaccattctcctgcctcagcctccctagtagctgggactacaggcacccgccaccatgcctggataattttttgtattttcagtacagacggggtttcaccgtgttagccaggatggtctggatctcctgacttcgtgatccgcccgcctcggcctcccaaagtgctgggattacaggcgtgagccaccatgcccagcctttttttttttaaagcaatatgtgaaaaagtaaggaaaaatagaaaaatatgcacaagaatatgctacacatttacagaaatgtaaaaaacacaaaatgagacttgaaaatctaataacataatttttaaaaatttgtgatcacagccaggtcaaaggaagtaaaagccaatgatgcagtgaagaaaccaaaatcttcagctcttttttctttttctagttaaggatacagatctttagactgaaaggggaaactaaagattgaaaagaaagaattgaagtctggtgtctcaaaagactatatattaatatttagctgcttcaaatcagtaatatcttctgggtctgagcaattgggattctagcctaatgagaatttgaatatcaatctatcaaatgtaggtttagaaaatcagagcaactcggaaactttttattttaaaaatgaaattgatttctaaaatttaatataagtatttgccatcaatcctaatgggttttagaatgagtttttaaataaatgacttaaggggtattcaagaatgaacactatttttcagatgcattttgggaacctgtattatttcaatacagcaaatcatgtcatgctaaagcaattttcttattaaaatacgcctaggccgtaggacccctactataaactatgctcatatgagctaagtcaaatattcatatgagtgagggaaaatcagtgaagcatcactactcacccagccgtagtgaattattcaggccctaccaggtggcttcctgctgtggcttgcatgtttgccccctccaaaactcatgttgaaaattaattgtcattgtaacagtattaagaaatggaacctttgggtccgggcgcggtggctcacgcctgtaatcccagcactttgggaggctgaggcgggcggatcacgaggtcaggagatcgagaccacggtgaaaccccgtctctactaaaaaaacatacaaaaaattagctgggcgcggtggcgggtgcctgtagtcccagctactcaggaggctgaggcaggagaatggagtgaacccgggagacggggcttgcagtgagccaagattgcgccactgcactccagcctgggcgacagagcgagactccgtctcaaaaaagaaagaaagaaagaaagaaatggaacctttaagcattaatgaggtcacgagggttctgccctcatgaatgggattaatgctataaaagggcaagttcactcccctctttcactcttgcccttctaccttctgccatgttgagatgggattattcccttgaccctgacccccttcgtgggcaggaactagagaggctcatttcactcagctggccgctgaccactcccctttagagggagcttgaaagtaagcaagtaccgaacctgagggaacgctggaacctgcgggtcgctcctctctggcggaagcaggctctgagcaggccccgcagaagcacccaagcccctgccctctagacacccgggttcctgtctagcatccaggaagaatcagattacatgaatggattgaagggtggtgtatgtggaggattttattgggtgatggaagtggctctcggtgggacgggagttggaaaggggatggtacgggaagaaggtgatctttccctgaagctgcaccatctgaagtcagccacttgtatccccaccgctcagcagcttgtgctgctttgccagctgaagtcttttcatgggcacaggataggggtgtggccggccaaaagggcaacatttgggcagaaaaatggggtcagctgttttcacttagttccaggcttatgtgttgggggggggggttagctgggagcacagcagttctttatcaatgtgatgatataggaagaaagcttttgccacatggcgatgctttttgatcttggatttagcctctagaattctgagccaataaaattctgttcattatttattacccaggctcaggtgttctgttatagcagcacaaaacataccacaacagtctcaatgcctgtcccatcaccatgagtgccagatcatctcctctccccgaatttggttatagtttgaggacatgcaaaggaaatattgaacagtctatttgatgcagttattgggcaaacccaagcaatgaatgaactcttgaactcaaccatgaaagagctcttaaactcatgcagacatatggagtaaactttgatgcaaactttaatatttgcatcaaaatgttaagtagttggatattgattaatttacctttgcatttcatttaagttataaataaattttttttcactttttctataaatatttcataaaaaactgtaactcacatttgtggcagatcagtgtatggtggatatggacctaaatatttttatatgtgataactcatttaaacccttacagcaatcttataatcagtaaagatacttgcttaaaggtgagggaacagaggtacacagagacaaacttaacttgttcaaggtcatacaaaagaagtggcagggctgtgattcaaatctgcacagggatcacactcttaaccgctatactagattaaatctgtaatatagtatccataggttgaaaaaacatgttactttaaagaaaaaaaaaaaagctttcttcagacatagtagataaaaattttaatttccaaaatctgtttatcttcaaattttattttttataataaagacattttaattgattttttagatatttccctcccaaattttcaaatctattctaaacagttttgaatgtttcttcatttctttcaagtgacagtaaatgaagtaacacttttatttttaagtcaaacaagagtatctagagtttcatttccaagcactttataataaattctttattacttacttagcaagtgatctatacactttaaatttgaggtaactgtaaatagcaaatcaatgacagcaaacaactcagtgcacatgcatgtttgaatagcctttgaatatttccccaatttgataattttttgttcagtatggcttcgactcttgttttgaatatacaatccatcaaagttttacatattatggtgatatcatcatatctatcacataaaagcttggtttgctaagataagttacttctataaattctgtattatccagtccattgttaagcaccagtaaatattatggtagggcagatatagttttgcttactgtgacacagaacccaaataatagtggtttaaagaagataatagtatttctttctttctttcttttttgagacagagtctcactctgtgccaggctggagtgcggtggtgcgatctcggcttactgcaacctccacctcccgcgttcaagtgattctcctgcctcagcctctcaagcagctgggactacaggcgcccactaccacgcccagctaatttttgtatttttagtagaaacggggtttcaccatgttggccaggatggtctcgatctcttgacctcgtgatccacctgccgcggcctcccaaagtgctgagattacaggcgtgagccactgcgcctggccaagaagataatagtatttcttactattatttattactatgtaatggcattggtaggagatccagactggatggcacctccaattatcaggaaccggagcccccttcttttggttctaccattctcaacttgttgctatcatttcatggtcctagatggctgcccagcaacttccacatcatatgcattccagcaagaagaaatgaaaaatgcagggagaggggttatttatcctaacgttaagtcaggaccaggaagtggcccttggcacttccgtttatgtctgattggccagcacttaattgcctgctgcgcctggttctgtgggatactggaacgttaggctttagctgggaggctatgcaagagttaaaattccattttccgggatacgaagagaatgctttttggaggtacaatgagcaattgaacctcatgaactaataatgcatcacattttctttttaaagataataactcaaggtacacattaaaatttatttgtaaaaggtgttaaagtaaaaatcccccttaacattccactccatatccattttcctccacagacttaatcactgttaacattttgatgctttcttctttgtattttcatgtaataacatatcatatttactacgcacctattcaactgccttttttaaccaaataaaaatgttattacatagtctggtttttcatttaactatatgtcttagagattgtcctattttgttttgtatggttttatctaaatctactaagctgatgcatagaatttgacagtgtagtcataccatatatgatttaactggtccccattaatagacatttaggctgtttctaatttgtttgcaattcaaaaatttatttcacaaagatactgaattttatgaccagagcctgtgttatagtaaactgtgggtatatttctatggaatagatctattgagagcagtttatgcatcaaagtatatattcatttaaacattcttgcatatttactttttcatgagaactttggaaacatcaaatccaataaaatacattttcttaacaaaacctttgtaaattaatctttggtatttttgaaggctgatgtaatacctcggttcttgtctttttagtttaaaaggattcaaacaagagacacacagcaaaagaagtgtagcataatttattgcaaaagaaaacagtattttgaaagctgagtgcggaataggtagcgcaccctgagagagagagaattcagggcaggaagctcataaggatgggacagcaaagactggcactagggatagccatgattattcataaggaggtggaaagaggtgtgactagaaagcatgttctaggtggtcctcggggtgcacatgtgcagtagctgtacatgtttcttcatatgtagcatgtctcatcagcatcttaaatctccacccaagggtgtcttttttactattaaaatgagcaaaaggtcagtttgaggacagataaaatcaaaatgagcatcctctctagaggggaaagttcctactgaagataactgttcttgaatgagctcaattacaatgtgaatgctgagacttattgtgttgactgcacggtcaccacagtgacctgagaatatggtcacttccttgacggacctatcctgcctcagtattactttgaatataatggaagaaacatatctttatgtgattttcccattccaagagcatagtgtcttttttttataaatttaagttttctttcatgaacaatttcaattttgtcattttcttgatataggtattatacaataaaaattaagtatctccttaagcatttgattgtttttcttattacgatgactatattctattacactttcagaagccacagcgtggcttagctgatttttctgctccaggtctcataagactaaaatcaagaggtcagcagagctgtacccactactcaaggtgctggagaagaatctgtttccaagctcattcaggttgctgtctaagttcaggtccttgtgactgcaggactaatatacccatttctttgctggctgtcagttgagggctgcccttggctcctataagcctttttctggtctttgcacattttggaaccagccagggcatgctgggaatcatctctctgccttccatgtggcgctctctcatgctcattctctctctcttctcttccaccacatctctctgactccaagcagaggaagttctttgcttctaagagtttatgtgattaacttgagcccctcctgccccagataatccaggataatctcccttaattacatctgcaaagtcccttttccatgtaatgtgacattcacaggttccagaaattagggaatgaacatctttgggaagtcattctgcctagtacgtgtgcatactgactttttttccaattttaagttcatgtttcttagaatttatctctgggaattctttgataccttgatttaaagtgtgcttcttttttttttttagacacagtctcactctgtcgaccaggctggagtgcagtggcaccatctcggctcactgcaacctccacctccgagttctagcgattctcctgcctcagcctcctgagtagctgggattataggcacacgccaccatccccagctaagttttgtatttttagtagagatgggatttcaccacattggtcaggctgatctcaaactcctgacctgatgatctctccgcctcggcctcccaaagtgcttggattacaggcatgagccactgcaaccagcctaaagtgtgtttctttagaaagtttatttctcaaggcatgttggtcactgctaatgccactgactaaactatagttgcagcctgaagtctcacagccgtcctcagggtaaatatcacctcaaacaatttttgtcaactttattaagatataattgacaaataaaaattttatgtatttaaggtgatatattcatgcattataaaatgatcactgcaatcaagctaattagcagatccatcatttcacagctaccatgtttttctttcatgagaactcttaagatctaccctcttaacaaatatcgagtgtacagtacggtatcgtttactatagccaaagctgtacattagacctccagaacttactcatcttgtataaccaaaactttgtgctctttgaccaacatctcccatttgcccttccttcaacccctggcaaccaccattctgtctgcttctatgagtttgactgttttattttattttatttacttattttttgtttgtttttttgagacagagtcccgctctgtcacccaaactggagcacagtggtgcaatctcagctcattgcaacctccaccttctgggttcaagtgattctcctgcctcagcctccctagtagctgagattacaggcgtgtaccaccataccaagctaatttttgtatatttagtagagacaggctttcaccttgttggccaggctggtcttgaactcctgacctcaggtgatcctcccgcctcagcctcccaaagtggtgggattacaggcgtgagccattgtgcccagccaagtttgactattttagattccacctaaaaacgagattatacagtatttgtctttctttagcttatttcacttagcataacatcttccaggttcatctctgttgtcacaaatgctaatatttccttctttttaaaggttgaataatattcttttgtatatatgtgccacattttcattactcattcaggtgtcaatggacatttaggttgttttcgtatcttggctattttgcataatgcttgcaatgaacatggcagtgcaggaatctttttgagatactgattacatttcctgtggctgtgtactcactagcggagtcgctggataatatggtagttctattttttattttttaaggaactttcataccattttccataatggctgtaccaatgtacattttcaccaacagtgtacaaggatcccaatttctccaaatcctcactgatacttgttttcttctgtcttttcgataatagccattccaacaggtgtgaggtgatatctccttgtggttttgatttgcacttccctgatgattaatcatgttgagcaccttttcatacacttgttggctgtttgtatgccttcttttgagagatgtctattcagatcctttgcccatttttaaatcatgttatttggtttttatcgttgctgttgtttcagttccttacatgttttggatattaactgcttctcagatacatggtttgtaaatattttctcccagtctgtaggttgtcttttcagtctgttgatggtttcctttgctgtgcagaagcttttcagtttgatgcaattccatttgtatagttttgctttcgttgcctgcactcttgatgtcatagccaacaaatttgttgcccagaccagtgtcaagaagcttttcccctgtgttttctttttagtcttttgatgattttaagttttatatttaagtgtttaatccattttgagttgacttttgtatatggtgtgagataaaggtccaatttctttcctctgcgtgtaggtatctagtttttccaataccatttgttgaagagactatactttttcattatgtcttcttggcattcttttcatagaccacttaattgtaggtgcatagatttattgctgggctctctattatcttcttttggtctgtttttctgtatttatgttaattccatactgatttgattactgtttctttgtagtatattttgaaatcaggtactggaatgccttcagctttgttcttcttgcttaagattgttttggctatacagggtcttctgtgattccatataaatcttaagattttttttctatttctgtaacaaataccattaagatattgatagggattgcattgagtctttagatcactttgggcaagtgagcattgtaacaatattaataattccaaatgatgacattggcatgtcttttcatttacctgggttttctttaatttccttcatcagaatgttataattttcagtgtaaaaatgtttcacctctttagttaagtttattcctaagtattttattctttttaatgctattgtaaatggaattgttttcttaatttccttttcagatttttcattgtgtatagaataccattgatttttgtatgttgattttgtagcctgcaaatgtactgatttcaaacattcaaagaataacaattgtcctacattctcacaaaaaaacagaagagagggaatgcttctaaactcattttatgaggccaccaccctaataccaaagccagacaaacctaccacaaaaaaaagaaaaatataggccaatatccctggtgaaaatacatgcaaaaatcctcagtaaatgctagcaaaccaaattcaagagtgcattaaagggattatacaccatgatcaagtgggatttatctctgggatgaaagagaattcaacatatgaaaattaatcaatgtgacacattgcattaagaaaatgaagcttaaaaaccatacacgattttctcaatagatgaagaaaaagcatttgagaaaattcaacatgaattcatgataaagcccctcagagaaacagatatagaaagaataataaaagccatatatgaaaagcccacagctaacataataatcaatgggaaaaaaacttaaaacttttcctttaagaccgggaacaaggcaagaatgcccacttttccacctctatttaacgtagtactggacgtctagccagagactagagaagaaaatgtaatcaaagcatacacatcagaaaagaagaagtaaaaatatttttatttgcagatgatttagccgtatatgtagaaaaccctgaagactcagccaaaaaactatcagaactgatttcagcactttctccctgtgcctctagctctgactctcattgttcagatttaagtcaatttccctctcagatctgatcatcactttccatagccacaatcagacattcatgaagacttatttactgagaaaaaaattaatgacactgaccttgggaaattatctttacttccactgtagtttgtaaaatcttaaaacttaacagctagattttcacctgacctctattttaatgttgtcatcatcacctctatttttaattttgtcattctccctaccaaagtgaatgaatttaaagagaaagaaaaagaagaccaacatttataccatgtaaacaaagaagaaaaaaggcataactctgttaaaatgacatgttcatatttttagtcatcctcctagttactttctaaaaacttgaattaaaaaacagatttaaaattttaattttttgtggggagttcttataggttttgacagtactcccagtttactgaaactgtttgggtcaatttaatattgggaagataaaacctattatagttttaaaatataaagctaaaaaaggaaattcaatgtcaaatatgtaccttctcttaaatgtgatgatgttcttttgtatcatttgatattgttataagttaaaatgtaaaactattaaaatgcatgtgaatagagatttttaacttgttttttagggtccagtgacacttttattaacttggagtgtccaaaatactttcatcttgagatcccttcaaattatttcatttccctatttaataaatatttatgaagagcctattgcatgccaggcactatttcagccactggagttcagtttgtgaacaaaatcaataaagctcctatcctcatgaaacttattgctggtggaagagacaaaacacaaccaaaaaagcaaagcatttttatgtaccctgaatgcttacgttcccccaaaattaatatgttgaaatcctccccgccaaggtgatggtaggaagaggtgggaactttgggagtgatttgggttatccaaccctcatgaatgggattagtgtccttataaaagaggctgaaagtgacccttcactccttgcacagtgtgggatcacaacgagaagatgactgtcaacgagacagcgagccctcaacagacactgacctgccaaccccttgatcttaaacttcccagcctctagaattgagaaataaatttctgttgttttaaagccacccagtttaggatattttgttatagcagctggaacagactaagacacatatatagcataatgtcagggtatgataaataacatagggtcaggagacagagcatggtttaagtgggaacactttagacagggtggttagcgagtgcctgttgaagagtgacttctggccagagacgtgaatgaggagagtgaggaagtcatgtgaatatctgaggcaagaacaaacttctcaatgtactttatgaccactggagaacccagacctaaagacccaggttatgaaataatgagcagtagaaaagcaaacctaacagttttgtaaagataaaaatcaagttcctgttgtggcatgacaagtcatgggactcaaaaatcacgtagacataaacattcacttagatagatccatgccagggaaaggtatgaacccttaccaagcaaattacatacacagacaagagccagtgctgtccacaagcaagctattcctaggtcataaactgatttaagaaacacattttctttagagttttgactgggttgtggccatctgcaaaaatgaaaacccattgggagaaaatctgcatagttcaacatagaacaatgaaaggaagtgtcagcctgtatcccagccctgaaatggaatgagctctgtttctgcacagaaggcagttgagacaatgtcagttacccattccactcattttggtttattttaaggaaaatgcaatctatgcagtgtttaggaaattatatacacctttgaaattaggatttattgcaatcaggtaacctttaataatgcaaaatgtgtatttaaaaatacatttagtaattaagaatcgtactcgatgcttttagaacagtaaagtgattagtatttcaatatactttcatccagattacattttcttcagaaataacatgttcttttaattttctatttttatgaactttgttaacaatattgaaaagtaaagacaactgttgaaatgtaagccctttttgtctgttaagtaatagtaggagcttttatttactggattatttgaaaataaactttagcaagaatattatagaggtgagtctttatatttgctcagtgaattctctaaattttctatgacgttttataattctcttagatgatttatattttaatttctaataaatttatacttaaattcacaaaaaaatgagactgatcagaaacaacctcattttggaagaagcaggactgcaaaaattaatataactgtctttttttgttgttttcttagaactactcaggaatatattacagacttcacaaagaggaatactactttgcactaagtcatattctaatgactaataagttagaatatgattaatacaagatatatgcaagagttcaggctagagttactcaaagattgatgaagccagatcatggaatgcagtttagcgcagttactaggtgcagtttgacacgttattcacaatttccagtgcctccaaagtcctcagaggatccagtctaaacaagcaaagcttgaggaaagactcttgaaatgttaactaacttgtgtttctcaaaatgtttcatgtaactctttcctatatcagttctcaaacttctctataaaaaacaaattcctgagatcgttgtaccctttgttatagcacttaacaaactttgtaatgaaaaattttgcatttatgttttccctccttgattttaaatatatttcttcaatgtagaaactgttttttcatactaaatactaagtaaagagtaacacaaattttatataaattacacttagatatttatgaaatgaattaaataactttcaaaatttgtataccaaatagagaaacagacatgttaagaatatagtggccgagcgcagtggcgcatggctgtaatcccagcactttgggaggccaaagcaggtggatcacttgaggtcaggcctagttcatgaccagcctggccaacatggtggaactccatctctagtaaaaatacaaaaattagccgggtgtggtggcacgcgcctgtaatcccagctactctggaggctgaggcaggagaatcgcttgaacctgggaggggcaggttgcagtgagccgagatcgtaccactgcactccagcctgggcgacagagcgagactaagtctcaaaaacaacaacaacaacaacaacaaagaatttagtaagtatctgagttttgaatagtcctttcccccaatttactatataaatttaattttcaagcattggaacgtggtctatttctcaattctgtatacatttaattcaaggtgctgtagctgagagtttggagtcttcctttccatgtcagtaggggatgaggaaacacacacacacacacacacaaacacacacacacacacacaaccctgttatcctaaaagcagttttggaggtggctgagaggagagaacttaggaacttagctgaggaaatgatgaaaaggacattgttttgtgtctcaggaaccatgtggaattccaagataagaaaaacagttgctaatttgagtataaaagcaggaaacatgatacacttatttccttttatgcgaacacaagtatatgaggggttgtgtaaaaattatttttctcttgctgtactacaaagagatagaatcaaactgctttttttcgacatactggtttttctttctgtttttcttctctttcttctatttcttgtggatattatggctaataacacaacaagtttagggagtccatggccagaaaacttttggggtaaggtattttcttttactgtttaaaatttaaaattaggatgtaagaaatgcactgcgtgattattaaaacagtgaaaatctctgagacattttgtttactataatgtgattacttaaagttttcatgtttattaacagaaatctatttcatacgtttattagcagaaatatatttatagatataaatatatacttatatatttatttgtctttatagtgttctatgaagatattcaagaagaatctgggtattaagtacagattttggctggtgttacaaaatataattaggaaatagtgaggataaaaataaaaaacataaggtggaggtaattcctgcttagaatatggcatgtagattttgttggaaaaattaactttcatttgtttgaaggttatagattatatattttattttatgaaactgagattttccatagaggctattttcacttatgttgtgaatgttatatgctttaatttccaaagtgaatcctaataacatctgtacttaaatgagtgaatttaaagtgcaataacacaggtaaaataaatgaatgactttagagtataacaaataaaacatggaataatatgaaatttgagaaaactatagtagaaaagattaagtggaaataacatcacgtgtaacattcaatggaatcctatcacaggggttggggggaaagaacaatacaaaagtattttttggagaattttttgtctgagtccagccacagctaacagtccagtgttccctgatgttgacaatgggactgtgctgaggtcaaaactcagttgctccaggttagaggtacaaagaagatgggctcacatggggagttgacatgtactcttgggttcagggaaatttttatattaaaggaggcaatttaaattaaattcagaaaaacactttaatgaagaaaatagtatatatggacagatctgtttatatggccagaacaagtttttaatcctctcagtgtacaattcagactttctgctgtgattcaaggtggggttttgggaactttcacataaacagtgagcagtagtggccgacttttcccagcaatctatatgtctaccatcacagaaatttgcatgaaaagaattcactccagtcctttaacctatgtactttcttagatgaaaaatgtggggacaaatatttattggttttaaaagatattaaaattcagcataagaaaaaaaagaattaactcattctttttttctcacctacatttatgtttgctggaagactgaaaaggaaggatattggtgagctcctaataaatttatgtaacagaattaagaagaagaaaaaagattattctagtacattgtaaagaaaggctttggtaataggttattttaggtagctagcactagacagaagcctttgaattgtagatgtctgattatatgcttgttaaaatattatttgctgtcctcacttatagagaaaataagtgctaaatgcacactgaaaaagagctagagtctgtctaaatcaaattcatcattataaaagtgttctgtataaattattcaaaagtaaagtagtttttgcaaaaattaatatgtagaagtcaatctatttttttcaaaccattcaaaattaaatttcaggtttacttaaaaaaacaaatcattattcactgactaaaagattaaaataaacttgatattaataagagaatgtttagttggagttcacctattgattctaaaaatttagatatttttaatatggaaatctgtgcttaagagggaattaaaacctgttatttcaaagccaaatactagtttttcctttctcttgttatgtgactgtaatgaaaattagatgaaaataatgaaaaccagaaaggggagtgttacattgataaacattaacaaagccaatggaaacatggagagcagatataatgtttgatgattttaggaaaatatataaaagattgtattattgcctctggggtaaaaatatgaagtataaaatgtgaataaaaatataaacatataaaatgtatacatttcctgaaatataaatgtcaatcttttaaatttccattgcttttgtgtatctaaattgatgtctattttgaccactgactcctcaaaaatattattttgagaatcttgtacaatgcagtgtaatgcattgttattgcttccaaaatcagtcatctgcttggcacattgaatttggaaaataaagaaaaacagcttagaaaaggaaaacttgtacattgaaccatataaattgctcagacgtagcacactttaaggtacagaaaaagttgttttcccaatataacttttctggtttactttaatgagcgctaaatgatggcataataatatcgggttattaccaaaaacaatagcttgcattttcatagctatcacccactaaaacttcctaaaggtgtgcaagcatttaagtgcaagggttggcaacaaagttagcctgaaagtgacaacacagatgcagactatcaccttccactccctatttttgctttctttaacgcacttcctttctctataaacattcccatgaaagctgcaggaaacatggcccgtgaaaatttgccatgtcctcctctaaggcaataggagacaaatactgaactcagttattctctcagtacttgagagtcctgtagaagacgtagttttggttgtttctgctgtcttgctttgcatttttttccttatggctagctttgtgaaaagttgggggaagatgtggttgcaggagtttgcatttattcacttaattcaattctcaccaaaagtacaatgtctgtctcaaaaggattatgctcttggaggcaattatgcgtctatacatatgctacatatgcacatacaaacctatatagttgtggaataatacaagataacatatgataaaatagcaatggttgataatatgagttaaaacaatatatggcagaaataatccctaaatctttctcagaaaaaaaatgaggtgctatctgttcctagaaagataaatttcagacagggagataattctaagaaggacattctagtcattcatttttttccctcaccaactcattctcatccagttcattagttcactcagaagcgttcgctgaccatattaggcaatgtgttaggagtcagtgacacaaataaggcatttcaagaggtttggggagctcaggaaaaatgtcaccagcaaatatgcagaagtaaaaacacccaggcatgtttgtggagaaaagaacgtcttggctagagattctgtgtgtggtcgtttcagggacatagtttgtaaggcaggttggaggcagatttctgcaagatttgaatgtcagcgtgaaagtttgatctaattaagcctgatcacttgcaatccagtgatttataatctctccatattcctccctctgggaattttctttaaggttggagagggtgtgtggatgggtggaggggtggaggggttatatattctgtgtattggagaggggggacctttgtgcttgatcaagttctggcctctgctgacatctactgacatgtatttctcatcagcttttgagacattgccctttctctgattttcactgccgaaatctcctactataaaatctggctcacatgatctgtgtaatattagctaacagcatggcttttcctttctgtaaatccctctggtctactggcccttattcgggtacttctccatctgtctcaatggcacagaataattttcaatattgtcccgtaaccctagagctgcaggagccttccttaggaggttgggctacatcaggtgcccttggcctggatgcagtaacactatgtcccctgctccctacctcacttccttatctgcccttcagatacccaagggttctcagagcggcttgccatctttcccaggaagctggaaataagtaccagttcctctgggattccctaatcaatctgtagctcatcacagggagggctggagagtgatgcttcccttctccaaaacccttacaggtcgtattctatatagctcttctctttgtctccccaaagctcctcctctttagatgcatggaaattgactcataggccatggtttattctttcctatactgtttatgataaaaagttatgttcttaagtcctttaggctgttagcttttagaaactgaaccaaacaaagaaactcaaagcactcttttctatttcgaaatatccaactattgcagtaaaaatgttggctttcaaacaattatttattctatatgtttaaaaaattatttagtaatttaaatgtgaagtattgacttttcctttttctatgcatccttgctaacagacttaattctctctaaggtaattgatgagatgcagggttgtgaactgatttgttggggatcaagtgctgtcaagaggagggatccctggctactagcagcaaatactgttctttagcctgtagaaaaatatggcccttagggaccaccccagcagatgggcataggatgttccccaagaagttaagaggggaacaggtttatggcctgggcatatgtcccaagaatttccactatatcttccccaaatttggaaacaaatactatgtctcaaattcgttttttcaatttgtattttaaaaagaaatgtctgtgttgcatattaatagtctattcattagttcccctatctcagttacctagaaagtttgaaaaacaaacatttacaaatgcttgtcttcaaaatgcatcagaattactaagaattatgaaaactcatctcactggactccatgctcagagattatgattcaacagatgtgagatggaacccataagactggactttttaatacatccctgacctcaaacttctgcatctaaattcatgagagaaagtggcctataactgtcctttctctgatagctttgtcaggtatcaatgttatgcaagccttgtaaaacaaattgggacgttttccctacttttctattactgggaaaggtttgtataagagggcattgtttattgtttaagtgcttgggaaaattccctattgtaactatatgtagtattttcaattggagggttttaaatggcacattccatttctttaacaatggtgaactactcagattttctatcaattctgttagtgaagggagtttgtgttttccaggaatttgaccatttgaattaaatttcaaaatatattgcttaaatgttgtttatgccattctcattagtttttcaacattttattatgaaaatgttcaaacatacataaatatttgaagaattctacagtgaacatccatataccttaccatctgaattctatctgtaacatttttataatactcattttctttgtcattctattagtcaatatatttcaaagtaaactaaaggcatcaatacagttccccctaattactttagtatgcatatcattaacaggaattcaattgttttgcaactcttttccctttaaagtcaagtttacatacaatgaaacatataaggtgcataaaaatgaagtgtacaaatcataacagaacctttgtagaattttgacacacacacttgagtaacccaaagcccaatcaagatacataatcactggcccaaaaagtttccaaatgccccctcccagtctaaaggctttaagactttaagattttagctttcatatttaggatccataactgtccacttccaattaaatttttgcatatagtgtagaaattgagggattgttttcatattgatatccagctttttctgcacaatttcttgaaaatattttccctgttttttattttattttattttattttattttattttattttattttattttattttattttattttattttatttttgagacagggtctcactctgccacatgggtggagtgcagtggtgcaatcacagctcactgcagcttcaacttcctgggctcaagtgatcatcccacctcagcctcccacatagctgggactacaggtgtatgtcaccgcaccaggctaatttttttctttttgtatttgtagagacaaggctttgccatgttgcccagactagtctcaaactcctgggctcaagcgatttgcccaccttggcctcccaaagtgctgggattacaggcctgagccactgtgtccagccaagactttctctattcaagtcctttggcacctttgttgaaaatcaaatggtcatgtaagtgtaaggctattgctgagatctccattctgtgtcatttgttgatttttatagtaagtcttgaagttacgtaaatcttccaactttattctcctttttattttttaaacaatttttatcacataattgtacatacttatggggtacagagtgaaacaccaaaacaagtatacaatgtgtaatgatcaaatcagggtaatcagcacatccatcactgcaaacatttattatttctttgtgcaagaacattcaaaatatcttctagatatttgaaactatacaatatattattaactgtttttctctttcaggattactttggcttttcgtgactttttgtattttctcactcccaggctttattgaggtataattggcaaataaaaacaatatatttaaggtgtccaacatgatattttgatatacatatatattataaaatgattaccacaatcaagctaattaatacaaccatcacctgaggtagttagctttatttttggtggtaagaacatctaagacctacttttttggccaatttcaagtataagaaataatttcataactacagtcactatattgtatgttagggctccaagctcctgcgcaactgaaactgcatttttctctcagcatctccctttttccctcacccccaaatcactggcaatcatcattctctgcttttataacttcttcttttttacattccacaaataagtgcagtcatgcagtacagatgctcgtccatttacgatggggttatatccagacaaactccttgtaagttgaaaatatcaggttgaaactgtatttactagagctaagctactgaacatcatagcttagcatagcctaacttaaatgtgctcagaacacttacattagcctacagttgagcaaaatcatctaacaccaagcctattttattaaaaaatgttaaatagctcatgtagtttgttgaacgctatactgaaagtgaaaagcgaaatggtcatatgggtactggaagtacagtttctactgaatgcttatggcttttgcaccatcgtagccaaaaaatcccaaatctaaccatggtaagttagattagaggctggctgtatttgtccttctgtgcctggtttatttcacttagcataatgtcctccaggttcatctaggttgctgaaaatgacaggattttttttttaatgctgagtaataacattcccttattatatacagatggtccctgacttatgatagttcaacttacaatttttttgactttaagatgatatgaaaatgatacacattcagtagaaactatattttgaattttgatctttaatgtttattattttaatttattattattattataaaattttccccttctttggtgtattccagccttggactcatagactccagctgactgagataaaaaaactggtatggaaattattaaaagaacactcaaaattccagcaatgaccattgctaagaatgcaagtgttgaaagatctttgattgttgagaaaattatgcaaagttcctcagaagttggttacgatgctatggtcagagattttgtgaatatggtggaaaaagcaattattgacccaacaaagattgtgagagctgctttatcggatgctgctggtgtggcctctccattaactacagcagaaattgtagtcacaaaaattcctaaaaaaagagaaggaccctggaatgggtgcaatgggtggaatgggaggtggtatgagaggtggcatgttctaactcctagaatagtgctttacctttattaatgaactgtgacaggaagcccaaggcagagttcctcaccaataacttcagagaagtcagttggagaaaatgaaggaaaggctggctgatgtttaagaaatcactgtaaccatcagttactggtttcagttgacaaactgtataatggtttactgctgtcattgttcatgcctacagataatttattttgtatttttgaataaaaagacatttgtatattcctgatactgagtacaagagccacgtacaatgtactgctttcaacttaaatcgctgaggtatttttactactattttcttaaaatcaggattttggtgcttgccaccaccagatgagaagttaagcagcctttctgtggagagtgagaataatcgtgtacaaagtagacaaatatccaattatgtgacaacttttgtgtaataaaagtttgtttaaagttaaaaatactaccttttattattataaagctggatgttgttagatgattttgcctaattttaggctaatgtaagtattgtgtgcatatttaaggtaggctaagctaagctatgaagtttggttaaaagttaggggtattaaatgcatttttgacttatggtattttcaatgtacgatggatttatctaaatccaacctcatcataagtctaagagcatctgaaatataacatttccattatagaaaccatatatgtgtgtgtgtgtgtgtgtgtgtgtgtatgcatatatatgtcaccatatttatccattcatctgatgatggacacttaggtggattatgtattttggccattgtgacaatgctgcaatgaacatggaagtgcagatatctcttagagattctgatctcatttccttttaatgtacacctggagggattgctgaattctatggtagttctatttttaatttttgaggaaccttcatactattttccacaatggctgcatcaatttacattttcatcaacactgtacagtttccttttctccacatcctcaccagcactcattatcttttgtctttttgataataggcattttggcatgtgtgagatgatattccattgtggctttgatttgcgtttccctgatgagtagttatgttgagcattttttcatctacctattggtcatttgtggggcttcttttgagagatgtctattcaggtcctttgctcattttgtaaacagattatttgttttcttgcttttgtgttgtgtgagcttcttatatactttagatgttaacttctcatcagatatacggtttgcaaatattttctctcattctgtaggcgtctcttctctctgttgattatttcctttactgtgcagaagctttgtagtttgacacaattctacttgtctatttttgcttttttcctgtgctgtcatatgcaaaaatataattgcccagatcaatatcaagctttttccctatgttgtcctctagtagttttttgggtttctggtcttaggtttgtatctttaatccagtttgacttgatttttctatatagtatgagataagggtccagttttattcttctgcatgtggatatgcagttttcccattacctcttattgaagaggcaataatttccccattgtgcatttttgatactgttgtcaaataccaattgtcacaaatgcatggatttattactgggcttcctccctattatgtttcattaatctaaatgtctatgtaaatgccagtaccttgctgttttgactattatagctttgtagtatattttaaaatcaagtggtgtgatgcttccagctttgcttttattgttcctttgtattgtcatcatatacaacttagggtcatttgtaaaataatacaaacagcctgtttattggacttttagttgatttagttatataaatttatttatataaataaatttaagggcagttggcatcttaataatattgaggcttgtaattcacaaatatagtatatctctccactttttagacctttaatttatttcagtagtatttcaaaatttgtggtgcagacatcttgcatacattttgtaaaaaaagatgcctaggtatgttatgcttaatgatgctattgtaatggtgtaattatactttccagttgtttgctgctagtatataaacgtatttttatatataagtcttacattctgcagtcttgcttaatataatttgtagttatattttagaatacataagattttcaatataaaaaacaagctaatagctgagtgcattggtgtgtgcctgtagtctcagttacttggagactgaggtgggagggtcatttgagcccaaaactttgagaccagcctggatgatatagtaagtccctgtctctaaaatctcttaaaaactaaatcaatcaatcaagctaatagatttatttatatcctgtcccaattctttgtattataattattacatattaaatctatataaactatacatttcatatgaaaatattttaatttttgctctagctagaaaaatatattttaaagaaattgatggaaaagagtcttctatatttactctgatactatttctgatggtctcaatttcttcttaaagatcccagttttcattatccccagactaaggattttcttcagcacatgttttagtgtaggtgtgctggtgattaatttgaattctgtttcacctgaaagagtatttatttttttatttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctaccattgttggacatttgggttggttccaagtctttgctattgtgaatagtgccgcaataaacatacgtgtgcatgtgtctttatagcagcatgatttatactcatttgggtatatacccagtaacgggatggctgggtcaaatggtatttctagttctagatccctgaggaatcgccacactgacttccacaatggttgaactagtttacagtcccaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagcactttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtaaccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtctcctcttttatttccttgagcagtggtttgtagttctccttgaagaggtccttcacatcccttgtaagttggattcctaggtattttattctctttgaagcaattgtgaatgggagttcacccgtgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcctggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttcaattcctgggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcacccgtcttctgcgtcgctcaccctgggagctgtagaccggagctgttcctattcggccatcttggctcctccccctgaaagagtatttatttcactactatacttaagggatacttttgctggatataaaattctgagttgacagcttttttaaaatcactttaaaatatcaccgtgtcttattaaaagtgagtatttaaataattgtcttttatgaatgtaatgttattattatttgtaatttggctgtgttcaagttttttttgttaacctttgatcttcagctgtttgactatgacgtgcatagttctttatatatattctgcttgatgttactgagactcttgatttgtagattaatttgtttcactaattttgaaaaatttcagcctcatttattcaaaatgtttttagctccatccaccctttcctctgtttgggggattataattgcacatttgttaaatatttttatatagttccacaaggcctagaggcttgctttttccccccaatatttttctccatttttcaaattggataagttctattaatacacctttaagttggccgattcttttctctctcattttaatttcactgttaagctcatggtataaattttttagttctcatttttttagttttagaatatccattttgttatttcttatagtttctatttctttgctgaaatttcctatcattttattcattgtgagtgttttacttgaaatcattgaatatggacatatgagttgctttaaaatttttgtctgctaattatgtctggatcatcttaaagtttgtttttgttgactgtcttttctcttaagaatggatcacattttcctgtttcttcatgtgcccagtaatttcatattgtatcttgaacattttgaatggattctgctatattaccctgaagagtgttatgatgtatgttttccccctagtttattttcacaggcaaataactctgtggaactacaactacagaaacctataaagcctgtcccttgggcagcagcttaaatctcactttagtttatttttttttctctagtgctgtttggaatacatcccacgtatgtgtgattcaggagtcaaccaaagatatgtgaaatgtttataaataaaatttggggattctcctctctggctttctcttctccaggatttccctctcacattctcagcagctcttgtttccacaatctctgtcctttgtttctcaagatcagaaacagtgcaggttttcgactgtagctttacctgtcccagactggaagcttccctcaggttaaaaggtttgaaaactggagcttgactagtacttgctgttcttttcttccaggtctcaactcctctccagtagctacaagcatttggtcattcttaaggcctttaggtagaatttttttttatattgttttcagtgttcatagtcattattacttgaaagggtcagttcataaaagctgatttggaatcctagcttgatgtttttattgcctgtatctgttctaatgtcacatttcttactcttgatattggtgattttctctttctctctgtctctttctcttgctcctgcccactctttttccctctttctctttctctcctctttccatccttgtcgttccaattagtattttattcatttttattagatttttttcatatctggctttgataatttcctctattttttctttttcttttttttttttttttgcccctgtttcattaagttctgctttctcttatttactgtatgctactttacttatgtttcagctagtgatcttttcctagcttcttaatatggaaactgaaataattgtttttgtaggctttcttattttaaaatgtatacctataaagctataaatgttcttatgaatgtggctttaggcacatctcacatgtttcgatatttcacaattttatcagaattcagttaaaatattttataattttcattaggtattttatttaattttctttatagatcctcaatctctgctgaaaatttttaacttgttaattttttaaacacattaatcaagttattttaatatttttgtctgataattcaaatattttcataacttacagatatttttccattttctatttgttcttttagtttttgtttactttgtcttgcctcttaggatgacttgtaatttattatttataacacatatatatataacattattaggtatatataaatttatttaagtatataactttctatttcatatatatgtataaaactttccttctggcagttaggggaagatcacctcagtccaacttgggattgatctatatttttatctttgtgaggtctggtctttctcctgtttaccattaagcttagggagtagatcctagggggcctaattccagattctgggatgtttcctagggtccaacttccttggcagcccctgaacaccaacttatgttttctaagcttacttatagtgcacagcattctactcagatatttttgtttctttttacagattattgtgatgaaagattttcttttctcctggaatttgctcctttgatttaatagttttgataagtctctgatggcttcaaacaaatttaagaaaatattttattctccattgtacgcttgctctcattggtttgatacatgttagtctatcatatacagaaaggggtgtgctaccttgatacttttgaatttgccctcacctctagcaatactgttaactaattatattcagaatatggcttgtgctttataattttgatcaaaactactttcaaatctccaagccttttgtttatttgaccactaccattcacaaaaaggcatctacaatttattttttccatgaagcttttttaaaccttccagatatatgttatcctcctatctttcaaacataatgacattttcagctcataatggttatgcgtctcattcacattttcttagagtataaattaatgaatgtagtttccattaaccaggaaggaaaaaagaaaaacaagaattccatttaggcttcagaggtgggacagggtgtcattttaggtggagcagccagggtagacctcaatgagaaacttacatataagcaaaagacctgaaattaaccatacagatagctgaggaaataattttaggaatagattacaaccagggatgggccctaagtcaggagccagcccatctgatgtacttaaggaatggtgaggggggaagtgcagacagagctcagtgacccaaaggaagagtagaggagatgggctcagataattgggagcctatcaagtagggacttttaggatattcttaggcatttgtttttactctgggagaagtggaggatttagaacagaagattgatatgatttgacttacattttataatgttctctctgactactgcattgagcacattgttggggtgtgagggatatggcaaggacagaagcaggaagaccatattccaggtcacagatgtgggaatgtggccacttggatcagtgaagtcgcagagtgggtagtgagaagttgaattctggatttctttttgtttgtgaaaacagacccaataagatgttctggcacatgagatataatggaaaatactcctcggctgtttaaattattataatcaatcaaatttctatgccctaaatattattctccctaaaagcccttttcgtcaaaagtagttctattgcctgaaccattctcctatacactctatgataccaaggacttcatggcctgctttggtgaacattgaacttatgattcttaacaactgcaaagggtttttgaatgttttaaacaatgttacattctgccatcactgataaatcactttcagagttggaatgcttcaactcaaggccactagatggtgacctctactaaattttaataccagtggatggaatttgaggtattgattatatttactaaaaatcatattcaatattacaatattaaaattggaagacacgaacgtggctgttattatcaggccaagaagggtcaaatgacttgaggaaattacacaactattagcagtaagagccagtgttcgttgagggcttgttatgtgccatctacttgctagttttgtaggtacgtattacaaattaggatgacatatatttaatttatatggcatagctgaccaatgttagagttttttccttctgctttcaaaaggaaagttaacatttttaaaagtaatcatttggtctcataagttgcattatattgcaattattaagaagaaagattatggctcatttttcttctccttagattgttgagaagtaagaaggcatatcattttttaaaaagtaatatctttgccaatgtcttttttttcagttacattttcttctacactaggttttaaaaaaggctcccaaaatacattgtcaaaagtctgccagaatggaattacatatatgaaaatttaaagctgtatgaccagtagatgctgctttcatcacacagtttctaaattctagtttgggcaggtcagaaaaatcatcaactataattaaatgaaaaaaaaatgtgtatgaaaaccacccctgttatttgactcagcatctctttcttattgcctttctgcatttctacatttgcctttgctgtttggacttaagggagcttaagaagatagataagtattttaccatatacctcaggaagtcttagaaattcttctgtcagcagtattatttgtaggtgttttaatattctgcaaggtataagaattagtgcaatgatttctgatatggtttggctgtgtccccacccaaatctcattttgaattcccacatgttgtgggagggacccggtggaaggtaattgaatcatgggggcaggaatttcctgtgctgttcttgtgatactgagtaagtctcacgagatctgatggttattatgagggggagttttcctgcacaagctctcttcgtctgctgccatccatgcaagatgtggcttgctcctgcttgtcttccaccaggattgtgaggcctccccagccatgtggaaatgtaagtccaattaaacctctttcttttgtaaattgcccagtctcaggtatgtctttatcagcagcatgaaaacagactaatgcaatttctaaagtgtgtattttactgactttatggattaagaagtcgttttcatgatgcgtgtactctactgagcaaaaattaaacaaatccatatcaaaagcaatttttttgtaatttgtataatttccgttgcacccccatcttatcctactttatattcattcaaaatttaaatagcctattattgtgtgtatatattattattatgattctcacgtacattttaaattcattatttaatcctttttggatatctatataacccaatatttgatgacattttaagtcatttccccaaattttgggcatagacaataggtttaccatatcaaatcaaagtattaccaagccacagagaatgatcattttaaataggtttgttgtcaaattcctctcatggaaatattgttatagttttagtgccacaaaaataatctttttagttcccaaactgaaacttgtcatttaagaaaattgtgatggtccaatatattctataataacttgcccattagagtttggatattatcctagttttcttacatcagaacaataatgtattttggaaataaaacagtcatctgaaatataaatatatttctcactccatgtatttttgttgtttttgctaatatactcaattgctgtattttatttaattaatttatttttactttttgtagagacaggtcccattatgttgcccaggctggtctgggctcaagcgaccctctcacctcggcctcgcaaagtgctgggattataggcatgagccactgcacctggcctcaatcacaataatagacaagaaattatttttcattgattgtgtatttaaatagtttctatttttttctcgaatctaaagtttgctattattccactataaataacatttatattgggaatatctgatttgtcagaagatgagaggctcaaagggcgtacacagagaccatgtacaaggactcttgtaatctttaaatactttcattgagtaactgaatatattttctcctttcagattctggttttaactccattttgctgaaatcaaggaaacatctctttttacattttatctattatgcctgcttatatactgagatatttagagtcttcagtcagactctagtagtggttaggtacatttacacataggaaggacatatactttgtaaatttgagtatttgtcttctcatttgtatcatacactagtgtaactaatagttccctaaccaccgatacttgccaatcaattattacaataaatcaagtgttaattctaccacatgaaccttagcttctgtttcaatatctataaaatgaggaatttatgtccaacacattttcaaaagcttgttttagctgaaactccatttctatgagtccatagctgagcttgttgatatttaaaagtctccactaaaggctattgattcatggaaatatatctgtagaacacacaatattatttaaccaccattctctcaagtatttctgttcataacaggctgcaagatactctggtattgaatcgaccaatttttatgcaatttatattgctcattttcattttagattaatattttcttaccttacacttagaaaataaataagcaattaactatgaattaagatgctttggtctcagatccttacttgaccttcaccaggtgtgggactatgggcttgttacttacctctcagtagccacaactattaaatgggaataacgctagcatttcctttattgggatgtttgaggattaagtgatataatacactaaaaaatgtgcctgggaactttgcataaagccattgctttagagaatgttgatataattatttgtacagataattgtgaaagtaggacacaataaatgtagcttttccacaggagataaatgtgacaatatatggtggaaggacactgaactatatcctaaaattagacagcagtgattattcctttgtagttattaacattagtttgttttgttatttctgcattctaggtagtctacatattatagattacaatatgctaaaaagaaccttggcaatcataaaatctaactcctttatatatatgtataatgaaatcagtgggtctaaacaaattccctaaaaatcacaaaacatattaggaacagagctgagtttggaaccctttatcagagagcttttgccatgtaacaatccacccccaaacatagtagcttaaactaataataatttgcttagctcacaatcctgtggattggtaatttgagatgaaatcagcttggtggattttctgctggtctttgctcatgtgtcacagtcatttggtgagttgactagcatctgaattatctaggatgacaccattcatatgtccaggttagcaggctcttggctagggcagtaggggttcctgggccatgtgtctctcatcatctggcaggctagtctggccttatttatatgctgacaatggcaggggtcccaagagaaggaagggtggatgctgagcctcttgtagcttaggcttgaacttgtatagcttcaattccattgcatcctaccgtcaaagcaagtcatgaagcctgcccagattcaaggggtggggaaatagactctatctcttgatgggaggaacagcaaaacgtttgtggctattttctcctcctcttccccagtctcacaacacccatcagctaattttcaggctatggctctctcaatacagactacctacataagcaattagatatgatagcttacctttctacttagcagtaacttatttttgtctaggaaatgtaggagtctttactgaagatgtgatacttgaaggtagagcttgaagaatgagttttccagacagaagcttaaaaaattgaattcagataaaaggacaaatatgtggaaaagctcagagttttagagagaatgacaggctttggtacagtgagaaacgagcatgacttgtgggttagatcatggaggggaaacgttggggacaaggggtttgatcatggaggggaaatgtgggggaccaacaggctggaggagtcttctaatacccagaatttttctttgcaaagtggtgtggtgaggggagactcagttacctagtttcattcaagaatatgtatttagtttacaagaggcagtaaggtagcatttccattaggaaaaggcatttttctccccagaaagggaaatctgaacaaattacaagttctacaaattacagaatactggtacgtagccgaggctctatggaggttcaggtgacaggaatttcatcatcacaagggcgtaacagaagcatgagctggaacctgggaaacaagaaagagcccagtagtctgcacaggtcaagtcatcaaagagtcagagatataggtgactgtctgggagttcaggaaatatgacataaatcagtcagctggccagatggttctatcccagcacttcctgtctcagaaagagcaaaggaagtgaggcatcatgaagactgcaggtggcagaaatcaatgtgattgatgaaagcagacagaggaaaaggcaacatcaaagtgatgacaaaattctttatcaatctggcacattagttactactataactcaaaaggaaatcaactttgggctacatttgcagctctgtaaaaaatggatgaactaaatgccataaattaatgacatcaagtaagactacttttatcttttatttcttaaagatgataaaacaggttaagtgacctggaatgccgcagctgaaagtgttattttgtatctttctgcttgaataaatggaagcattatcagcttccatttgttcatatccacctaacactgtcttctatttccctaattcaaagtatgtttaaattaatcatgtattctttgaattacagtatatatgctgacccttgtttttagttgaaaacctatttaaaaattgatttagcaatttgttttctttgtttcagaggaccttatcatgtccttcactgtatccatggcaatcgggctggtacttggaggatttatttgggctgtgttcatttgtctgtctcgaagaagaagagccagtgctcccatctcacagtggagttcaagcaggagatctaggtcttcttacacccacggcctcaacagaactggattttaccgccacagtggctgtgaacgtcgaagcaacctcagcctggccagtctcaccttccagcgacaagcttccctggaacaagcaaattcctttccaagaaaatcaagtttcagagcttctactttccatccctttctgcaatgtccaccacttcctgtggaaactgagagtcagctggtgactctcccttcttccaatatctctcccaccatcagcacttcccacagtctgagccgtcctgactactggtccagtaacagtcttcgagtgggcctttcaacaccgcccccacctgcctatgagtccatcatcaaggcattcccagattcctgagtagggtggcttttggtttttgtttctttcttgtcttgtcttttattgaaaggaaatcaaaaataggctaaacagaattttgagggcatggcccaaataactcatgagttccaagttgaaacatggttgtgcaagttggacattacaatgtaaaacacattttcttcaaacacgttttcccttttgtttcaaaaaatgtaatattttcccccaagcgttttatatttatgtattttgtattcaatgtgaggcttattaaaaatagtgattctaatgtaagaatcagctaagatgcattatatatattttaattaaaattaaaacttcagatatttgtggattacaatcctcatttacttccaatgtgactaaaaagagaaaaaaaatcactgtgtcactttaaagaaaaatcttctaagggatttggattttactttctttagaatgacaagtgaatcatattgacattttacaatcttagatttttctttttttttcttttgagacagggtcttgatccgtcgcccaggcgggagttgcagtagcatgatcaggactcactgcagcctctatctcccaggctcaagtaatcctcccatcttagtgccccaagtagctgggactacaggggtgcactaccacaccgggttgaatttttttttaattttagtagagatgaagtgtcactatgttaccaaggctggtctcaaactcctaaactcagatgatcctcctgcctcggcctcccaaagtgctggaattagcctggccaatcttggatttttaatggaatatgtgggcacaaaatgacagaacataggacattctaaagttccttgatttgatcattataagaagtgtgggactcaagcacaggaaactgaactcttttggtgtcattggatgtttcatttttgacactaattttttctggacaaactctttatgtgtttttcccaagaatagttatctacttcctggaggcaaaatccttggatttactaacatgatgatttaccttttcttcaccgttgtcgttacattgttagaaaagcaacaggaaaaaatccaattcatttgacctaaaaacaagcctcaagtttaaaaccaagctcacgtttttcttaagggaaaaattttctttcttaaacttacatctagcaacttggaaagcactttctctggggatcttcttttgtaactttgcagacaaataagtatgagtcactggggagagagtttgttattgaaatagatgttgcccatgaagaattctccttcctggattgactcttaatcatcaggcatcattcctggtttgcttctctacgaatctcaattccaacttctctgcagagtctgtacagtgattaagccatgccagatggtctttggtgcacacagttatttaagaatccacttccacaggtggctgcccttgtaaggaagaatgcatccctaaatgtggccaccagagagttccagtgggcagatgtctgtggctgcccttctcatttaaggacatgagttcactggagtattactcaaaaagtctgtggttcatttccagtattgtgaatatttagtttatgtggccgtttctttgtttctttgaacagtgggattttcagtgaaaaagtaccctctttttcatttcctattgcagtggtcacagctaatagtgtctgaacatggttcaagaataagagattccatgtagcattttctttattattttcatttcccttatattatccatcattccttaaggacaattattcttaataatgcttatagaaaatgttctctaattaaacatgccaaaaggaaaaagtaagagaaagagggagcaagaagaaaatggaagaaaaagggaaaaaagctaaccggataaccaatttgttataagttggttttcaacaaagaaatttagcagccaagtaaggtttcaagggaatattaacttggtatcagggctacttttttttttttttttttacttgcatgtcatccttaatgtctaacatgaaaaatcagcaaagagtatggtttttatcaagaatttgtgttgggagtaaaaactgctttatagctcccaaattaggaagagaagagcagaaatcctctggggcatttaaccatctggcagaattgttgctgcacccttatcccagttataagacagtcaaaatgactatttcctaaatattgtgagtgtatgaaatgtgaaattaaagcaaaaactggagacttttaatgtatttctttaatttgaaatgttttgtggattgtgaaataaaaataaatttatgtcaagttttattcaaaattcatttatgaaataatgccaacactgttctaaaaagcaaggagtcaagaaattataaaattcagattaaatcaggaaaacacattagatggaaaattatactatagaatttgagcttattaaaatttattgcataagaaaagtctcctttttactttggtatttaaacctaacctagactatttgtaaatgaatagactgagacacaaatcctttttcatataaaaatgtataatggagaaagggaacatcacaaataaattttacaagatttttaaaattaatgcagatggaagaattagtaaattatttatttaaaacatgaacttagagtcttatctcattagctaaatacataattacagaattatttaattattttatttagggaataagcattttaaataatggctatctaaaaaaatagaggaaatttgaaataaatgtttagcaaatctatgaaataggaaaggggtactttttaagagccaaagggatgaaataaattacaaaggaaaatattaacagttttgattatttaaaaaaatttaaaattctgttcattaaaagataaatttatccaaaatctaaaacaagcaaaaacaaaaaaagaagaaagaagttaagttaatataaatatggcaaaaatggccaatatcttgaagtcatgattagcacacataaatacatatggaaaatactcagttgtaaatagataaattagtaatggaccaaaacaagcaattcaccaaagagaaaaattaattgatttacaagtttgtggtaaaatactgcatgttactactaagaaagtgcccatgtacatttaaacaacactctagtagttttttctatcacattagctaattattattattatttgaataaagacggtgttttgccaagttggccaggctggtctcaaactcctggcttcaagagatccgcccacctcagcttcccaaagcactgagatcacaggtgtgagccaccatgcccggcccacaatagctaactatttatgaaataatgaatctcctcactgctggcaaatgtactaagaagggagtgctcctacatatttctggtggcaaggtaaactggcattgcccttttggaaggcagtttgatgaaatgtatcaggagtcttgcactaggcagaccacgaagtctcctagcacctgccaggtacacggttttctctgagaaaagtggcgatgaacttgtatggagaccaagcctgctatactagccatgtgggactggatcagagcattccgtatcagatgtgagtaaccgaccgaactagatcttccctgctttgtgtgagagggtggggatgaagggagagaatgggagaactgccactgagagacctcgaagggaaaggagagacgaaaataacaaagacctggagtaaaatggctgcagtatcttttgaataaacttccattacttaagattactcatatctttttacaatgttacaacttgaaataaattcacccgagtaccagttcaaagaaagtgatggccgggcgcggtggctcacgcctgtaatcccagcactttgggaggccgaggcgggcagatcacctgaggtcaggagtttgagaccagcctgaccaacatggagaaaccctgtctctactaaaaatacaaaattagccaggccgtggtggcacatgcctgtaatcccagctactcaggaggctgaggtaggagaatcgcttgaacctgggaggcaaaggttacagtgagccgagattgtgcaattgaattccagcttgggcaagaagaacaaaactctgtctaaaaaaaaaaaaaaaaagagaatggctgatgataaatagaccctcacagtctagacactgggatagttctaccctcacccaggcaagtgggacccatgcctcatggggccccacacttcagattaccttctttgaagttttctaaatcacagttcggtgtgtagaactggccaggactggcaatgccaactggacagggcacatgagcctatacaccaagacctgtgtggatgctagtccttttttatttttttcgttccctttcaggtgatctttgacccgtatctagcatgtcaggtcaaccagctatctcagaagctctccaggacttttatctatgcggtctctgtgattgaaccccagtttcaggaggacagcctggcaatcaggtcactgctgctgatgggagtgtatttctttcacagaatcacatgatactggacagccagaatggtactgccatgctgatctggggtgactttaactcagaatgaagaatctctgggtaataactatctaagtacttcttctcaactcacttaaaatatttatggaggccgggcgcggtggctcatgcctgtaatcccagcactttgggagggctggagtttgaaaccagcctggccaagatggtgaaaccttgtctctactaaaaataaagaaaattagccaggcatggtggcgggcgcctgtagtcccagctactcgggaggctgaggcaggagaatcgcttgaacctgggaggcagaggttgccgtgagccgagatcgcaccactgcactcctgcctgggtgacagagtgagactcagtctcaaaaaaaaaaaaaaaatatggaaagatcactaaacctcatttgtgcccatgaattttgtaaaacatttttaactaatttttaaaatacaagataaggccctgcaaaaaatatttgtccagggcctcacacactgtagctctgtccctgtgctgagatgatatggggagacacaaagtatgagcctaatgtgatttgaaaagcaagtagtccatactttgttgtggtaaaattctgatcatctctcatccttgtgttatagacattgtgtctgtaaccacagaagagcttagaatattgtagctatagcttgagagtggttctgagagttgaagccatgctggaagaacagatttaatgagatcttcattgtggtgtaagtaaaatagagaacggccatgcaagtgcactagcatatgtggtggcttttgtaaggtatgttggggaaaggatagatgcaagttccaaaatgcctgaccaggagctagagctgcagggccagcaggtgtcactgctgccagtgacaaatccctgctcccaatggctgtcactctgacactactgaaaagctacagcagaaatggacacctttatgaactgtgggattctcagagtgccagggactcagggacttcaagactggggagagtctttattgaaaaatcaggcttcaggccgggtgtggtggctcacgcctgtaatcccagcactttggtagacggagacgggcagatcacttgaggtcaggaattcgagacccgcctagccaacatgatgaaacgccgtctctactcaaaatacaaaaattagccaggcgtggtggtgtgggcctgtaatcccagctacttgggaggctgaggcaggagaatcccttgaatctagaaggcagaggttgcaatgagccgagatcatgccactgcactccagcctgggcaacagagtgagcctctgtctggaaaaaaaaaaaaaaggaaaaagcaggcttcataggtaagcctctgcttagctaaaatagagaacaagagggctgaaacttaaattagattactgactacagttgggcaggaagaatgggcaatgggtgccattaagtaacagaagtcaaacagccaaatggtcaatgagaatctgagagtataggactgtagggtatgatgggagtagcctaaggtatttgttcaaagctgaggagcaaattgagggaaaaaaattcacaaaatgcatgacaaggagttaatccttttacataaagagctcacaggatcaatgggaaaaatcgttgtaagaaagaaattaagaaattcactggtgaaaatgaacataaagaattctaagtagaaaaaaaaaacctttaacaacactgaaagtggaaaaactaaaaactcctattaagaattcacaaagaggcagggcgtggtggctcatgcctgtaatcccagtactttgggagtgtgaggcaggaggatcacttgagctcaggagtttgagaccagcctgggcaacatagcaagacctcatctctactaaaaatcaaaaaactagccaggcttgtaatcccagctactcgggaggctgtattcccaactacttgggaggttgaggtgagggcatagcttgagcccagggggttgaggcttcagtgagctgtgatcgtgccactgtactctagcctgggtgacagagtgagaccctgtctcaaataaatagataataaattaattaaaaagaattcacaaagaatagcaacagaatacagtcaaattttgatgattgacaaggatatcaagaatcaagaacaacatgtgctttccagcttagggacacggtgtgatttgtggagaatgagttaagtggacaaaactgtcatctctctgaatatccagtttggagaaacactcatgttttgaagcaattaggaatagaatttttcaaattaaggaaaagaactctaacaatatctgaaaaccgctataaaaattctatgcaaagctataagtattgactcacactgatgctaggcgcgaatgttctttggaattttaactacactaatattattactaggattgttagttttggttagtgctccagtgacaaatttccacaggtttttttttttaagtggtttgtctttaaccttatttttctataagccctgctatttttagctcttggttttgtacaacctgaggaatacatatacagtgtcacaacaaaaacataaacacctaagtctgtatacataagtatgaaaaatttcaaaagttaaatgattgctcttacatatgaatgtcttatcaccaaagtagcttgctgaatgtcttatcaccaaatcatcgaagtataatgcaaagaaccaagctgaaatccaaggtacagctgccacacaattcaggaacatttcgtggtaggatgaaattggccgcagttagaaaaacacaaattaaggaagaaactgcagagtcaaaactcagactgcagactccccctgctttatccagttggtgtgctgaatattcaagcctacatatttaaaccttgtgatctgctgagcagctacaccacaggtgctcaacagaccaaaagggtctgagggaaacaagggattccaccacattctaactgggcaaatggcagacttgggtagatccagtggcctttgcaaagtgttttggggtagggatccagacagagtcaggcaaatatcttccagatggctcaaactataaaaagtaaaatttaaaagcccctttcttcaacatggaaagaaaggaattaaactaaccctcagagagaggcagtaaaatgtagatgtgccaatcacattgaaattcttaatgtaaccaggcagcttaacttcaaaatgcattttaaaacttgtatttttctttttcttggatttcaagatataaccttgcagcaaactgcagaagcattttccttagccttaaaatagattccatgttctaccctttctcaccatatatactcccttcacatttatctaactgtatgctagcatctaattatgtgccatcttagaagttccaagggccaatcttcagacggaaagtccaaatctggacccaggtgcaaaattccagagattacttcaaagtggctagtcaacaacttggccattgtcgaaatgacaccagcccatgctccccggtggattgaaacccaagatagccactggaacaagatacacagacattgtactccgcacaatttttgcgtgccatccattatcaagttttccctttttaagcccttggcttgcccctcaaaattgaagtggttgctttggatgggaatctggccatgtctccattactacttttgtttaataaaatgactttctaccagaccttactcttgttaattggattttgcgagtgggaagcaaccagacttgcatttggttacattggtccctgcagtccctgaagcctagctattgaatatctctctttccttcataggtaatgaaatctttattggaatctactagataccacaatcaccttttataaaattttcatttttatataaacaacattagattaggtcacaataacttgctgaaaagatttctaaccaatacagggattcaatatatactgctttatttctgaagctgataaattgagaaatatgtgtctaagcatattatctgaaattatattagcaactgctggcaaaattaaatatagatgatctcttttgggaaaataggcatgtagacaaataaagcacaggttatacaacaaatggtagaaacagaaaataataatgaaaacaaaaatttaaagcataagatatcagaattaaaatagattactgtctttataaaaataaaaatgagacacacacacatacacaagacagaagacatcttttcaatcaaaaaatcctaccttcaagtcaataaatcttgcctaaagtgaagtggctcagaaaatgtgaaagtaaaagggcaggcaaaagtatgttagtgtgtacctagcgtgaaaaaaaagtcgggcaagatgaaatatgtgaaataggacaaagaatattactttaaattttttgtgtgtgtttaattaaatttttatttattatatcattgctaatctaatagattgtacatggtagctcaaagcggttttagtttgcatttctctattttttttatactttaagttctagggtacatgtgcacaacatgcaggtttgttacatatgtatacatgtgccatgttggtgtgctgcacccgttaactcgtcatttacatgaggtatatctcctaatgctatcccttccccctcccgctatcccacgacaggccctggtgtgtggtgttcctcaccctgtgtccaagtgttctcattgttcaattcccacctatgagtgagaacatgcggtgtttggttttctgtccttgcgatagtttgctcagaatgatggtttctagcttcatccatactttaaattattgaagagcccactcccagtgaggtataaagcatcacgagtaagcatcagagaacgccatttttttttttttttttgagaccgggtatctccatgttgtccaggctggagtgcagtggcgcgatatcagctcgctgctacctctgcatcccaggctcaagctatcctcccacctcagcctcccaaatagctgggactatagggcacatgccaccacacctggccaatttttatattttttatagagatgaggtttcaccatgtggcctcggctgcagaaatgactttataaaacaaactacagagtgaaggatgcaaaagaatatacaagtaagtttggaaggcttatttgtggataagaagtctaacattttaagatagtttatacccaaattaatttataattcaatgtgatgaaagacagaattctgacatacagacttttgttttgttttttatatttgcttttgtttgtcttttaacttagatgaagataaaatgtcatgtggaaataaaacttaagaaacaatgtcatcaaaattctgacaaagaaaagtaacagaagatcctcggcctaacagatattaaactggtcttaaagctaaaataaaaattaaaagtcatgcaaatcaacagaagaaaataaataatactaaaatagaactaggcatatatgggaaattagttatgatgagagttgaattttcaacaaattaagacaattgattaattaatgtttgggagaaaattagctgtagagaaaagtctctgattcaaaataagttcaaaatggaaaaagaatgtaaacaaaaaatgaaatagcggcatgcaataaaaatacataaatatgtaaaaatatttacatgggaaaaacttttctaaactagtctttgaacaatgtaatttcagattcttttaattttgaaattagtttttaaaaaactaaagttttcaaatatagattcaaaacaattaggatttattataagtgtgtagtatttatttattacagcaagtggccttataagaaaggcagaggaagatttggcacagacacaaagaagagaaggtgatgtgaaaatgggacagaaagagatttctagaaatactgatcttgaatattggagtgaagcagccacaagccaaggaatgccagaccctgtcagaacatggaagatgcaaggaatggatgctcttgtgcagaaccttaaggtgagctaaagttaaaacattagcgccttctcacagccttcctgggcatacacatggcccttcacatgtatgtgggtttctagattccccaggaatatgtcagagcttttccctatagacacttcattttttatttttgtgtgtttggttttgtttttatttgttttttattttgttttgtttgcttgttcttttgtttgtttttttgtttctttgtttttgagacagtgtctcactctgtcacccaggttggagtacagtggcatgatctcagtgcactgcaaccttcacctcctgggctcaggtgatcctgccacatcagcctccagagaggctgggatgacagacgcatgccaccatgcctggctaatttttgtattttttgtagacatggggttttaccatgttgccaggctgttctcaaactcctgagctcaagcaatctgcctgccttggcctcccaaaatgctgggattacaggcataagccaccatgcctggccttccacggttttcttaaacattttttgctcagcctctttctactccaactggtgtctctttatcaggcagctacaaaatcaaacagttgctgctgactgtttttaacaagtgccttggaggaaaaagggagctttccacctagtgagctctgaatgaagttatataaagacaatccctgtgaatggggttttcaagaagttgctagtcaggtcaaatagtgactactgctgaggcatggagctttttaaagaagctctaacccattttgacttctctgatgactgttaggctgttggtttctgtaagcctgatgattttcatggctaccttggagctggcaagaaggacttgggaataggcaagttaaaatgtcactaaggtctctgttcttaacaagattcagttgcttttcttgaataaatgctcctcaagttgtcacaagtcttcagttaatttccagagtactgaacaagttgctttttcttttgccatttatttccactgtttttatggcagaaaaaatgttcagaagaccttatcccatcactccataagtgcttctgcttgttaacattttggcatacagacagtcttgcctcttaaagtctactggcacaaagagccaggtcttaaaaattaaaaacagtccatcaatccttcaccagaatactgtggtgatttctcctgtctctgcttttcttatgctgtgaaatgaaatgtgggattcaagactatcctttagaggtagatgattgcttttaagagcatactcttcctcaatcataagtatcttgtgagaccagattgtggaattcctactgatggttaaaaggttcccacatcatatctcagttttaaaacaggaactatattattctaaggatttcagtcctccaactcttcagaataaatctccgacttcatgaaacttatttctggttaagcgcaaaacttatggttcaaattcctccccaaaagtttcggaagtgaggagatgctcatgtgtgttaaacaccaaaggcaactgtgttgcttggaaaaactgcaatgttggtgtttagacacttccattcacctgcctggaagggaacatagtcatgagcagtattctttctgggtggaaataagaggtgggagctgcgtgcagtgactcatttgtcctttctctttccctatgtgcatgcatgcttttccacagattataactcatggaaattctcattggaaaagacacttcagtaacatttcccacatgctttgacatttttttttttaggaaaatgtttcattctattaggttaattccaccccaaggtatttgcataagtggcgtgggtctggcctttgacgttatcttcctgaatgatctctgattgctcactcaggcatattgtagactcttggtctcattgaatcttgtgctatctttaccaaatcaaatctgtaaagttcactggcaatttaatgtattgtttttgagtcatcttgacattttgacttcttaagtgtaaactgaaaaatgcatttactggaaatttggaaatttgttttttaaaataaaacaacatatgccagatccctaatctacagatgatttataaaatcaggcaatgcttatgaggtaatgctgctgaaagaaggtttctaaaaaggaaatttatctccaatgtttctaaagcacataaaagaacaagactgtttttaacaggagaataaaacatacaaagaagggtgtaaattattaggatatcatccagtttttttgtaaggcaggtagagaggaggctcaaatgctaaaagggtaaaaatatttagtttagcattgttgaaagaactggagaagattgtctttatttcaaagttgtaaatattataaatagataaactttttggtaagtgagcctttattaagaaatcaatgcatattggtttgaattggtagaacctttggatatttcataataaataagatcttattttgtagtaatattgaaatttgaaattttcctagtagatactttttattattaacttaagtagtctagagttaattcttgctaccgaattggatcaccatatgatgaattctgtcactacatttatattaaacatttagctatatccatggacattgatgtttagaggtaaacaaaatgcctaaatagaggtgaagaggaactccaaatatgcttacctcatgcattctaaagtttagaagttttggcaactgagattttgcaatcaccaatggatcacagaaattgacaagataattgttattactcttttctgttttaatataaattttctaaagtattataacattttgaaatagaaagtttaaaatatttgtttacttaatttcagaattaagtatttaattaattgctgactttgatgagatcaggcacactcagggtggtatagccatagatgaattgcttactttgaatgaaattgaatgtaaaggaatgtaacagttaaaagaaaaaagccctttttttcttcattttattctttcattccatcttttatttctttcctctttgcattgttatatgatatttataaaaggggttctaaacaagataacaaaaatataaagtagatgatagagttggggccaaggggaagcaaagtggagccagtaataaggttagtgctaaaaaccagagtcttacatcgttaaaaccaacaaagggccatggatttagctcttagctttttagctgtgcacttaatgaaaggaataggaacagatatatattcacagagctcataagataaagacaaattattcattccagagcacagtgagttctgattttaggtcctaacaatatttgaattttatcataaaaaggatcctgtgtgatgcaatgaacaaattactaagtaatacccttaggataaatacagcaaggaattttatgtggatgtgtcttaatttagggagttgtcatcatgacagaaaaaaaatcagtgaaaataatcctgttgagtcaaaccccaccatatcaatgaggcaggattcacttccgtggtcctgtgaggggactattagagtatctggagaaaacttcctgaccaggttcaagaccccaaagggaatcgataaattttgaaagagagctctaggaaatcctgtaaattgtgtacatcggtgggtgtataaggtcatggatgcatttttctgaaaacagggtttgcattttttaacaaaagaaactttgccttagaaaaggttgagagaaaagaataggctgcacatccattattaatacacttttttttaaaaaaagaaattcgtgaacatgcatgatcattagttttgagagtgtgctccatgcttacttctcggaataaaaaatttctgtatgacacattaaagaataaaaacatatgctgtaagaatcagtcaacaagggtggtttgtacttcctcttaagaaagttgacatgctgatttagtgctaattggtagagaaccctgcttcatatatgtttggaagtaagcacagggtatattcctaggaaagatatagatcttaacagaaaatgatgttgtgagccttccaaatgaaattacaaaactttgagtttttatcatgtagtgtgttaataagtttaacacaagtatttttaaagcagatataaccaaaagcttatcttgaacattacaaaagaaagagttgaataagacactcatagactgtctggctttgagcaatgcaatttcctggaacaatatactaagataaattgcttgcaaaatgtacttctctgtaactgaatgagataccttgctgaatggggttgttagctataaataaattaaaagtttttttttttctggcaataaagagtttgaagtagaagcttcttaaggtcttggctagatcatgagaataaaattactatgcatcttatgtatgtgtgtgtttatatataaattaagatttagtattatatattgtatattaagaaaaatattggagatatctatatctatttctaaagtctcccagagagattggataacttgcataaggtcttatactgtatttatgtggtggagctgggattcaagcaagggcagtgcagctccagaacacctgtcttagccattacactatgctccctctatgtacaataatatgatcatactatttgcttgtgaaggaatgttcactctccactgtctgtgaaagggatctaggtggggaacaaggcatcatctatttcattcaaaatgctattaagtcataaaagaacaagttattgtgaatgaaagaataaaccctcttatttactactagaaatcagtaactgctctttcaagacctggtataatgcatatgttgtttaaggtttcacaattaagaggcatccagagcagctaatataatagctgtatctcttcatttagtcaatgactgttgaagtgtaggaagtattgtttcacttgtacaaaattaaagagtttatttaagtgatttattttcttctctcagtttctccagccagctttatgactctttgcaccagttgacatagcaattctatttctaggaatttatcccaatcaaataatttaaggaaagcaaaaagccatattcatgaagatatctagaatatctttatttgtaacagaaaataagaaaacattagtggggaaaaccatgggtcttacattaagggacataaaaacagctatataaacacaaatataaataattataaaaattctgtaaaagcatggaaaatgtctggctaaatgtcaaggaaaaacagcattaacaactatcatagacatatatttaacatgtatatagacatgctttgaacatatattatagacatatgattaacatctattatagacatatgtttaacatctattatactttcagcaagtaaaatgtatacttgtgaaaggaaatatggagaaaatggaaatagttatattgtaataaacttacaattattttgttgttctttccttaatattgtcgtttttatcttccagtgaattttgccaattccttgacaagttcctaggttttcactagaggttttcaggatttcactgtccattaatggaattcctacctttcaaatattggcttctccactcgttaactaaatgacactctgccagttaattaacttctttataccatattttttttcctgctgaatatggagcgaataatgcttacttcatagagttgttgagatcaaatgagataatgcaaattaatccttaagtttacagcgtttcccagcacatagtatgtgcttaaaagaaacaaaacaacccaaatggattagcacatttagctaccatttgttgagtattcagaaggttggactaatgtgtgagacattactgttttaatggtgaaagaaaaaaatgtaattaacatgtcagaacaaaattttagttttgtttttaaagccatgctgataaaaaatatataatgcatcacagaattttaaatataaggcaccattacagtttttctagtcttttagaaacaaaggtatttcaattaaatgcagctcaaaatcaataataaaaatttgaaaaatagagaagagaatgaaaaaaagaaagtattatcaatggcatcatccaaaatacagctcctgttaacattttgggggtttatttttaggatacacaaaggatacttttaaaaaaataaaattatattgggagttttatatttctctttacacttaacactagaattggtttcttcgttgccaaatagtttcccttaaaaaaaagcctacattattttatattgattggagattataatttattaaaatattctacaagtagtttttagaatattttaataaattataatctgcaatcaatagtataccttttcacaattaaaagtaaaactattctaaatatttttgtatttttttttgctgtaggattatttttattacttccttagcatagttttctagagatagaatcattggtttaaattgtgaatatttttaatgattttgatatagattgatgtatcacattgccagcaaagaatgaagagaatttaaaaattttgcaagatgagagtttctataattttaacttaagcctctttcatttttgatcagaggtaatgatttatgatggaacatttaactatgttaattgatcattttaagtttttattgcatgaattttctattcatatcgtttctcctttttttaggcatttaatatttattacccatttgcaatgaatgctttaggtttagaaaatattaactttctgtcatatattcaagtaagcccataacttcctttgcaatttttaatttcacttgaaatttgaaatatttttttaaagtcataaacttgatattcaattctatgttttaaaaaatactaagttgtcaggcagtttcatttatttgtatgtaactctttagtttggtgaaaattgaatccaattggctgttcatttcatctatctgaggaaggtgtttatattcacttccaagattctttctctttagaattcttaattcagagtaagaagcaaaaataaaaataaaaatacagactccttcttaaatattttatatatgtatattgttattgttattattattattgttattatttgcgatggagtttcgctcttgttgcccaggctggagtgcaatggtgcaatctcagctcaccacaacctctgcctcccaggttcaagcgattctcctgcctcagcctcctgagtgagtagctgggattacaagcatgcgccaccatgcccggctaattttgtatttttagtagagacggggtttctccatgttggtcaggctggtcttgaactcccaacctcagggcattggcccacctcagcctcccaaagtgctgggactataggcgtgagccaccgtaccaggccggaaatattataattattatccctatcaaaaaaagcatgataacttccatttcactttctaaaagtgcttagaaatttgcttcttttcttactgtttaaccatatagaatttttggcaaactgacaaaagagccttaaataaccaaaagtagacattgtacaaaaatagaaatataaacttgaaaaataagaagtaataaaatagttctaacttttatgaagtgttggaaattaaagtatacatctgacgtaaatgcataattagttgacaccatttcagtaagttactctcttccaaaagaggctccagtttgttttaaacaagtacacatctcccagatgaaatcctttttaggtggagctgtcttacaagaaagtgagaacaaaaggacgaatattttttacttttgaaaaactaatttttttatataaaaatttacagcgtatttagttatatttgatttatagatatatttttctttagccataagcacattcttaataagaataattgtagaaatatgaaattaattttgaaaggtctttataggtcaagtttgtaaagacagttaacaaagctgagagaggagtttcaggaaaaccccagccactttttatttcctgtgataaatgtatacgagctatagaatttaagaagtgtgggataagtatattaagttctaaaaacaatgtgaatttctaaataatttctccccaatgtgatgcattgacttgaagttatttcacagaacaaagaaaaaaaatcccaactttgtcaatgtttccagtctaggtaaagtgactaacacgttttgacatcgaatatgcccattcatgctaagaaaaactcttaaacagtctaaatagaaccccctttgcttttgagtgaagtgaagattttagatcctggaattactatagaggctttaaaacattaattggaactctttttcacataagaacatttccagattgttttctttttgcttcagcaaaaaggaggagattcaacattaagattaagtaatactggctgcaaaaataaacatcaaaaaaaacctttccacttttccaccttgaatgtttattcttatcagcgctcatttgggagcaacttataatgtaccaggtattggggatataatgatacataagacagtttcagtaagaggcataattaaatcaattgattatgtaagtgtgctgtagaaaatattatcacaaaaaatacagataaaatgcaataaaagcaaggctggaaaggcattctaaaggggtaatgaatcatagaatttaaaaattgtatgatttttatagaaaatattcccttttctgttgtgaagttacactatttttgtttttaacaagacctggaaaaacatttatgcatttaaaaatacgtcccaatatatgaatcaagcattattcagatgacttaaaggactaagaaaacgactatcatcgaatgaaacttagcctagagaaaaaaagaaacatggctgagaaatctttcaaaacaaagctggtaggatttcagtaatagccatcctgtacaaagactaagttttatttgagaataggaaagaagtattgaacattggacccaaagaactgaaaactaaaacaataaaagttttttaaaaagacttgaggtccaaaccaaatagagttgaaataagtacaatttcaatctcattcactcgctcatctgaaatagttactgagcacctattacgtgacagcaacatgcttttgcatgctaaaagtgtctggcgatggaggaaatgtcattgtatgtcactgtagtgatccaacatgctcagtgttaggctgggggaaatacggggttaaacaagggcccaaaatcacagcacctcacccaaatttgatgggagaatgggttacagtctttctggaaaaaaatgttctactgtaagctgagacccgaaggataaaaagagattggagtaggtgtttctgagggaggaaatggtatgtgtgaaaagccagagacatgagagaatacggtacttttgagaacctgaaagttgttccacgtggctgagaatagattgtgggtggatggggaggggacaatgagggaccattgatgagaatagcgtgatccaggcttgcaagcctgtttccttcaagagcaatagggaaccacagaaagattataaacaagggaatgatatgatcaaagacattttgggggaagatcactttagcagcattatggaaaagagcttggaagaaaaaaggttgtaactagtggaaccctatttgagtctatagaagttgcacaggagagggagaatggaggccgggccttctttagtggatcctcagttttgtcatccaaagaacttggaatcccacattgatttcccccatcacacataatgtatgattgtatatgtgtaagtatgattgtcagaggcagaggtcattgatacctgtttatacacataagtatgattgtcagaggcagaggtcattgatatctgtttctagaaactctgatgactgcaaaagtgtttctcatttccttagtaagaaaaatgccaagaatagtccttgtgaatgtagagaagaaagaagcaccctgtgccttctctatctaatacttaggctcagcactgttttgacagaaaaagcggctttctctctttccctccatggcatttcgattattttgtagttgttgttgttgttgttgttttgacagaatctctctctgtcacccaggctggagtgcagtcacatgatctcagctcactgcaacctctgcctcctaggtttaagcaattctgcttaattctcctgcctcagcctcccatgtagctgggaacacaggcatgcaccaccacgcccggctgatttttgtatttatagtagagatagggttatgccatgttggtcaggctggttttgaactcctggcctcaagcaatccacctgcctcagcctctcaaagtgctgggattataggcatgagccactgcgcccggcccttgcgtggtatttctttgagacaccctaaaggcactgcagccacagaaaggagtgtggacctaggaagcgactccccgttaggatgcatctcaacaacatttcttttggttgtcatttggggtaagaactatttgcaagcaaatgtaaatcactggattgaactgcctgttaacatcatcactacacattgctcaaccgtcccggtaaatccggagggtcacagcagcaaggcaaccatgccccactccccactctccatgctctattctgtgggttttgaatttgctggcctcacaacccacttgaagagaaaggtgaaaggtccagatctcagctccgctactcattggaagtcacttgccttttttcagttatgaagttgctaaaatttctcaaaacaaagtgacaggactaaattaccttaaattctttctagctgaaaatgatggttttatgagtcagaaatgagaacattagtgttccagacttggaagtacagggaagtaactacagatacaggatattagaatatatgattaagaagaatggtgattttaaaagcttatcaaatagctgcagctcctgcttccttgacagggagagtttctttcctgagggccaggcgccagcagccctggagacgcagggcccagtttgcctcaagtctccttcccaaggctactctacacctcctcacaaagaccccatgaggatttggtgtctggcttctggcagcacattgaccttttctctgcaattgtgtcagcaatggatccagcttcttttcctggaggggactcgaggagcatcaagggcctgaatgaacttctaatgtatttgtgtttcagcagcagtcttcagaaatcaattgttcaccaattggacagaccggctcggggctagagtgcccttcctccaagttcccacattgattattttaagagttcttccaactcaaatgaaaaataccaaaaattttaaaacatgcaggccttctgaagctatccaatcctaaaattaaatattgggtgtgggaatgggagtacactaggaagggtccaggaaggactcaaggctctttccaaaggtgaattgaggagagtttaataaagaggtagaattgaggagagtttaataaagaggtagaagtagtgaggtagcgagtaatccatgaatgagcctcagcagggagccgttggcccctctagggctgcaggagagaggccaccctgcagaaactgaatcttgcgggaggaatgtagtctcttccaagccatggcctaggggaataaatacccagaactctctttccctcctctttggtcctttcatttccaaccagcacgtctcttttgctgagcccagccagcagccagaggaccagggtgtggacgatgtagtccataaaggtcagccttcaaggaaatagaaacagtgaagaagagcagagagggttcccagcagaggcgggagctggggggagagcctgtggcgtcagatctctcccaagagtaagccgaaactcagggctcctgggaggtcctctagggctgaggcaaactgaaagaaacaggtttagctttagggccaaggaatgggttgaagaagcctaaggtgaggaaccaggtggcaaagttggagaccagctggaacaactgaagaacaaagagagggagggagacatgtggcctccagggtcagggcaggcctccatcctgcccccgtgctccattctaggacaaatctcaaagttaccaagcttcggtcccagggcctctttgaaactggttttaacactaagtaggatatagggtccctggcaggctcttcccaggcaaaccatgactatacacaattcaaggccattgtaaagtaatggtgagtatatattttcacaggccacagagtaaaatgaacacaaaaatttgtttttaaaaatgtttacctctgccaggtgcagtggctcacacctgtaatcttggcggcatgggaggctgaagcaggaggatcacttgagctcaggagttggaggctgccttgagctacagttgtgccactgccatccagcctgggttacagagacagactccaagtctaggggaaaaaaagtttaacttgatcatttctaggtaaaggcaatacttttcagatttaaaattctatcatttcagattttctgtcatttcaaatgttgtctttcagatttgaaaagaggatttgtctcctcttttccctcagagtagcatctaagcttctgacagagcaatgtgaaatctgggaggcttcctctgggcactttggagatggtctagggctggctgtcatcgactgaaatatgcagtgacatctggtccctgggtgtggacacccacgctggctcttggtaggttgtttaaaacctgtccgttgctaggccctttccactctttgttccttggatggtattttgggttttcctaagcagggtgtgcaactatcatccaggtttgtctcccgtaccattatgcagagtgtttctccatgatttgctttgtcttatgtcaaccagatgtgaaatgaagccaagttagcctctattgttcagcccctacacttgataacacagggttctgtcatccatcccttccactctaccataaactcacaccagcttccccatctcagaggctcttccctggcctgtggagaatagatgtagtggtagaggggccatgagaactcactcagaaaatattcttgccaaatcttcattctaacatctagactgcagctttcttaaggttaaaagccagaaattagacatggttgtttttcatttgatccatatagtaaacacagagggtgattgagttgaaggctggttgcatggaatgtgtacagtcatctcccaacaccccggcagacgcctgaaaccactgacagcacctaaccctacataaaccatgtattttccatctgtcaacaaattggctaagtgactacctgggaggtagcatagacagcacagatatgctggacaaagggatgattcacatcccaggctggactgggcaggatggcagaagatttcatcatgctatttggaatggcacacagtttaaagcaaataaatggtttatttctggaattttccattaatgttttcagactgctgttgaccacaggtaactgaaatcatggaaagagaaactgcagataagggaggactactctatgtggtgggggaacatatacataagagatgacattgtgaagtaggtaaaattggttttaaaatctttaatactctatttttcaacttccacatcttagtattgtgtgttcctgtgatttctctatacccttctttttgaaatctattttcaggaaatcgtctgatacatacaaccctaataaagttcgaatgacttgcagcacttgcattgttctttctacatgtaatttgatttgaagcaaaaaaattctgagacaaaggaataattttctctaaactcagcatcagtaagtgggacagataacgaggttttggagttaagggagaagttgtcctcgatcatatcatttagatcattatttgttttgctttatatttgctgatatatttttagattccgaaatgaattctaataggtaactttaaagggaaaatttacctttattgtaatattattttcatcaaatcactaatatgacaagaatacaaaatcctgaaaataagttcaaattttctaatttaaaagaattgaaagtgtttatatatactctaatatagatgctttaaatatataaacttttaatatgctatacaaatatacgtatgtatatacatcttatgcaaatgtacacttttagtaaaagtatacatgtatattaaatgtatgtatatattctgtatgttatacatatatacatgtataatatattgtatagaatatatgtatttatgtatatataacatatacagtacataatacattatacattaggtatataaaatatatatacgcaaatatatatttcctaatacaagttattgaaagatattggatttaagactattaaagcaaacatatcatcttaaatatctgccaaacaggaggatctaggggattgaaaaactttttttgtgaaagatcaaatagtaattattttaacctttgagagctgtgcagtttgttgcaactatccaactttgccgttgtagcacaaaagcagctatagagaatacatatatgatgaaatgcttttatgttccaacaaaactttatttatggacactgacgtttaaattatatataagttttggccagggaggtggctcacacctgtaatcacagcactttgggagtccgaggcaggcggatcacttgagctcaggagttccagaccaaagcccgaccaacatggtgggcaccagtggtcccagctactctgggggctgaggcacgagaatcgcttgaatctgggaagcagaggttgcagtgcaccaagattgcaccactgtactccagcctggatgatagagtgcatgagactccgtctcaaaataaaataaaataataacgtataattgtcatgtgtcacaaaaagttcatttaatttttttaaccatttaaaaatataaacatcattcttagcttgagagatgtaaacaaacaaaaacaaatgaatgaagaaacaaacaaacaaaatccagaggggtcagtctatttagctcacagcctgtagtttccagacctctgatctagacttacccactcaggattaccaacgcagacattggctaagtctcaggactggaggtgaaatagggtgaattaggcaggtaaaaccaccataaaaagaggcagaagagcacaagcttaggcatttaatccataataagaatatggaccctctattagtattttgcactaaagaaaaaaaggcaaatttggatttctgctaatatcctgagcttgaaaatcccttccatctaatttccttgcatccagtatgtttgaatttagaatgccagttttatttccctgctcttggttctgttggtgaaaaaaggggagaggagatgccaatatttttatgagctgtcaatttccatatctgacctgctagcatcaaaaaggtgatagcaacaattacagaatattaccaattctaaattgaaagaatgctgactcaaaatcagacggtctatcttccaatctcgtatttgttattaaccacctgagtggcaaaaattactgaaactttctggagatcagtttacttatttgtaaaagaaggatcttgaagatttttctatccatgtgaatgaattatagttccccttattacaaacatcactttactgagaaggcctaaggcaaaaataaactttgccagaaatgtaggcaaattatggaagaatatgtcaaagtacggaaaagacacatttaaacagtaaattcaagtttgtatctttgtacttatttactaagttttatggtaaccgagaattcaggataaatttgactgcagtactttttcttatgtttattttttctggaagcatccaaaagttaagctggctacaggacctctggtttacaattcatttccttgaaagaaaagaagaaataaacacaattctataaagtctgtgaattaaaactttgaacctgcagatggtgctatgattccattttcaaattgttttgctttctagtttaaattcataagagaaaatgcagttgtttggttgagtttacttttattcagaggtaataaaattgaattatttctttttattttatcttattattattataatagaagcaattgtcttttgtattgggaaaagctactatagttactctttgtaaatgctaagtgcttgcctaggccaaataatgatcagctttacatcttttatgtttaaaatttttcttcttatcattcagcagtcatttgtctgtgaccctcaattaagttgctttgctgtttctgctcttaaataaaattggttcactaagaattgggtgatgaagagctaaggataaaaaaattccatatgagaactgtttcaacctctagtttgtaataatcaggtaaaaaagatttcctggaattaagccacaggaactctggcttaagtcagagctgtcaactgggaaacaaatttccagacattttgaaacttaattcatttaatttttctggtaactggattagaaaatatgattaagcatagcaggatattcttttactggatcagtctgactttgaacgaaggaaatagatactacaatcttaaagtagaagaaagaggactgtaaagccattctgtcttatgaaacttagaaacaaaatgtaaaaataatacacatggcagaaagcctttaaaataaaaggaaaaatggcattttcctctgttgtttaggaaatttttcatgtggctgcatttttaccttaaactctgattgaatgtgtgctagactacctttagttacaaatccacaaatagaagtgaagtatttatcaaagtactatataaatgcttttcaactatttgaagccacctgtcaagtgattgaatcagaaatgttcaaaactggtttgagtatgtgtgtgtgttggggatgagggtagaaaactaattctacattatgcaaagacttataaaagtgatgaggaaaatctttaaaaagaaaagacaattaaattccttgaggtatatagcctgacaacaatttattttttggatcatttgacacagtgtatgtaaaagtgcattgggaattgtgccattttatacaaatatgaaatagcactacttgtactgctttgtacaacagcgtgcatatcttactatcttagagactttctgaaacacttatcttggaattagtttcaacaaagacgaaatgtaataataggaaggtgaaaattatctctagagcttttaaagttaggatagatttcaagaaagattaaatctggaactatatgaatagcataaaaattaaaaatattaagagaattgatactttgtaataaagtataattatacttttataagcgtaatgaacataagtgtttgttgctttatgcatttgtttctacacatgaagtctttattttctgaaggaatcccaatggccctggctataacactacaatcattttcttattttacaattaattaaaggttaaaacatttcacattgagcttgctactttgtttgtttaaagaaaagtaaatttcctcttatcttacattttgaagttgctcactataaacttatataaattaggcataatgacaattaagtaagaacttcaagccctattcatcccatggccgtcatactgtgacgtctttcagagcactttgtgattgctcagtcctaagtataagccctataaaatgatgggctttgaaatgctggtcagggtagagtgagaagcaccagcaggcagtaacagccaacccttagccattgctaagggcagagaactggtggagcctttctcttactcccaggacttcagcacctaagacagctccaaaacaaaccagaacagtcagctccgggggagcacgactgggcgaggtaagtgaaaactttacctttcctcttctttttccctcctgcctctggaacttttctcacaaaataatgaatttttctctcttgaaaagaatttgatagtgctttgcttttgcaacagcaaaaaacaagtttctcaagtcacctggtaaggatagaaatacttcaatttctctcatatggatagattttctgaattcttttgtttgtaagatgctttaccctgcttgctcttttactgaatactgatttttacaaataattcattcaagtaaagtttacttgtatgtagatttttgactgaaaatttcagtgggaacatttgcttttgaaattttcaacttatttttaaagtgctttttttttcctatttcgtatgttggttaagtgaatctaagatgcatttattttttccttaagtttaaattccataatttttataggcagcaagagaaacagaccttactcctaggcttttaatctagaaactagaaatgaaatgtgtaagttgattaaatgcaagaaatgcaagctttgcttttaatatatattttcctcttatggaaaaatttatttcaatgacaacatatgattcagtaatattttgagtattaatattcactactgagttaagaagttcaaatccaggtgtaaggaaataagtttccgtaatatctacaattgaaagaggaaaaagtaatgtatatacaaaatcttttttaaaattatatgtatatatacacattatatttatacatttgcacacacacgagcagaataattattaaatagatgatactctagtcttatattagtcagatactgaaattttaaagcagaagaaaatcaatgtcttgaagctgtttccttcgtcaaaaaatacactaagcttgagtggtacatccctgttatgaaaagattgtccccagggttatttccagcactatagaagtatggcattcaatagatactggggccaaccatgtgcccagacagcaggtgaaaaggattctaatttttattcaagcacctgtcactgagagaaatactgatttttgaatgtatcatcttgcaatttaactctttctacaagatgaaaattactctttacaaactctgcaagagccattgaaaattactgctagacaatcagaattaccttgctggtgacatctttggctggaagaactgaggtgattctctctctttagaggcacagaaatggacaccagaaataaggcccagctccttgtgctcctgactcttctcagtgtgctcttctcacagacttcggcatggcctctttacagggcaccttctgctctcaggtaagttccctttcaattcaaacatctgaacattccttcctcatctaaatgggaatttcctatacattttgttggacaactaaatagtataaattatgtattatgtatttaaatttttccttgatgtgttgagtgagaggtgtttgtcaacatcaggtcattctgagtcctggaattcactttcagggcatgagagacactgtcagttattagttttatgggctgagtggatcacattcccaaacatggtgaaaggaggctttcactttctttttattcaaaaccatctttagataaataataagcttttatccattgttatctcaagtcagttcaatttctggtggaaaaaagctgtttagttgccaaccacatttgagtttattttcaagattaatcagtaaataatcataagactagtagttgattagtgaaacatgtataaaatcatgttgcacagaaatctatctaggcagagtcaatttgccaatattaaatatggggtaattgatctattgagatacactcccccaataggaaaattttgatatactttgtttggaccataaatccttagttttattgttctatatgttatattatatattccaaatccataaagtataacacaactcttatttaaaactttattaatgtatgctaaagaagtaaacaataaatgaaaactatattagcttgaattttcctttcagtttacgggcaccactgtatctccaaaggaaaaataataattgggttggtttccttctttgcttattaggtcattcttgattttttgcttaaggtagacttatgctcaacagagagaataacctcttagctattagtgttctctgtgaaatctgtttaaatacagctcctgcgttgctttgataactaaacaaaatggttctatctgaatagttctaccacagcagatgaacaatcacaagaatgtggacatttgtgttgattgctaagcttcagacccacagaggactagttgctagtgactcccaactcccaaatcactgaaagatacacaagtgtccaggagctgacacgctccttggatgtttgccctaacagtgaaaatctgcacacacaaaattataagagttgccggtgattgaaatatgcatgcatccataaatatagtcatattccatatatgcatttgactattcttagtctttcagtgtaacattgtacatcccttattaaagttgtgttaatacataagattagaaaaaagaaggccccataaaacttattgaattcaaattcatcttcatagatgagctatccatctatggagacattctttgaactctgtcaatacagagaaatatataatgccaaagtaaatatttgaagcaaagcttgggggtcgagagagagagaagcagttaatactctgttcttcagagatgtttggaacaggtaatactgaacatcaccaaatccataaattgttatcagttctcattcaatattagttttttgcaagtttctattttgcataaaatatttctacatacgaaatttgactttgcaaagtgaagatattcttggcatagtaaattacaccaaagaagtatagtttgcttaatgctctgataagattgaattaagtagctcttgtgttttgtatattcagcttataaaagtcatatggcatctactttataggataataggaatttcctatttatactctcattaactatatgagccattaagtcaaattatgctattctcatattatgactgggtaatacttcccaagagtctaagtatcttattttaaatggttgcggaaccatacacactgtcttctgaaaaaagaatgtattattctcgtgtaactttccccatcaggttgggtgacagaataccctttgagggagcaaatgaacctgatcaagtttcattaaaagaagacattgacatgttgcaaaatgcattagctgaaaatgacacaccctattatgatgtatccaggtgagtttatttttataaaactatccaatgagttttattttagaaaatgtgtttaagaactataaacgtgcttattttatctcaccatgaagctattccgatagcaaaacactagaggtttctatgtgtcatggcttcattcatcctgatttactgcagatcttacagctgtacataattttcatactgaaaggttgtaacaagccaggatgaacacaccattcacttccattctgttgcacataattccaacatcacagattgtaccaattctgataaaagtacagcatttagcattccaatgatggaagagttgccaaggagttttgtctctatataaagaaaagatacctgatagagctgttcattcatagagctgtttgtctagagcatcatttcaagtacagaccaagtagctctatagtacttggtacagacaaagtataaaaggtgcttcatttgaaagagaaaaggtgggatgataggccttaatgccttctctatcttaagagattttgtttccaaatattttggaaaaagaaaaaaaaaggtgtactggggtttatgaactttccaaaatcagaatattttcccattgtgaatgtctttattcagtggggcagacacaaagcaccatgtacaaatagcagctaatttaaatagatcatatttttacaccaatatttcttagaaagaaatagttataaagattcaaccatggaggaatattgaaatgtgctcctagaaatgcctgtttctttaatttttcagtgtcttgggctagaaatatagggtatatcttgatataagtgactagaagatctcttttgttagggtgttaagaaatctccttttgaactttagttttaatgagaagctttcataataagcccataatttttttgttatttaataagccataataatattctagaaagccatttacaaaataatagctatttttttcttccttgttttagaaatgccaggcatgctgatggagttttcaccagtgacttcagtaaactcttgggtcaactttctgccaaaaagtaccttgagtctcttatgggaaaacgtgttaggtaaagagaatttattatttttataaaatatgttatcattattcaatctgaatattgtattttcactcttaacaagttatttactttgtttgaaattgaaaactcgttgataatgtttaatttagttaaatgaaataacttgtattcttcaataacatctatcaagcccatggactaagactttttcataatatcatattcattgactccagacacacatttttctcaagtagcaatcatttagcaatctgcaatcaaattgaacaagactcagtaaaacaatcaaaaagagatagtacagactgaggtaaattttaaggtcaaacagaatattctttttacttcctgctcaaattaaatggagaattccaaatggccaacagtcaaatatttagatgacgttgctcagggtagcatagcttctaaagaagtaattatgttttttttaaaaaaaaaaaaaatttctcccaatggcagagcacaacttcagctattcccaaatttttatttttggatgaattatttgctcagctgtacagaatgtgtcataaaacagtcccaggccatgccaaaatatggcagatgattccttgctttccttcatccttaggtttagttgtatttttcttttagtctttttatgatagaaaattagttgggtgggaattgctttttatgtggctccaagaaacctggaacatgtgtgtatttatcatttcttgtgaaaactctttgatttccttttcctcatgttccttagcagtaacatctcagaagaccctgtaccagtcaaacgtcactcagatgcagtcttcactgacaactatacccgccttagaaaacaaatggctgtaaagaaatatttgaactcaattctgaatggaaagaggaggtaaagaaaaagagaacttgctaaaatgaggaatcatgactgactttcaaaatagaagctgcacatggagacctctctatctcacttatctagctatactacgtgaagcagtgattttcaaccttggctgacattagactaccccgcagaactttaaaaatacagatgtctgggccttctcccaaaccaattgccaggaaatcggtgtcttcggtggtgtggccctagacatacatttcttttaagagttccccagttgactttactatgctgccagtgttaaaaatgatgactatacagacatctagtctgaatctaagagcaagtttcatcaaaagtgatgatttttaaaacatgtaaagcatagtcaattgcaatttggtaacacatggaactcacttcgtgtgcatattcactactgttatttaatcaaattaaaccattaggtattttgtatatttagattctgtaaaatctatatctctctatggtgtgtaaatattggacacaatacataaacagtgtagtgttctgtctttttattccaattgtttttgtttaagtgatgagtattaaggataattctgtttgggtgtgatcagacaagatgacctctttgcccactagatgataattctgtgagaataattttagaaactctaagattgatgaataattcataggtactaacaaacctcaaagataattgtttagcctccccatacactttcagagcacagagaacagcacattcattatgtcataatagtttctttagaccctttctcatctgagagccttaatatgtacaatgtttttctggtctgcagcagtgagggagaatctcccgactttccagaagagttagaaaaatgatgaaaaagacctttggagcaaagctgatgacaacttcccagtggtgggtatattcgtgcattccttctgtattcttatggctgtctctgattatataagtagctaagagtcacttagtaagaaacatcttagggttaaatagtttctcatcatgagacctcatccaagacagacacttctacaacagtggaccccaacccagtaaacagcttagaatgattcatgaaatttttttgatcttgtaaaagagagcactcacaataagcaaacgttttgagatctgaatagtgttcctggcttacttggggttatttctacctttgtatcaagataaaaaaacagaggaggctgactcacactgacaagaaaaatgggctttccttttgaggatcgacccatgctgcttttattaattgaaggtttagtctcacaattgactgttagctcctcaattaagtatagggaaatagcaccaaattagagcatggcccattactatgaaaatatcaaggcattctgggtctaactatattccttgaaacatggcaaacttcatagagcaaaagttaaatttagcttgttttacctgtaagtttgttttacctatatgactctaatagcattctctgccaacattttttttgagcagaaaaaacatggatagactttttttctttgtgaagtaataagcttgctatcaaaattgattttatataaatgtgggttcaagacatatttctttcctgagttacattacattaatattcacattcgctcataaaaaatctataatactgggcaagtgcttaaagaaatttcatgctgtcaccatatcaaaggttagcagattttaaagggctatggagtaaaatatgtttggctttgtgagccatctattttctgttagagtgacttaactctgctatggtagcacaaaagcagccacagttagatgtaaaacgaataggagtgactgtgttccaataaaactttattcataaaacctgaaggtgagccagattccaatccctaactaggttaaggagattaaattcacccatgctcaaactaaaggcaattcatggccttacctcagttcctgatggggttatctaaggttttcaacagtcatcaagagtggacatggtgtctgggaagatacctgcttaattgactgcttttgtccactaattacccttagacctctaagagaaagcagaggcaggagtgtggcccacatcaactctttatcttttatagacatctcagagaaacaagtccctttgctcaaagaagaaagttaattacatatagcttttctaagagtgtttataagaaggcttctccatcaaattaagaaacacggtaggcactaaaatataaaggagaattgattaatcacactgtgctttgtaaatggtaagatcacttatgagattccatcctccattcttttcttttttaaatgggtggctttggacaaattctttgaagaggaaatcatgtgggtcatccattagtgaaaattacaagtgaatcattaataatggttagttagacgtcttttcacattccagttcctctctgataatcagtcctctagaagctgctctcttggtatgtcccaggacatgatcccctgccacaggctgttaacaagggacaaagagaaataagtgtttatcagataagtaaatcagtgaatgaaactaagatgctagaaataaaatatattttatgcctaaagcaacaattttttctttttcagaattcttgaaggaaaatgatacgcaacataattaaattttgagttctacataagtaattcaagaaaacaacttcaatatccaaaccaaataaaaatattgtgttgtgaatgttgtgatgtattctagctaatgtaataactgtgaagtttacattgtaaatagtatttgagagttctaaattttgtctttaactcataaaaagcctgcaatttcatatgctgtatatcctttctaacaaaaaaatatatttaatgataagtaaatgctaggttaattccaattatatgagacgtttttggaagagtagtaatagagcaaaattgatgtgtttatttatagagtgtacttaactattcaggagagtagaacagataatcagtgtgtctaaatttgaatgttaagcagatggaatgctgtgttaaataaacctcaaaatgtctaagatagtaacaatgaagataaaaagacattcttccaaaaagattttcagaaaatattatgtgtttccatattttataggcaacctttatttttaatggtgttttaaaaaatctcaaatttggattgctaatcaccaaaggctctctcctgatagtctttcagttaaggagaacgacccctgcttctgacactgaaacttccctttctgcttgtgttaagtatgtgtaaaatgtgaagtgaatgaaacactcagttgttcaataataaatatttttgccataatgactcagaatattgctttggtcatatgagcttccttctgtgaaagtacatttggagacacaactatttttccaaaataattttaagaaatcaaagagagaaaataaagaccttgcttatgattgcagataatttttttgtttgattattttatatgattcagcagtaactcattttagctctaaagttctaggcactagatagcttttgtggtatttgattgtgtgcaagttctaaaataatgatggcttaaaataaaagagaaatttctttctcacgtaagtcaagaagtaagatgtcagggttattataatggttctgctcagcaaaaccctcaataacttacaccccttccagctcatccctcatctccaatggtgtggcacttttcctcatgatccaaaattagagctagcattccagccatcacatatgcattccaggcagcaggctataggaagaaaaaagggagcaaatattatatgccagttctctttgaactgatatcttatactaacatcccctttactagtacatagtcttatggccacagtcatttgcaagagaggctgggaaatgtagtatgttttcttttctttttctgggtgatcatgtacccaacttaaaactaagactctattaatataaaacaaggaaagaataaatgtatgcagcgattaaaaataattccaggcttggatcttaaattctcacccaaaaagcttaaagaaataataaagagagcgagagtcagaccctaaccattaatgaagaagcattatccccataaggcaaagttttgcttggtttcattttctacaattaggacaaatggccacatcaggaggaactagtctagaagtaccagtaattgcaaagtagttttcacaagttgaagtaaattgagcttcttgtatctctttttcttatctgattcttcaaattattaaatatttattaagtgacatttttatgagaagcactgcagtgaaaacagacaatttctaagtgttaagtgtacataaaaagcttgtaaagatgaaatggagccataatttgagtgtgtaactaaagagttttaattttattttattaatatgaatcttttcaatttattccctattgcttcaagaaattcattgaagaaatattcactgaatgactatgatgtgctatgtagctatctgagagattgttctgggctgagggaacagcaagtgcaaatgagggaacagtcctgacatatctggagagcaaggaagcccatgtggctggagcagagtatgctggacagggactcagtaggagaggaggtcaaagaagttactaaggactggaccttgtagggcctcacaggccactgtaattgtttgtgaagtgagatgaggtatggcagagttttggacagaggtgtgatattatctgaactgcactttaacaggatctttctggatactctaatgagagaagagtgaaggagtgctaagggtggaagcaggggtacaaactagggggcaagtgctataaatcaagtggcagatgatggtgccaccaaggcagaagcactggaggtattgagaagtatatctgaatagatcttgaaagaagagtcaggttttctgagaatgggttgaagacaagaaataggagaggctgggcatggtgggtcatgcctgtaatcctagtactttgggaggctgaggcaggaggattgcttgaggccaggagttcaagaaggaggaaagtcaagaatgacatccaaggtaaatcacctgaggcaacttgaaggatgggattgctatagacagagaagactgggaggaacgagggttcagggaaaggtgagcttagtttggatgcactaaggcagatgttgagtagggagttggagatgtcatgaagaggagatgctgagctgcagatgggcaagtgggagatttcgcatatagacgggatttagaaacacaagactggacgagatcagcaagagaccaagtgttgctaaacaacaaaacacaacaaaaacagaaacctcaacacataatccttgagtgtttttatttcctagtgccaccataagaaggcaccgcagaccaggtgtctcaaacaaagaaatcaattgtctcacagttctggagacaaaaaacgctagagcaaggtgtcaacagggcaggctccttctgagagctgtgaggaagaatctgatccatgcctctcctctcgtttcaggtggtttgcaggcaacctttggctgatagaagcatcacttctatctctgccatgaccttcaggtagcatgtctccaaatattcactttacataaggacatcagtcattttggattagggccaatgctaataatctcattttaagttgatttcctctgtagaaaccctatctgaaaataaggctacattctgaaggactagggttaaggactttcacatatgaatttttggggacacaattcagccaataatcctggggcatgccaacattaagagtttggagttttgagaaacaaatgggataaaaatggactggaagaagaagctattgaaataggagaaaaattggagaccatgtcatctggaaaacaagtgaagaagatctttcaaggaagagggtatcattaacagagccaaatcctgctgcagggtagattacaattcatttatttaattcttctgcaagaatttataaggaacttactatctacccagcaccattttaagttctgatgatatagtagtgaataatacagatcaaaattcctgccctcatggagcttgcattctttgatttgaaacagataataaaatagtcaagtaaaatatagtcaagtaaaatatatattgttttagaaagtgataaatgcaaaggagacaaattatgtacttacagttccatatggctggggaggcctcacaatcatgacagaaggcaaggaggagcaagtcatatcttacgaggatggcagcaggcaaaaacagagcttgtgcagggaaactctcccttataaaaccaccagatctcatgagacttattcactattacaagaacagcatgggaaagacccaccccatgattcaattacctcccaccgggtccctcccacaacacgcgggcattgtgggagctacaattcaagatgagatttggtggggacacagccaaaccatatcagaaggtgtcaatttggctttatgtcagagaaacatcaaaagcacgtttgcatgctgaggggagagatgcaagatagggaaaattggtgatgcagaaggtaaagtggggttttacttgagtgatgtccttgagaagagagaggaagtgggtgattcaaaaatagagggattgacctttgcttggcacaagctctcttcaaccacactaacaggcagagtggttgggtccgaggtggatgaatggaagaactggtggaagtttacaccagttctgattacacctgttttctcagggaaatagctgagagtaaggataagtgaggagatgtgaagaaagtaaaagaaaaatatgaaagagtttgctggatgagtgggagagtaaataactaggaaaatatgtttcttatacttagagtccagtgatgactgaggtaacttagaaaaatgggtcaaattaagtagtccaagattattttttattattttgaaaacttaatgaaaactagggacctttttccagaaatacatatgtgtatatacacacacatgcaaacacacacacacacacacacacacacacacacacacacatataatactttcagagcattcaccaaatcttacatgcccatgcatgaaatttcacagtgctcagcacctgctgtttaagatccttactccagaataatgtagtggttggagtcatgtggagaccaccctacagcttgggaaaatggtatgtagagtacatttatcaggggtgagataataaagatctggatttagactggtggaagtgagaaagaatagaatttgagtctagcgcccactgctttagggaaatctgcatcagcaaaccactgaaataaaatgcttgttgggacatgagtttaattccgggaagagaggaagtgtcaaaacccagatttgctagggtaatcctgaattgattaagatgattataaaattgactgaaattattttttcagtatttttttaacataagggctgtttaggatacaaattaatttcagttataaaaattcagccatattgctgcatacatgagtttgaagtgagactaagattaatgccctctaaaattatgttagaaatcattctctatagatctgaaaataacattctatcttctcctttcctttcagtagatacacacaaaatctgccaaaaaaaaaaaaaaggagagacataatattcctggagtttctcaggtttaatatggtatattgagctcatgaacatgtctccctttccttgccaaagaaatattgtcccatgccatcaaaacaagaaaaagggagccataaatggtcaagagattacagtacatttctggggaaagacgggcggtggattgaagagcggatccaggaaattgacaaggcaacttcaatgttgaactaatgtggacagtttgtagcagattaactgtcctatggaaaagctcagatttgacaaatacaagtagacatttcttcctgatatttctgggagaatgtacacactttcacaagttctgaatcccaaaagaaatcagttgcaaaatcaggaatgcaagaattaaagcttaacattcaacgtaaaagcgctactcatttggaggcatcctcttgtgttgattcgctaaggttgccataacaaagaatcattgaatggggagcttaaacaacagaaatttattttctcacaaggaggctagaagtctgagatcaaggtgtcagcaggattggtttcttctgaggcctctcttctgggcctgtgtcttcacatagtcccccctccatgtacatctgttctcaaatttcctcttcttataaggacattagtcatactgaattagtgtgctcaccctaaagacctcattttaatttaattatttctttaaagaccctatctccaaatacatccacattctgtggtcacattttgtagggttaggactttaacatataaaatttagggggacccaattcagcccatgacactattgatgtcaagtcaaaagtaagagcaggaaacgctgattggtggagttgcctttttttgatgttttttattatcaaacgtctttatcaggaagaaattattttcacatgttattgaaagatatttcatcacaatatatgagtatataataacaagccatgtatttatcatgctgtttttgttacagaaaatctctgaaacatttagtgtgatcccatcacagaaaaattttcatggttgcagtttgattatttttattattttaaaacatataaataatgtgttatgaaaaatgcaaaactacttataagtttggaaattcctaagaattcctgccaattctgattgacctttcctgaataccaaagattaatatttgtcaggaatttggaaacactataactgagggcaagcttatggaagggcctgaatataggggcatacactgaaggcttacatacaagattattgatctcccattcctgctacagaatgctgaaattcctggatgatcagaagaaaaataattacagagttattctctaaagaaatggggttggggcagagggagtagctgccatgggagaactaggatgacaattgtgagagtcgaacccagagttaagcctttgtctatgtggggtcaccctggttgcatcgggcttcctacacctgctcagcctaaaaagaaacctgcctttaaataacttcatccacatggagaaatcccacatgtcgtagtcagactttctagctccccctccccttccctcccctcccctaacctcccctcccctgacctcccttcccctcccctctccttcccctctccttccccttccccttccctttccctttcccttcccttcctttccctttccattttacccaagagattttaaattaatggtggaaggggctatcataaatggtgtctatgactgaacaaccaaagatgtcctggcatttgaagaaaacttaaagaatatgtagtgaaaagagatgctagataataaaagataaagtctaaccgagaatgaataatattgcacgtataaagcaagaacctgatgcagtgtattagtcaaggttctctagaaggagaggactaacaggatagatgtatatatgaaagggagtttattaaggagtattgactcacatgatcaccaggtgaaatcgcacagtaggccatctgcaagctgaggaacaaggaagccagtccgcatctccaaacctcaaaagtagggaagccaacaatacaacatttagtctgtggccaaaggcccaagagcccctcgcaagccactggtgtaagtccaaaaaactccaaatgctgaagaacttgaagtctgatgttcaagggcgggaagcacccagcagtaggagaaagatgaaggccagaagactcagccagtcttgtccttccacattcctctgcctgcttttatgctagccacgctggcagctgattagatggtgcccacccagattaagggtgggtctgcctctcccagtccactgactcaaatgttaatctcctttggcaacaccctcacagacatacgcaggaacaatgctttgcatccttcagtccaatcaagttgacgttcaatattaaccatgacattcaggaacagagaaaaaaagctcatggagtttaaaaactgcctaaattaaaataaaatttaatttaaaagtatgtcaaaatgaaacaaattcttaaagtattagagataaagtagagattaagtcatagaaaatcaatagaggtcttggatttgataaatagaagtttcagaaaaagagaatggagaagagaggggagaaaataaagaaatatcagaaatgtaatgttaccttccctagattgtacttcatgtgagatctggatgcacgcttattttattcatgaatgaatgcatgttgcatactatattaactgtttcaggtgttgaatttgtaagttggaaactacgttctttggtgaaggacaccaaattttctttaataatcacttaagataaccaaaatgtttctagacatcttaaatgtgattatattttcaatatctgggaaagtaaattctaaatacttagttttctaacacatctgaaaggattaaggtgaatctatccattttagtaatcaaagttacaccttttcttctatacgtttttatgtagcagatataatatatatgactatgaatactactgtattctgtattaatattaatactaacacatacacacatacacacacatgtacacatacacactctggttttgggcttcagaagcagaaactatcttacaggatatctcaaagatagatactaagagttctataatcgtgtctatgagttcctaagacccttagagctgcacatttcagtagatctagattttagaaaaatatactctaattacttatttccctattcttgtttggtgttccacactcaaatggtctcctagctggttaactgataacagctgcagtttttggaaaggagaaagagggaaaggatacatgaaaagcatctgccttttcacaaacctctgttaacagctttttctccctattagagagaaaacatttccttggtccttctcttttgccttatgtaattgcaaatctctggcaagatgcatctcttttcagactttaacttgtctcatttttcccccacacaattgtgctctttcttttcttgttccttggaaactcgccctcgtttcataattttgcttcttccccctttgctgttctgttctctacagagttacgggttcattctctcgggtgtcttattctgcctcatgccctatctacatgttaacctcatctgttccagagacagaaaatggatctagatctctccagatttccttttgtctcttaacttttctttgcatgggatcttagacagatgcatgacacttgttaaagtatctttctcaatttacatttcatttacctttctgctttaaaaacatagaatctttgagctagcagttgccattatctgtaagtttgtagttgatgtctaaggaaattactatgccattattcctaatttttcttcaaagacatttccccttaccttgattcttataaagaaatgttggctatacccttataaatttgggtagacattaatgaaataaggatttggagcaacaggcatatgccaaaaaagagagcttatcatagaagggtaaatctgaaattgtgtgtaggtagtgaagataagactaatggaagagaactgtgaaaattcccattttaagatcttaggtctcatgaggactcaaacgcatgagaatgatataatggactttggggactcgggaaagggtgggagggcatgagggataaaaggctacacacggggtacagtgcacacggctcaggtgagaggtgcatcacaatctcagaagtcaccactgaggaacttatccatgtaaccaaaacccaccaaaattaaattaaatttcccaaaaactattgaaattttaaaaataaataaatataaaaacaaacaaaaagaaataaaaaagaaaaagaagtgaatcttggttttaaaaaaaagatctggccgggcacagtggctcatgcctgtaatcccagcactttgggaagccgaggcgggcggatcatgaggtcaggagattgagaccatcctggctatcacagtgaaaacccgtctctactaaaaataaaaaaattagccgggcgtggtggcgggtgcctgtagtcccagctactcaggaggctgaggcaggagaatagtgtgaacccggggggaggagcttacagtgagccgagattgtgccactgcactccagcctgggcgacaaagcaagactccctctcaaaaaaaagaaaaaagaaaaaaaaaagaaaaaagatcttagctcttgttgagcagctgcttataggagagcctgggctgagaatatacctgaaaagtaaaggaaaactgtaaataaataaaagatgatattagaagttgggttatatgtagtggttataatgacaatattttaaaacattatgatgaaagtatataatgatttttacaaataaaatataaatattttacttcccaaattgaatacaatttactaaattgtgggacataactactaatttgtttctaattggaaaatgtttggaaactaaataataatggaaataatttgtagtgaagtgatgttgtatggattatactaatttagtgatgttgcaggtggaaaggtaattcaagctaccaaggttcacacttccttttgggaagtactaaataagtattgatgatgcaagatgtattggaacaaacgacaaagtataaatatcatttttctttgtcccgtgactctcaatggggcattaacagcaggggctaaaaaggagaggctatttctcaacagtcactctctatgtacgtagccaacaacttccgtccaccattagcttgaataaactagaatattaatgtcattagtcatcatgtatttgtgataagaaaaattgctaattagtgactctccttaacagtccgtattatcagaaagaaaacatgactctaaaaggacgggtgatgaataaagaatacatgcaaatattctctggttttcctagaactgggagacggccaccccatgtgactcaatggctttggagcatgaagatgaaggtttagattcctccctttttgataacttctaatgtcactatgcagtctcatgggaacccaggaactcattctcaggtttgcaaatgaagcctctgtctgtaactataaaaatgaagcatcagaatagaactgagagcccaagtctgttacagaatctggtgaggttcacaccagagcaatcgaagtgcccacacatacgttgacatgcaagtcataggttgatgcaattttcatacctacattattgttgcctgatatgggtggtgagttgctacaagacagaacagaggctcaccttccccccagaattaaggagtcacaaggatatcagcctcactgcctggaagatacaaaaatgattcagcttcaggacattgaattgagtgtttaaaaactgcatggtacatctacagtcccagaccggctgagaagcaggattcacttttccaggaatcaaacactcagggtattaaagcagtagctggtttgcatcaggactctgtcccgagggccctctgcagcccaggagctgcccaagtcagggtttgcctttggtctcacttggttcagtgacctttctttcctttggtccatttgccagtacagggccagcatctctgctttgaagggggttgaatggcctcaagagcctgcctcaaccttggtcaacagttcatttctgctcaagcgccaaactgcaaaggtcaattgcttaccaatctgacccacagaccaactcagagacagaaatagctcttcctagttccaggaagggtcaatattcactaaagcacagtgcatatggacccttggtgtttattttttcctaaaacatagccacaggagttcacacaataggtctctgttccatgcttacagtgcccatatttctttagctatttttcatgtgtaatcccaaagatgcttgcaaggaaatcacagaataagatttgaggaaaaaaaaaatcagtaagtccacgtgttaaatttataattcagctcagttaaaaaggaatccgatcacaaattgtaaccatgattcagagcacagaaaattgttttggaatttggattactcaatgtgaattcatcctgctccctctcattttaataaacccatttcaattcttaaattattagtaggacaaaaattaaaagaaagaaatgttgtggaaagtatgtggaaaataagatgttaaaactattttttaaatatgctttgctgcaggcaaaacccagtgttctcatcagcttagtgtattaaaacctcatcaaattccaaattccctattccaataaaataatgtaagaattacttaacttcgttaactggtccagatagccaccagaatttagagttgcacttctatggatactgctactgttgaaactgtttcttagtttatcttttcagatgattatgacagccttccttcaaaaagtagttcattaagagaggagattagaaaatataaaggagttgggaaaatcgtgtcaataattggatctccacagctactgtaagccccttgcctgtctctattactctctgaggctactcgagaatgtagaattacatacaatatttcccatatttcttgtctagaggggggatgtagtctacaagctacaactgaattgctgggtctctatagcctaggagaggtgggagtggtgaagggctggctttggaatgcggtgttgtggagatcacagctcacctagccagctctctcactgtgccctgagctgggtaagtcagtcttactgcctcctaagtgccctcagcaacttgaatggaatcgttaccttcccatatacaagaggactgaccagctctctcagattctcatgccctgaggaaagcttatgaacctccagagtcctccctcagctggagggcccttttaacctcagcctatgcagagacagatttattctttccggtttacctcttactagaccactagtgtctgaaggaaaccactagccagacctccagcattgagggtgtcaaacccaaatgatttcaagagtcaggtcattaaaacacatgcgagagaatctgcacactgttctatcataagactggtagaagttttgatctgttggagaggaaatctcctatataaagccatataatttttttaaagtatattttgaccaaacaatccaagtatttgggccaaatttaggtctaggtgttagtttataactcctgaattctattataaactgacattactaagaataaggatacagcaaattaggattatactttcaagagtaatgagcagcttgaaagaggaagatctggttgaaaaatcagattaaatgaaagaaacaggagatactatgatgggggaattcagacatataaatatagaaatttataacataggattttatctcaatgaagtttaaggcagctcccaatggaaaggccacggtatgaatttaagatataagtgttagaagttagaaaatattaatattgtcttttgatgaagagatacttccattttgacaacttcagtttattaattttctattctatggttagtttttgttgtgttttttttcctaagaaatcttcacctgtcccaaggttgtggagtgtgtttgcatgtagaagttttatggttctacatttatggttaaatttatgatctcaaattagtgtttagaaatggagttaagtagtagcagttgaggctttttcccattgaacatcctgttgccttaatatttgttaaaaatatttttcttagcctggcatggtggctcacacctgtaatcccctcactttgggaggccgaggcaggaggatcacttgaggtcaggagttcgagaccagcctggccaacatggtgaaaccccatctccactaaaaatataaaaattagctgggcatggtggcacacacctgtaatccctgctactcgggaggctgaggcaggataattgcttgaacctgggaagcggaggttgcattgagccgaggtcgtaccattgcactctgcactccgcactccagcctgggcgacagagtgagactccatctcaaaaaaaaaaaaaaattcttttgctcatttaactgacttggcttcttgatttaaaaaatatcaatggacagtatatgtgtgggtctctttatggctgtgtgttctcttctctttatttagttatctatactaatcccagtgccacagtgctttgactactgtagctttatcataagtcttgaaataatgtagcaggggtcttccaccattgccttctttttcaataatgttttggtcagtctaggtctttggcattccatattcattttagaatgagtttgtcagtttcttcaaaaaacaaagcaccattcactttatcccatcatcaatatagtcttataattgcaggagtaggtgctggagctgggacttagcttttaggtagcagccccaacaaaagagcatgtcaggggttttcgtggagaaagaaaatgtctaaatggaagggtgagacaaaattagaggcaccacaagacgtgatatgagaggagacatgaacagattcctgaaaattggctttaccactcaccaagccctcactggagtttcagtgactttataaaagagccactggtactccagacaccgaaggaacaaaacacaaacaaaagaacaaagaaatacaatgataatagtacttgttcccttctccaggataagataacgtaaaatgtcagttcaaacacaacttgcaggagaactacacattgtgaaaatcagacactaaaagggtgagtgcagagatgcctgtggtcactctttgactgctgtggagaaataaacagcttcaaaggaaagagccgcttggccggtgatacttgacttacgtatcattctattgccagaggtgaccacctagctgattaataacctcttttgctctcgaggaaatccttacgtatcctgaagctatctttaacttgttgtagattttacagcatttggcactgaactctattatagtctcagaagtggaggcaattggtaaataacttttgcacagctgtggtatatagtcccacacacctccacctaggatggtagttactattttaattgacagagtccataggtttctagggctgtttgaaggtggtgagaggatcttttgataatttaaactagatcaccttgaaagaagtataggtaactggttttgaaaatgtgtcaggtgcagtgttgtacattagacctactgagaaattattacaaaaataaaaatataaagccaggcgtggtggctcatgcctgtaatcccagcactttgggtggccgaggcgggcatatcatgaggtcaggagatcaagaccatcctggctaacacagtgaaatcccgtctctactaaaatacaaaaaaaactagccaggggtggtggcagacacctgtagtcccagttactcagaaggctgaggcaggagaatggtgtgaacccaggaggtggagcttgccgtgagctgagatggcgccactgcactccagcctgggcaacagagcgagactcattctcaaaaataaataaataaataaaaatataagaaaagatgaaaactcgaatgaaggcagtgacagtggaaataaataaaagacagatatttagagatattaaagtggtggccgggcatggtggctcacgcctgtaatctcagcacttttgaggccaaagcaggcagatcacctgaggtcaggagttcaagactagcctggccaacatgatgaaacgccgtctctactaaaaatacaaaaattagctgggtgtggtggcacgtgcctgtagacccagctactcgggaggctgaggcaggagaattgcttgaacccaggaggtggaggttgcagtgagcggatatagcgccaatgcactccagcctgggagacagagcgagactccatctcaaaaaaaaaaaaaaaaaagatattaaagtggtaaagtcgacaccacttgatgattaaaagaatgtggggtgagggaaggagacagggacaaatttcttaataagaaatatcatgtactgaataattaccatgcaccaggaacattgctttacatatactttgtatgtaattgtaaaaatcctagaagtaggtaatattaccaacccagtttaatgaaaaagaaaatagaagagtaccgaaattaagtaacaattctaaaaacacattgtatgcaagagaatttgtaatcagacgagctaactccccagctcttgcctttgtctactaggctacataaaccatagatttctggccattggtgggtcaggatggtggtaccaatagcaaacataggatgagaagggtttggggagaaagataatggcttcaagtgatgaagaaattgaaatttgaaattgaggtgtatagggtctccacgtggagatatctagtagctcagaagagataacttagctgaagttataaatgttggattcatatgcttataggaaagagttaatgctatgaaaactgatgaggtattacaggaagatccagctagtgaaagaagaagtttaatgctgtgaattggtaacaccagcatttaaaggacagaggaagaagactagatactttgtttcctcataaatcataaatgtaccactccatgaactttcacaaagtgaatatgcccaaataacagcatctagatcaagaaagaggccattatcagcaccctacttgccccatttcaagtaatacacatccccaagggtaaccactgcactaatttctaacaatatagatcagtttgcctgattttgaacgtgacataaatggaattccacagtaaatgctcttttgtgtccagcttctttgactcagcattgttttaatttatccatgttaattcccattgcaataaagaattctagtctgtggcagacacaccctgaaggcccacaatgagccatggccccttccctcaagtgaggaaagacctgtgacctgtctctaaccaacaggatatgtcaaagaagataaagtgtcattcccatcctgctggccttgaagaagccaccagctctgctgtaaattccccaaggagaaggccatgtggcagggaactgcaggctgccagtaagaagccagagccctcagtcacacagccacaaggaagggaattttgccaacagcctgaatgcacttagatgcagattcttccctaatagagccctcagatgacagcacagcctggccagcacctgagcagaggaaccagttaagttgtgctaagactccagacccatggaaactatggataataactgtgtgttgttttactattcacaatagcaaagacatggaatcaacccaaatgcccatgaatgagagactggataaagaaaatgtggtacatttacaccacagaatactatgcagccataaaagaaatgagatcatgtcctttgtagggccatggatggagcttgaagccattgtccttagcaaactaacgcaggaacagaaaactaaacactgcatgttctcacttacaagtgggagctgaacaacgagaacacatggacataggagtgcggaacaacacacactggggcctatcagggggtgcagtgggaggagggaaactattaggaaaaatagctaatgtatgcagggcttaatacttaggtgatgggttgataggtgcagcaaaccaccatggcacacgttcacctatgtaacaaacctgcacatcctacacatgtgccccagaacttaaaataaaaataaaaaataaataaatgtgacttagtttgaggtaatttgttatacagcaacagaaatcaaatatatactgtataaatacactataattaatttaatttaccaattattaataaatatttcagtagctttccatttttgtctattaactggtgatgctataaatattcttgtgtgtgtatgtgtgtgtgtgtgtatatatatatatatatatatatatatttgtgggggtgttgtgtcagtcaaggtccactcagaaaacagaaacaacaaaataatttgaacagggaggtttcatgcaaaaaaaaaattattgactatttgtaggggattaactactaaaaaggggataaaagagagctgtacaaagtccctaatgcaaagggagacaaaaacttggaagagggcccctctctaaggatgggattcagatctcaatggagaagatgaagttaaaacccagtggaggctgaagttagccgagttgccccaggcctgagctgctccattacagcaggtggaggccaaggactgggactgggaagctggaaagctcccactggggtgctggtgggcagaaaaccccctgctgcagtgcctatgacatttatgaagaatttggagggaggtgaaattctctaggaagtaggcttgggtcactgtaggacttactgggaaatcacccacaggagatgctgggaagtacccatggggacgtcattgaaaccagctggtggtgagttccactgggtgtcccacagcctagccttgcactgtaggaacaaaaacaacaacaaaaaaagcaggcactttacgggaagaatcttcttcctgcagcatcccttccagaccctctaacggcaaaggaagaatatttagtaactccagctccagtatcctcagcagggcaatgaacactggttttgtggctgagagacaataaactgacaactggtacaggtgtacacccataagagactcgtaatctttttatcctcttttaaattagtgtgaaagtatgaaataaaaattatttaaaaattttatggccaggcgtggtggctcacacctgtaatctcagcactttggaaggcggaggcgggaggatcacgacgtcaagagatccagaccatcctggctaacatgatgaaaccccgtctctactaaaaatacaaaaattagccgggcgtggaggcgcatgcctgcagtcccagctactcaggaggctgaggcaggagaatcgcttgaacctgggaagcaaaggttgcagcaagctgagatcgcaccactgcactccagcctggcaacagagtgactccgtctcaaaaaaaataaaaaattacatcataatgtcttatctttacctatgttagacaaaataaagacaacagcagaaatcaataaagtagaaaataaggaaattatagaaaagatctaccaacctcttttagctctttgaaaatattaatgaagttgaaaaaagaactttggcaaaattaatccagaaaagtacaaagaaggtgcaaaggtatacaccaaaatattaagcatgagaatgaggaactaattgcacatggagaagagattaaaatgtaataataaactaaggagatcatcttttatgccaaaaaatttgaaattataggcacaatgaaaaatatatctgagtaagaatagaaagagtaaattactttacaattattaaggaaactttataagttgtttagcattgctgtggactgaatgtgtcctcttaaatgtcatatgttggagcccattgtgacagtatttggaaatggggcttctgggaagtaatgagggttagatcaagtcatgagggtggggtcctcatgatgggctgggcccccataagaaatgacaccagagaacttgagctctctctcttcctgccacgtgaagacacattaaaaagactgccttctagaagacagggaggagcccctaccagaaaccaaccatgctggcttcaggatctgggacttctagactccagaatagcaagaaaataaatttctattgtttaagccacactgtctatggtgtttcgttctggcagcctgagctgactaagacaaacataatttcacaaatgagaccccagatgcagtgtcttgtatatttatttatttttatttatttatctatttttttgagacgcagtttcacccttgttgcccaggctggagtgcaatggcgcgatcttggctcactgcaacctccgcctcccagcttcaagcgattctcctgcctcagcctcctgagtagctgggattacaggtgcttgccaccatgcccggctaacttttttgacatttctagtagagacggggtttcaccatgttggccaggctggtctcaaactcctgacctcaggtcatctacccgccttggcctcccaaagtactgagattacaggtgttagccaccgcgcccggcctcttgtatatttatatctgaccaaacatttaagggacagattagctcaatctcaggtacgtttccagggaattgaagaaggattcctatctaactcgttctatgaagtcagcataacgtttgatgctaaaactagattaaaaaacgcatgagaaaggagtgctacaggccagtcttactcataaacatagatgcaaaatcccaaataaaatattttaaaaattacttttaattttttttgacaaattgtaattgtatagaattatgggatacacagtgatatcatgacatatgtatgttgtgcaatgattgaatcaaatgaattaacctacccatcttcttaaatatttatttcttcctcctgtttaactgtgactttctatcctttgactgacattgccccattccaccacccttatcctctggtaatcacccttctactctctgcttctatgaattcaattgttttagattccacatataagtgagaacatgtggtttttgtctttctcagactcacttactttacccagtttaatgttctccaggtccatccatgctcctgcagatgaaaaaattttcttcctttttgtggctgaataatattccattgcatatataatatggtttggctgtgttcctacccaaatctcatcttgaattgtagctcccacaattcccatgtcatgggagggaccaagtgggaggtaactgaatcagggggcgggtcttaccccatactgttctcttggtagtgaataagtctcacaagatctgatggttttataagtggtttccctttctgcttggctttcactctcgctttgcctgctgccatgtaaggcgtaactttgcttctcctttgccttccgtcatgactatggaattccccagccatatggaactgtgagtcaattaaaactctttcctttataaatcacccagtctcaggcatgtctttatcagcagcgtgaacatggactaatacagtatatataccacattttctttatcctttcatctgctcatggacacttcagttgattccataacttggctattgtgaatagcgctgcaatgaatgtgggcgtgcagatatctcttcaatgtagtttctggattatatggtaattctattgttagttttttgaagaacctccatgctgttttctacaatggctatgtttacattctcaccaacagtgtgtgtaatctttgtctttttaataagacatttaatcaccatttcgatgggtatgagatgatatttcactgtggttttaatctgcatttccctaatgattagtgatattgaacattttttcttgcttggtagaaatgcgtggttgaggtttgcctcttcatctgggaagagctttagggtgagctttgagggtgcactgagccattgtttgaaagcctggatggtacaagtctagtgcctgagctttgctaaaaggggccttgaggctgaggatggagcctagccatctaggaactcaagccaggccagcctctgtggctcacatctacaatcccagcactttaagaggcccaggtggcagagttgtttgaggccaggagtttgacaccagcctgggcaatatggtgagacctcatctctacaaaaaataaataaccgagcatgatggcatgtccctgtggtctcagctacttgggacgctgaggcaggaggatatcttgagcccagaagttccaggctacaatgagctatgatcatgccactgcactccagcttgggtaacagagggagacactgtctctaataaataaacaaacaaacaaagactcaagcctagttaatgtgctctgggagcaatcagcctggctctgcttgtgggctgtgctgttggcacctctaatccgcacctctgctggcagtaatatggagctaccaccaagatctgggtgcaggtcactgtgggcagtgcctccttgctttgtttctatctgaccctgggcagtctggtcatgtctttctcccctgtgttccctgtgttccccatgagacaagatcaaagtgggccttggcttggcgggaggctaggggacctggatgtgaggttttggttctcttttcccgctgttggtcctctgtgtgtggtgctgcatcgacttggaggatgtggagaggcaatacctgtctaatgctgttcttattcagttccatggtccattcaggagtctcaagcttattctcaagttttgagattttcaccaaggtgttcttatcagtggatagttgtagttgagctttctatgcgggggagagcagcctgggacctcctattctaccatcttcccctgaatatcccaaacaaagtacttgcaaaccaaattcacctgtgtttctaagataacacgaattgattaagttgggttcccaggaattcaaaagtattctaatgttagcaaacctaaaaatgctattcatattagcagattaaagcacataaaactatatgacaataggtgcacatatttcagtacccattcatggtaaaaaaaaaattaacaaagtagaaatatataacttggtaaaggtttataccaaaaaattacagcaaacataattttgaatgggaaaacattagaagtatctctttaaaaattaagactacgtcagagatacagttgttttttctattcaactttgtactataggccctagtcagagaagacaataaaagtaaactcttgtatataatcaccagcagatatgtacatgaatattcctagcaacactatttgtaatatcttcaaactggaaacagcaaataatgagaaatatgagatttagatattctttactgccctaggacccttgtataatttaatctgtatgtaacttttctggttatgtatagatcatggtatctttttcttgtttgagagggagagatttttttcttttatgcatacaccacattgcttataatttaaatcaacatattaagtatttaaaaataattagcaaatcaatagcagtaataattacttatagaagagttaatattttcatattttatgtaacattatatatatatttacagtgtatgtttgtgaaattatcatgtaacatttgaagccaatcttatttttgaagaattgtatttaatattttctgttctagtaaccagtttcacattattctaatttatccttctgtgaatttttgagtgtaatatagatattttaaatgaaattaaatataaacatatgtgaatatctttggacctttatagatgtatgggtttaaaattactcacatagaaaaacataatgatgcccaaagggaacataaatattgcagatcataagtaattacactctcaaatgctcatggaattgttaatcctattcatgactagcaattcactcactaaaatttccaattcattgtttacactagtgaactattacagtgttgccaacctgacaacttaacattgtcaaaaacttagctgattttagttgacttgtatgtaggaaggcttaatgcaatttatgtgcaatgaagatatggtacaaagcctaagaagatatgaaaaataacctgctcttggaatgattcaccttattttcagtggacagctgaaacccaactgagaccacaatttaaattgggaaataatttgttgttagtttctactcccggagccaacagcctacctagagccaccctactgggcattcatcagttatatttcttggtcgacaagcagagtgtagtagagttcattttgaatttaatttcaaaccccatggtcttaaccattttcccattcctttctgtggcctcttagttcatccctgagagttagagacttatgtttttatgagtggtgatgaatgcttagaaaaaaatctggggacatttagtagaatccttcaggcccagcactgactgagttgacagaagcctcttgttttttaattgctctgggactagggttttgaattgttggccacagcaaaaactttggttctacctctgaaatctgattccagaaaggaggagagagaagaaagaagaaatgttacaccaaaatgtaaactctatgacagcagaattttttttcttttcttttcttttttttttttttttgagacagagtcttgctctgtcgcccaggctgaagtacagtggcataaactcggctcactgcaacctctacctcccaggttcaagcaattctcctgcctcagcctcccgagtagctggaattacagatgcccaccaccacacctggctaatttttgtatttttagcagagatgggatttcaccatgttggccaggctgatctcgaactcctgacctcctgatccacacaccttggcccatggtgtttcaagcctgtaatcctagcactttgagagcagaatttttaaaaatctcctttgttcactaatatatcctgagggcctaaaatagtgttaacacaaagttgttctgtaaatatttgcagaaggaatgacagaagaaagaaaaggaagaaagaggagagagatacctgggtgaccaggcgttcctgtgacaggccaccatctgcctggctctcctgcgactctgtctggttgctcgcctccagtgcttcaattctctgtccaaacttcctgacttctaaagctgcagctttctaaggccacttgtctcgcccttggaggatgtggcttcctgcttttaaaaggcactttttaagcacccagttacctactgagggtgagacaagcatcgggtttgccccacttaacaagctattttgaatatatggaatatattcagccttaaaaaaaggagattggaaattgtggcacatgctacaacatgaatgaaccttaaggaggttatgtgaaatacaccatagtcaaactcattgaaacagaaagtagaatgatgtttgctaggggcttggaggagaaaaaagtggaaagttgttgtttaatgagtaatagaggttcagttttgtgagatgaatagttctagagactggttgcacgacaatgcgaaggtatttaatatattactgaacggtacaacaaaaaacatatcaaacttctcattgggtctgtcggagaaagtcacattaaaaacagcaagctgaagtcaagccagaaaaggtcataggttttcagaaagcttatcacaagcaaaactttgctataaaagtgaaaatcagataatctcatctcaaatatttcaattacaaaggattaaattattgagctccctgttttttcctttcttgaaataggaaatgttctaagaaataaaacccttaaaacataacaatgatcctggctgagttgtggcaatttcaccaggatttctgtgaaggacttgaattaacttattacttcccattgcatgtcaaagttcaggtttatgaggttagtctagctaccattctagcaaactttagaggagaacagcaaacaaaatggctagctatcgattgtacataaatttacaagatgaaaggattttggtatattttgggtaatttccaaaagctgtgacattgaagtcgactcctcactcacacaagttatttgaggctgacaattgtgttctttgagtatgcagaattgaaaacaattagatccctctgatttctgtaagacacttttgaaatttaagcatgagtcatgacttgccttgtagctaacctaatgacccgactttaattaatggactgctgctctaacagaagcacgctaccatggtgtattttgtctatttttattggccaaattagccttattttgttagctgtcctcccttttatccatccacccatccattcatttgctagtctatttatttatttattcaccaaaaatttagcaaaactttatagaacatctatctgctgtatacttaggagggactaagctatgaaaacgaatatgagtaaaacacccatgaagacattctaccctcaaggatggatgtcacattgtatttaggaacttgaaagactggtctctagttctattctttttctctccatttccaatctattttgaacagccttctttttcctttcatgccattggtctcagttcccttactttatttaacgtaggtcattttggtcttgcataactcaatatcttttcattgaaactattttcattggtgttccacaccaacttatttaagtatactagcaattaactaaacttcagtggttctgtacaccttttcctcctaaaatgtgcctcattttggaaaaagattctgatttccctttgggaggattgtctttgttccacagaatacagtctatttagtgtcctagtaagtacagtctgcaaatcaaggcacttagctcttcagtagccaaagaatgagcacacgactgaagctagactaaggagttgatctttctggaatttaagtcatgaacagggtgaaaacagaacaaaaattcacacaggcggcaggtctaaggggatatctattggcatccagagctatgctgattcctgccttattctgctttctccttgaatctgtgagctacactccatcacactaatggttttctttcctattggatcacatgagtggctgtctgaagttttcatccagaaaaccctgattgattgatgtttccctatctgtgaaatctccagatctccagggattatttgcagagttgtgtctccaacattttcatggagaccataagaaatatctcatgaggactcaccagtctgtgctctcaactataagtggtgcctctgggcatgatggtcccaccaaagtgtagccaccacctgctgaatttgacctccgctgatcacccaaaccctttgtgtaccaaaggtggctctgacttcctgatcttcatattctgaagccaggccatgttctttgccaacatgacataaatctctttaccagttgtattagtctgttttcacactgctgataaagacatacctgacactgggtaatttataaaggaaacaggtttaatggactcacaattccacatgactggggaggcctcacagtcatggaggaagatgaaggaagggtaaagggacgtcttacgtggctgctggcaaagacagaatttgcacagggaaactccccttatgaaaccaacagatcttgtgagacttattcactatcatgagaccagcatgggaaagactcacccccatgattcaattacctcctaccaggtacctcccatgacatgtgggaattgtgggagctacaattcaggatgagatttgggtggggacacagccaaactgtatcaccagtagtactgttctgctacatgggcttatgacttgtgctcccttgattcccagtgtcttagagatacttaaatagaatcacactttgtatttttacttaaattttttgtctagaggactgagaaaatattcatgggagctggaccttgaaaaagcaagaattaggcaaaaatttatttccctgactgaaccctggttatggtgattaaaactgctctttgtgagctaaacatgtttcctttgattctactgagaggttttgaaatgactgcagaagccaacacctgctcacctaaataatgcatttgtgtctcattgaagatttgcctcaatgtctaaaatatttagctgtttaaaaggtcaggtgggaagcttgtatgaatagtatgactatatttggaatttttccacctgtgatattgagtaatgctctttcctgctattgtatttttttatttttaatttttttatttcaataggttttgggggtaacaggtagtgtttggttacatgaataaattctttagtggtgatttctgaaattttggtggacccaccacccaagcagtgttcactctacccaatgtgtagtcttttatcccttgctactcccaccctttcccccatgtccccaaagttcaatgtatcattcttatgactttgtgtctcatagcttagctcccacatatgaatgagaatgtatgatgtttggttttccattcccgagttacttcacttagaataataatctccaattccattaagattgctgcaaatgccattatttcattcctttttatggctgagtagtattcagttatatatatgtatatacgtgtgtgtgtgtatatatatacatataaaacatttctttatcgattcattgattggataaagaaatttactttcttctataaatataaatgtttatttatttatttatttatttatttttttagacagagtttcactcttgtcacctgggctggagtgcaatggcacgatcttggctcactgcaatttctgccatctggattcaagcgattctccccccttagcctcccaaagtagctggaattacaggtggctgccaccatgcccaggtaatcgttttgtatttttagttgaaatgggttttctccatgttggccaagctggtcttgaactcctgacctcaggtgatccacctgcctcggcctcccaaaatgctggaattacatgtttaagccactgcgcctggcctataaatgtttatttatggcagaagatgattgactttattccataaatataaattccttaatataaatgttatatatgtataacattttctttatccactcactgattgatgaacatttgggctgatacccatatttttgcaattgcaaattgtgctgccataaacatgtgtatgcaaatatcattttcatataatgacttttttcctctgggtagatagccagtattgggattcctggatcaaatggtagatctacttttagttctttaaggaatcgtcacactgttttccacagtggtactatgtttacattcccaccagcagtgtaaaagtattcctttttcactgcatccatgccaatatctattattttttgttcttttgattatggccattcttgcaggagtgaggtagtatcgcattgtggttttgatttgtatttccctgataattagtgatgttgagcatttttctacacgcttagtctagtcacatccttagctcactttttgatgggactgtttgtttttttcttgctgatttgtttgagtcctttgtagattctggatatcagtcctttgtcgaatgtacagattgtgaagattttttctcactctgtgggttgtctgttaactctgcgattattattattattattattatatgctgtgcaaaagctttttattttaattaagtctcatctatttatctgtgtttttattgcatttgcttttgggttcttgatcataaagtctttgcctaagccaatgtctagaagggtttttccaatgttatctgttagaatctttatggtttcaggttttacatttaagtctttgatccatcttgagttgattttttaataaagtgagaggtgaggatctagtttcattcttctacatgtggcttgccaattatctcagcaccatttgttgaatagggtgtcctttctccacttgatgcttttatttgctatgtcaacagtcagttggctgtaagtatttgggtttatttccaggttctttattctgttccattggtctatgtgcctatttttataccactaccatgctgttttggtgacaatgaccttatagtatagtttgaagtcaggtaatgtgatgcctccagatttgttctttttgtttagtcttgctttgggtatccaggctcttttttagttccatatgaattttataatttttttttctagttctgtgaagaatgatggcggtattttgatgggaattgcattgaatttgtagattgcttttggcagtatggttattttcacaatattgattttgccatccatgagcatgggatgtccttctattgtacaggtgtggcaatttctgagtcctctggaacgtcagcactctctactcaaatggcctcacgtatctgtattatcatccacttctacttactttctttaaaaatatagttatcacttctgattactttggtatcctttattcaccacaagaaaaaaaatcaaatctatggctgctgtattaagcgtacacatgatacaatgtctttagatttttttaaatgtaacatctcatattttttctgtctcacagtttgcctaatggagagtatttgatagtttactgtgtcatcttttcaaatgttttgcctgcgcatgtaatgtttgatccttattaatatagaattctcattattcatagatattttcccattgattttattaacttcttttagttttactcaatttctgctgttctctaatcagtatttattataagcttagaagaagtattgtattacagacactttgtctattccactaatcactgagtgtttatgtctcaaccaaaagttcaacgttgtgacttaaacagtagaaaaaccaaatgtgttacccaattcttatctttcgatgccaagaaatacagctgaacagataaaatgataatctataaaattattgatatgcataacaaaatgcagcagattaaacactgtgggcatgggctgttagtgtagaggagctatgagctggggaaacaatgaagattaaagtagctcaaagttggcattggggaatctgtagagatgctattggggcccacccagatcaccttcaccagtccagctatatagcccccaggtgctgtgagtgtctctgcttccctcacagtggcatgctttacctgagaatcgccctcagctcaataggtgctgctttttttttttttttttttttctccttgagatagagtctcactctgtctcacaggctggagtgcagtggtgtgatctcagctcactgcaacctctgcctcctgggttctagcaattctcctgcctcagcctcccgaggtagctgggattacaagcataaaccaccatacctgactaatttttgtatttttagtagagatggggttttgccatgttggccaggctgttctcgaactcctgacctcaggtgtttttttatttgaactgcctcagcctcccgaagtgttgagattacaggagtgagccacagcactcttctaacgggaccttacttcttacttcgagaggacagaggttaataactgactgatccaggaggagaaaaggccagctcctttgtctcaaaacggaacaatttctagggtatatactttccgcttctgagcccctcagggctcagataaactaagacacatttccagccaaggccactttcttgcttgccttccttcctgtcctgcatcctttcctgtcctgcatcctttcctgtcctgcatcctttcctgtcctgcatgccctttcttctgcaaatcctcctcaaaatggcaggcccaggcagactaatctacaatttacagcaaagtgtgagtgtccaagggcctccttagctgcactgacagatattcatctcctgcagccaaggggcaaacagagctgaagatcaggcacaaacttcattagaaaaatggcagttttctaagaattaattctgaacctagacaattcctccaagtcaaagtcaaggccctgatagggaagaagggctatttgataggatgattttactctggagaacctggtctcccttgacttccctgaatcctcctgactttcagaagtggctccaactcccttgatgtaagggagatgacccctttcttgaatgctatgcagagacctcaaatgaggcatttcacaaggcaatcaatgattgtcctcttcaggatctgccttacttctcctcatggccaccataactaacagtaaggttaaatatcagcatgaccaaccctattgggaagtgctgggcctgtgagagctgctatcaaggtatattaccatatatttattgtctcattaatttttctgtgaggaatatgcaaaaggtacttgtgattgaaaaaagtctaggtgaacttcacggagatggggcatttcccagtatgatttcctcagaataatggtccagtgaaatagcccatcaaagaaggctcagaaaaatttgtagggaataaaccttggtttatcccagtgtttcttaaacctagtttaattatgaaaaaactcttacttttcacctttttttgttttcaacctgttagtgttctgaataaccaatatttaaaggattccacatcaggaaattctgataaagaaaaaaacacaagtcttttaagtaatgagaataaaattttagggcaatttctgcctttcactatcatacaatatgggtttcacttttctggctccaaatttctttctgtatttttatctatttatctttgtctgtttatctatcataatctatcttgatatctatctaactttttattttgaaataatgttagatttacagaagagttggaaggataggagagtgttgctgtatagcctacattcaacttctaccagtgttcatattgcacataactgtggtacatttatcaaaactaagaagctagcattgatgtaatactattaattatagactttattaagatttcatctgttttcccactattgacctttttctattccaggatccaatccagaataacacattcatttaggaattccttttatttttgtgagggagttcaacatgacttactctaagtattattccaatatccccaactgcaaataactgaaacttaaatttgagattccaggagtctcaataaatgggaatgagcaggctgcagtagggataaacaatgaagtattcagtaacttccctaccagatgctcgctggcctcactggagacacagttcccaagtccattatctgtgccctcagatgaaatcctcaagagacaggcaatgtgattggctcttagtcaaccacatgagtaactgccttccctataagtcctgacccaattagctgaggccaaagtggagggggtgattccttatatagagaaactgtcttccatgactgtgaatgaagcaaattaatccatgagggaagtgatatatggcagagaaattaatgtctctgccatagattgaatacaagttccattctgttgtaatgttctgttgattctactgtttttccacactcctaaaaaatttcccgtgagaagttaactaatttgcacaataatacttttctattttatagtctctgagtcgaccatgtgaaatcactggatatccgagtggtgaactgaactcctcttgataaaaacaaaacaaaactatacatcataactgtcctaattatataatctagctacatttttattagtaccagaaaaatagaagctattgtctagctctttctgtgttccaaattatttttctttcataattctggaacaatccactaagattccctagcaatccaaacagagaaacacaagtgggtacttcttaaatacttgtcagtgatgataaaactgccacattaaaataccatttgttgtgtattaggtaagaaaatttcttgtagatttgtcagtatgaatgctctagtttgaactgtcatgcagcaatgtgttgaagtcaggcttaaagaatagtcacatactggagaaataatttgagtataaggaattgtttctgtccatgaggcacagtcacagttaaaaacaggattagtatatattggctatctacattgcataaggaataaattctgtgtttataccatttgtgaaggacttttaatgagacatttaacttttcagccacataattaacattccctacatattgttaaattcagatgaaaaggagagcagccatgcatctcataaggtaatgtttgaaactggctgctactaacaatccattcactcataaactaaaagatgtaggaaaattgtatcctcagtgtcttattttggaaaactctaatgtgatctaaagagtttatctttacataagtgtggagggaagaaaaaaggaaaggagggtttgttgctgaaacttttataaccttaatattgggcacgagaattattttgagggatgtaacactctttgtagagataaatgtcttgaatagctttggtaaaaggtgagaactccaaggcataggtaatattaggagttaaggcaaccttagaattggccaaacttgtaggaaatggccaaactgttttgtaaaagaatgatttggggttttgtttcattttgtttttgtttttttgggttttgttttcttttttgatatttagagaaaagaagagggggggaaagagcaatacaaaagagagaaagaaggtatgaacctgggtaccactcagagagcaacaggcagaaagcaaatctgaaagctgggacaattaaagaacttttaagaactggagtgactaacgttgaagttgaagctgtgttgtaatgttgaccactcctctatcctcctctaccaaattatgatcacatctataatatttctaaaggccccgggaatagtttggagggaggagccatagatagcatcattatataagtttcacgtgtgactctatgtgttgcccaaatacagggagagcttctgggatggttaggtgattcataacttgaatgaatttgaccagtgcagaagtctgaagccaaagatgcatgtgcattttacttgttatcgactagcaccctagtgagatttaaagaaatttaggggatctttggaatattaaagaaatacatttcctgggggaaaattcaaggcatctttacatatactctaaaaatcagggagtcatcaactgatacctcattcagtgaatactcaggatggataaatgcgagaaaatagtgcctacctgaaaaaagaacaataaatgcaaatgatttagtcattgtgctggacatgactagttcattctcagtcacttaactatagtaagcacataataaagaaaggtgatattattattctaccattgtatcctttctaatagattccacagcgtttatatctcccacactattctcaacactaacattcttctgctgtaaaatgaagagcattttctttccaatgatactgacttctcaaaggagacattaaattttaaataaatgaaaagcagtgaaaatataattacatattctcctttgattcttaaaaatttattgcttacgaaatatctttccactcgttgcttgagctcctgcatttgactataatgtatattccatgttttactgtcttcttatttggaaaaacttcttgcttattgtgtaatgaattactttctcatctgcatgcaatattgtttcttaagagaagacaggaattaatactcatgaatacctgataaacattaggcattgtattgggttctacaaatggattattttcatttgaataaaattctcctgtgaacgtagcaccgatgtataaactgtataaactgatttcatgggtacatttgtggtagcatatcttatttgaagatgttttttaaagctagcaaataggtcaaaatagaattttaaattactctaaaaaagtccttaactactttttacttacattatatgttgttacttacatttatatatttacatatattatatatttaaacctatatttaaatatggacttatcaatgtataatatataccataacatatagtgcatatgttaatatattctataatattttaatcactaaaaagagagaagtataattgaatttgtgtaagttactcattaacattgcaaatgttgagatattttatttttaaacactgaagattaatttttcttgtaaaagtatcctagaataaacaaatcagaaaggaagatacaagtagcgagtctcataatcaattacaaaaatgcagaaaaagtgcctcaggttaagtgtaagaaacttgaaagacaattacatttgaaagtttgaaatgaataatgaaaaattattccatatcttcttacttcaaattttatcttctcaaaagtcagcttttctgacctacaataatgagatttctgtcatttaaggctcattccaaaaatcctgcttctaatgtgttaggttaaccattttaaattctccattgctgtcccaaatgtcagtgaactaatttggcagtgagtgacttttttcacagatgaatgccatttcctgactccagcttagttagaaatgcagggccattgcatgattctttgttggctcttcctctcatgtttatagtgaaaaataagtgtaggaaaattaataacctcaaaatagaggaatttctgttgtcttaggaaacaagattttgactcatatcatctcttggtctttgaccttaaaaatgcaaaaagttcttgccctattataactattctctattaataaaatttggcacatgccattttctgctgggagaaatatttttcaggatttgtattaggtttaaagatctattgtaaagctaggtggtgagagtagtaagccatcccttcatatccagagttgctaacaggttcactgaacaccacgatgccaaatcacactttcaaaatacttgcatgtgagtggcagactcagaacataggatggtagctggaagtggatgtggagtttaaggattgtttttgagcctttgtcttagttttccatttttttaaaaaaagatggctgttgaacaggagaggaaaaagcaagtacttggtgcagactttcagcctgttccatcagcagttagccttgaaagcaacaaatgtttcagatttccattctgaattagacaacacgctacttctttagaactttctgagaatacccactgcattttgatagcacggtggtcttgttattccttgttataactttcagtttttattgtgagaaagaggctgccctgtggagagccctgaattcttaatccattggccatcccctggcccagagaatctcacctctgagattttctcagtttcgaacctgggtcctgtttgaggttagtgtctgtttgataaaaagggaatccacatgtgatttctaaacccaagctttagcctgctcttacaaagccttgtttcaagtggcgagaatttttttaaaaagttattttcccaaattaagaatgtgtttccttgtctgagaagcgagatgcatgagtcaaagaagctaactttttagatgccaaatgggtctgtattcaaaagaattcccaagataaaaggcatgatttcatttcaggattaaatgattcagaaatgatgacaaatcttgtgtgttattccttcaattttctggaagagtcaaaaagaataagcacctcgatttatcattcactgtgggcttatagggtcttaggagctttccttcctatgtggcattcttcaagcctgacacaaaactaacctgttgtcctacctatgccaccacctaagaccagaggcttcaatctgtgtatctaagtgtcaaaagctggaacaggacacaagcaaactatagtgtgtgtcacttgtttgctggtggacttggcaaatgacattaagaaatgtgattaaaaaaaaactaaaaataatacatggtatttttttccctctttctcaagaatccaaggataggaaatgtgaaataaattaggaaaaatgtgactgttttctcgggaaaaaatgtgactatattagtccattttcacactgctataaagaactacctaagactgagtaatttataaagaaaagaggtttaattgactcacagttccacattgctggggaggcctcaggaaacttccaattgtgatggaaggtgaaggggaagcaaggcacatcttacatggtggcaggagggagagagagtgtgagggtcaaagtgccagacatttatcaaacaaccagcaagggagaagtccaacctcacaactcaatcacctcccaccagtccactaccacaacatgtagggattacagttcacaataagatttgggtggggacacacagccaaatcgtaccagtgacaatctttatgaagaagtttacctttatctccttggccaggaacatggtccccactgcacaggaaaggcataccttatctgtcctgccccctgctccctgggggaagagaaatagattctctagcctcagccaaaaggtgcattttccccagaaggtgctgcccatgaagtttaaatttaatgaaagagatgtggcaagttcacaccacataccctgtgccaaaagatgccattgtcatttgcacatgaaagatgctcttcttgaattgctgtttgttgaatccacatctgtataattctcagagaaaacctatttgttgaccctccctccttctactatatttgtagactttgttccttcccatttggagaatttatgccagtcaaggagcaaattgtcatccaatgatcttagaaaattaacaacatattgggtattatattctatatcaaagcatatgcattcccatgcaaaatatgtctcttttcacttaaaggccctaaatcatgtcagacctgggcttcaagaaaagttcaatattctgtatttcacctttctctttgatttctctgacattatttctgcgatgagattctctttctaggggctgcaatgtttaccctcttagttgtgtgagccctcaaacctcatatttttttctgaaaacttgtagctaattaaatctgtttatagtttaataacgtgttctatttggacactgtggttttacacatgttaaattcctaatccatgtagacttctttttttggcatgttctctgaggtagataatagcatcttgaacttctataattccactgacttgctcacttctaatttgagtgctggcataatccttagcatacaagagattctcaatataaagcagttaacccattgatgtgtgatttgggaaacaatttaaaatgcgatgatgcaaataaagaaataaagggatggataattgggggcaggtcaggcttatgaattggtgtagagctccattccccaaatatccccttaattagagtgttttcattagagtcattttggaaattgttacaatgctcactgtaatgatgttacaattctgtgtcatgaatgctccatgtaaaagcaaaaatgccttcatttaattatttagtaaaaatgtcaaagagggatgtgatcactgaaaactggaagtattaagtaaaataataaaatcattcaaggaacacaaactcttgcttaagtaagcttacctaccttcctttctcccttcctggcaaaatttctgtgaatagtcatctttaccttctctcctcttaagtgcatttatccttcagctcggttaaatactcatcttgcccttttgtaccatctaaaacattctttggttaccagaggctgggaagggaaatgggagtgaggttggagggagatgaggatggttaatcaatacaaaaaataattagaaagaatgaataagacctactttttgatagaccagcagggtgactacagtcaataacaatttaattgtgcatttaaaaatgactaaaaaagtataattggattgtttctaacacaaaagataagtgcttgagggaatggataccctattcttcatgatgtgattattatacattgcatgcctgtattgaaacatctcatgtaccccataaatatatacacctactatgtacccaaaaaaaagaaagcaaaaactaaaaaaaaaaaaaatttgctctaatttactagtgacagctcaaaagtgaaatccaatccaaatccaatagtgaaaatccgtcttcatcctacttgactactcttcagtgaatctcatactttgtcaagcttgcccctcgctcagcatctagaacttcattcacttgtatctcttcacacttccaagattattggttttttgtctttttggggagcccttcttgagtttaagctaactaaagtagaaacaatatcttctcaatcacaatataacctaccacttacaatacattttcgaacaaaataggtgtgtttatttaaatgaatggatttttaaaaatgaattaatatcagaaataaaaggaaatggtttctcatctagctcattgttgaggtatagaaatgagattgatggaaattcagtgactagtccatggtcacagagtcaattaccaacagaaatggaacaggagctgaggtctccttcatgcaaattctacattctcttcttataccaccacaaaataaatgcaaatattttttccctagtaaacctccacagagttaaagtcatgcctattttatctgaaatcccataggagactagaaattgaaaaaatccaaagctgccatgtcatctaaatcattctttattcatacaaatatgtgtattaaaaatatacctctaagacgcctagttcataatgccactatgtattaagcctttttaattattcctccaaatatgttttttcttatttccttggctttttttccaaaatgaaactacactttactaatcttactgcttttattttagaaataagcccaaatcacttggctagtttgccaaacagtggaagggctacaatgaatcagagagtaatgtttgtcccttaagccattgagtcacttcagaggatcatcttaagaaacattagaatcatagaatcttctcattaaaagggactagcaaggtcatctaccttgaaatttctctaaagctgtaattcatcaatgaccatttactttgtaatagatcatagttctgaagctctgctgcaattcttctcatttctctcagtgcaagctggtgttttcttctccaaaaggctctatatttcataggagtgattgattagttggtttttcagagcaaaacagtctgaattcaatcctttctttgccacttaatagctatgcaatcttgggcaaatgtactaatacctctaaatcttagtatttctcatttctaaaacagagatgcttaatcacataacaaaagtaggagaagctacgatcatgctgtatagtagcaaagcttcaataagtagtaatcatcattgtatagtaaacaattacttgagaattctctctccccatcatgttcccttgctggcaatttcttgatgctggttttaattctctaacttctttcaagttcatttcttctctctagagatttttccctctctccattgagcttgagcacagaggagcttttgtaagcttttatgttctccactctaaggtttcccaacttccatgtagagtttacattaaatagtcatcatctcagacacaaagacaaattaagcatttgctaggggggtgcataggaaggtatccataccagtacttcatatgtcctagaccttgaatcagacaaattgcctcatgttctcccttgaaaatttcacatggaaatttccacggctgccagatttttaggtgtctaattttgtggaggacctcaaagttctgattttaaatctattagatggcttccctttccttggttcttcctgccaaaagtcactgtcaagcctggtcccccttggaaaacataggagcatatatacatatgtatatgtacatatacatacacatatatacatacacatacatatatacctgtatatacacacacatacacacacataacaccagtcaacttttacaggagtgtggctcttctaagatatttgcccagggcttgggatttcaattaaatgatcttattgccatacttatcagtcaatgcttaggtgtcatgcatctactttgctatctcggtgctccaaagctttgtgaatttcttgatcattatccaccatatcttccaatgaaaagtttatttatatcaaaagttgtgtgattccagtcttatttctggtatgaattccacttatgaatgaatgagaaagaaagctagtagatggcccaaagcaaatttgcaaagtcttctgtctctctttccatttcctgtgtgtgcctgtcctccctttgttgttctcattccagtttaccttaattccatgagcatttttccacctcctccctccagacagagacttgtccttctgtagttccacttgtttttatttcctgtggttacctgcatctttcttgagtaaaatttggacgcaaaagggatttgaaaaagtccatgcttagtaataccacttctgggaatttactctaaagaaacaaatcatgagaagtaaaaagtcattctgacaaagaaatttataatatttacaatgataaactgaaacaatctaaatatcatagtatatatcaaccagatggaatgttatgtggcttttataaaattcaaggctttgcagtaacaaaaaactgagtgaaataatattatggaaaatatataatgtaaaattatattacatataattagaacaatttcatttcacagaaaaaatattaatgctagtataagcaccttaataaggttgtactcaaatagtttgccctttttttcatgttaatttctgttgataaaatattgatgcctaatactttcatctattatgagtcaggaatttttctaaggcctttccatgcatttaatttttacatctcatttaatcttcataataattccctaatgaaagtgacaaaatatgtccattttacagatgaattcaaagaagatcaggcacaaagaactaacttgttcaactagctaatttagaatttaatccaggtagtctatcaccagaatccattcttttaatcataatactgtgctaactctgatgtttacattggtttataaatgtattctttttgtcaaattagttagaaaaaaataacactaatttatttaagctataatttgacaatgtttttaaaagtgttaatatgtcatggtaatgatatcaacacacacacaagcaatgcactgatttcaactgtgtaaaaccccacctgactctatttatattaattactggttgaaataaaaaatctaggaaggagaacagggtcaccctgatagaattaaattaatattttcatttaaatccatttaatattattatcatattgtgtgaaatagaaaaacaaaaaataaaataaacaaaacaaaaacttgcctattgtgaggtctatttccatgaagatttatagggaaaagatttgaagaagccaatttttttctgaggaccagaaaatcaagatccagtttcaataatgatagcaatattcagtgaattatagattaccaaattcaatatcatataagtttgattctaatgaggtaaaacaaggaatattttctctacaatttacgtataaataaagctattattgcccactcatctgagaatttttttttacttttccttttaataaatttttttgggggattcagtgggtatatgtgcagggttgttacatgggtatattatgtgatgctgaggtttgggatacagatggtcccatcaaccaggtggtaagcgtagtacccaatacgtagtttttcagcccatacacccctgtctagcagtcccaggtgcctactgttctcatctttatgtttatgtgtattcaatgtttagctcccactaataaatgagaacatgtggtatttggttttctgttcttgtgttaatttgcttaggataatggcctccagctgcatccatgttgctgcaaaggacgtgattttcttctttttatggctgcatagtattgtatggtgtacaatttctttatccaattcactattgttgggcatctaggttgattccatatctttgctattatgagcagtgttgtaatgaatatgtgattgcatgtgtctttttgatagaatgaattattttcctttgggtatatacccagtagtggcactgctgggttgaatggtagttctgctttaagttctttgagaaatctccaaactgcttatacagtggctgaactagtttgcattcctatcaaaagcatttcttttctatgcagctttgtcagcatctgtttgtttgtttttttttttgactttttagtaatagccattctgactggtgtgagatagcatctctttgtggttctcatttacatttctctgataattagttatgttgagcattttttcatatgtttattggttgcttgtaggtcttcttttgagaagtatctgttcatgtcctttgcctatttttaaattggattattgttttgcttgttgatttgtttaagtttcttgtagattctagattctggatattagatctttgtcaaatgtatagtttgcaaatatttcctcccattctgtaggctgtctgttcattctgttggtaatttttttttttttttttttgctatgcagaactctttagtctaattaggtgccacttgtcaatttttgtttttgttgcacttgcttttggggacttagtcatatattttttgccaaagcccatgacaagaaggatatttcctaggttgtcttccagaatttttataggttgaggtcttacatttaaatccttaatccattttaagatttgtatatggtgagggtaggggtcaggttctttctgcatatggctacccagttatcccagcactatttattgaaagcgagtcctttctctattgcttatttttgtcgattttgttgaagatcagatgattttgcatgtgcgggtttatttcttggtcttattctgttccattggtctatgtgtctgtttttgaaccagtgtcatgctgttttgattactgtagccttagagtatagtttgaagtcaggtaatgtgatgcctctagtttgttcttctttcttaggattgctttgtctattcaggcattttttggggtttcatattaattttaggatagattttgtttaattctgtaaacattggggttggtaatttaatctgtagattgctttgggcaatatagccattttaagatactgattctttaaatccatgagtatggaattttttccatttgtttgtgtcatctctgatttatttcagcagtgttgtgtagttatccttatggagacctttaacctccttggttagatgtatttctatgtatgtgtgtggagtcggagagatgggggtgtgtgggggttgggtgtgtggctattgtaaatgggattgtgttcttgatttgtctttaagctagaacattattagtgtacagaaatgctactgatttttgtacgttggttttatatcctgaaactttactgaagtcatttgtcggttccaaggtcccttaggcagagtcttcagggtcttctaggtaatagaattatattgtcagcaaagagagatggtttaacttcatcttttcctatttggatgtcttttatttcattatcttgcctgattgctctggttaggatttctcaataacacttgaaattatcttttaagccttagtagagttttatttaaaaaagaattttactttactattttctaacctctttaggttaaattgaacatatttacaaatgaaagtactctaaatttttagtgtttataaagtattacatcttcatttgctagtagaatctcaagattctcttctgaatgagtgtactcaccattgtctaaatactttttaatgcttatgttgcataatttccctgatgagaattgatatggtttggctgtgtccccacccaaatctcctcttgaattcccacatgttgtgggagacacccagtaggaggtgattgaatcatgggggcaggttttcccatgctgttctcatgatagtgaataagtctcatgagatctgatgttttttaaaaatgggagtttccctgcacaaggttctctctctttgcctgcaaacatccacttaagatgtgacttgctcctccttgccttccaccatgattgtgaggccttcccagccatgtggaactgtaagtgcaattgaacctttttttttttgtaaattgcccagtctcgggtatgtctttatcagcagtgtgaaaatggactaatacaaaaattatataagttatttaatatagataaacttctagtgagcagcttcttttgactgtgtacatcctgcttgattcacagggggcaataacaattctggctcctttccaacatttgagctcctggacctacatgaaaggtgtgggaattggagaaacagttacaggccacactaagatctctgaaatccagacacttcactatagcagaaatgtttgctgtgagtctgaacagtaaggacataaaactgaaagttctacctgatgaagtacagaatgttttgttgtttatttctttgagtaattcagctctttctaaactgaagagtgaaggaatacttagtaaaatcacatcagaggagaagaccactgttttatgtgtttctaaaaaaaaaaaaaagaaaagcaattagtgttgtccttgaattagtttatcaatcatgcgtattaaaaaaaaaaataagagcctcaatcagaagctaactttgcccttgcacagagcactacgaaaaaccagattttaatttattagaggaaaacattattcttcaatttatcatgcaaattcaaaatttcattataaccaagagaaaacagagtttctgaatgatcttagagctgctgtcagtgaattcaatctatgaaattgataataaagattttttgtttcatttttaactttttatgaataaaaagcttaagtcacaaccatgaatactgaatcaacacataatacatttccctagatttttttccaagcatttagaaagcttcaaggctttgattatttcatttgaaacctggaagtacctattgaataatcaaatttttaaaatttggcattccttttgctgtcatctggcttttatagtttctgttaagaaatcacccatcagcctggttgttattcccttgaaagtaatctattccttctctttgtcagataattgtttgtttgtttttctgcttcatatttctttttctattttaaagatatataaagattttgtatataaaaaatctagggaaatgtattatgtgttgattcagtattcatggttgtgacttaagctttttattcataaaaagttaaaattgaaagaaaaatctttatattaactgtttatagttcaggagaccaagaatcttaaatcatgtgtctatttctagcagcttagtacacatttcactaactctttccctgaaagaaataaagaaaaaaactaaaattattggataaaatatttaaaattttttgaatacattaatgagctgataaaagagtgagaaatctctgatgtgaagtactttaaaacattcacttgaaaatcacattcagtggaaagttttgataaattcatagcaatctatgcacccaaactgggagcttcatctcctgaatgactagatggaatgtaaactccattttctgttaccatatagttcttcagttattcgtttgatggctttaacaaaataacaagggagccacacacatcgattttcttttttgtattgtaaatcctcagggcaggtcggtgggcagttctcagaactgtttgcaggtagctcttttcattttgcaacttgattgtgcgattcaactgttctgttaaactcatacagagagggctacaggagtaaggatagtatttgattaaaatcctatctaatatttattaattatgtgatctttgcaattattttgaatccaatttcctctactgtaaaattatgataactccttcgtcgtggtattgttttaaggatcaaacaatatatggtttggaaagcaccatgcctactgcatggtaaaaatatttaacagatgttaatttgtcactgtcatatggaatctaagatgattttcaaaatagagctcaatgatgtaaaaattattctttttcctttgtattaatagaaaaaatcctattttatgtttgctaaaaaatattaaaatatattacattaaaaaggaactcttgaaagtacaattcagacttcaggaaggagtatttcttataatgtcaaaaagttgtattttatctattccccactcactctgagtaaagtaatcagactctattatgagagagaataaaaaaatcggggtgtgcaggaaaaagaataaaatgagtaaaagttttgagaccatcttgttaataaactccattggaatacaagtagtaatatgcaaacagaaaatgaaatatgagctacaattgcaaataataaccatttacatattttgcagagttttctataatattctattatcatagactagcattaagatcaagaccttgaaaaataccaggaaaaaaaaacactaaataaactatagattggttaaaaaaatcataattcagaaaacagaggattaatagttaaagtataagttttaagagatgaaaaacttagactagaaagaagtaaccaaaagttggagaaatgccaattaaattagcaagatatgctttctaccaatcagactatttaaaaatactttaaaaatttgtattgctgacagagatcaggtgaagattattataatacattgccgttacaggatatgtagcagctttgggtgcagaaatatataacctattaagttaaaaatcatttgtcttttaatctgaaaaccccacttctagaaatatattccataggagtcaaagtaccaggatacaacattgctcacagtgataaagcacttcaacaacggaatgactgaacaaattatggcataagcatgcagtgaaacatcatgcatacattataccatgtattcattaataagaacaaatcatttcacttggatagctttccacaaagagttgttgaatatgaaaagatgcagatggggatgtaaaatcttattctgttttagaaaagaaaacatggagaaagtatagactgctatatactaggatgtcacatgagttaccagtggaggggagtgtgaagagggtggctccggaaagaagaggcagcaagccaaacaaaaatggagacaagaaatagactgctacgctaatttctataaatgtttgtaagcacttttatctaaagttagatgcatgtgtctgtaataaaaattttaaaattaatcagaaacagctctctaaccccaaagtatctccagtccccgaatttggaagtcttatgtggtttagctgctgaacagcaactccttcctccattttcatttccagtttaaaacatggagaaatcgttggtgagatgtagtgataggaggtaaataagtgtgctcctcagttctaaattcaaaggatatatttgccaacttcttcatctatcagaatgattttattaatttacacttcacttcaaacataccacgaagaatctgactgaccctgacaaatctagggggttggaagggagtgcattttgttattaatggactcaaagaagaatatttgtaagcaagggtccacgttccctttttctcttaaaattagtactagttttccatgaaatatgaacaaaacagaaacaataattgagattcatgaaaaaattctggggataaaaaaacaaaagaaagaagaaaaatcctagagctaatactcaccctagaatgtccaatatatgaggggcaatattttttttttttttttttttttttttttttgagatggagtcttgctctgtcccccaggctggagtgctgtggcgcgatcacagctcactgcaagctccgcctcccgggttcacgccattctcctgcctcagcctctcgagtagctcccgccaccatgccgggctaattttttgtatttttttttagtagagacggggtttcaccgtgttagccaagatggtctcgatctcctgacctcgtgatctgcccgcctcggcctcccaaagtgttgggattacaggcgtgagccaccgcgcccggcgagaggcagtattttaaggcaaaaatgttatttattttcagggagataaaacaaagcatcacagctatgagaattaatttttaaaatgaaccggtaaagatttctatggaaagcagatgtaaaagaatcaattctttcaaagtgaaggtaaatgatggaaggtggagctaataataaatagggaaaaaaataacaatgaagagaatgagacaaaaatgtcaggtgtggaataaaaacaagaaagaaaacattcaataatagaaattactaaggaacaaaacggagaaggaaaaagttttatagtaaaagtcatgaggcaaactaaaaaaccaatatcattggatattcaaagtgcttttgatatccgagcaaaattcataggaagtcagcacttcatagtttggtgcaattctttaaaggttaaaaaaagtcttcaagcttttatataaagaaaacttagtttcagggcattaaaatcaggactcctttcaacctcatcacaaatagagtatcaatcaatggcctggtctctgaaaggaaaaagatctcaaccaagacactcaggaaatgtgtcatttgtgtgtgaaaacaataggaagacattcttcgaactacggactcccactttcccacctagaaattctttctgcaaaatacacaacaggatataaaccagaactccaaaagactgaattacatgtaagctctccaattggattatgcattggaaaaaaaacaaacaaaaacgtttgatggccattaaaaccatgttcccattacagagcagtcactaaagtgtatgattattgtttgataatagtaagtaagggtctaacaagggaagacgtgctgtaagtctaaataactggagtaaattttagaaaaaaaagtagaacaaacattttaaataataaaataaaagtttatttaaaggttaaaaaatgggatttcagattccaaaatttagataatgagctaggagaagccacatggctttgaggttacaccctgctttccttagaagataattgagagtaacaacaaaaataaataaataataacaacattagaaaagctaaagggagtttgagataatcattatgaaagcaaaacaataaaaacagcataattaatgattcaaaattactgaggtagattaaaagaagcacaaaataaatttaattattgacactaatatgatatttatttttaaaactatggaaataaggaaaaatgtttacaatgctatattaatacaatttgaagcaaaaggaacaaattgataaattgtacatatatgtctgtggacaaaccagcacaaaaatagaaataaacatactataatgtaacattatgggtaattgctttatttactcatacggcttaaaaaacttttaaaaataaataagaacaactctcttaatttcattgttaaattacattaaggcaagattaaacattttaaaaatatgccaaattcaattttaagacgcagcatatattgccacttttaacaggtagtaatttaactgcagagaaagactttcgtttctttcttattataaaaaaaaagtaaagaattattcaccattgtcttatcattactttagaagacaagctatttggtgaatctgtacaatctatgtattaagtaaagatatttttgcgcttgggtaaataggtccctcaaagctggcagggcctctaactaaatatacaccatgtgcaggttattgaagtaaaaacggaaggtctgtgtgtgacatttgcagatactaaaaatgatgcttaaatacaaacatgattttcccattggagaacgacggcttgccactaagataagaatactgctttcagaatttccttctgaactttctaggcaagcctctctagtatgcattctccaaaatcagatatattactgaactatcatatagtccaagactgtaaatctttggttcatacaatgtcagggatcatggagaaatttaacatttaggaaaaaaaagttatctgtggatattgaagaagactttataatcatattactctttcattttattcatgattctaatttcaaaaattaatcttgcttccccctctacctttcctgtacatcctccatatcaactagattgcccttgttttaatttttcacttttttaaagagcagttttaggtttacagcaaaattgggaggaaggtacagagatttcccatatatcttctgccctgacatgtgtacagcctccccagttatcagtatccccaacagagtggtacattgttacaactgatgaacctacattgacataccacagtcaccgaaacttcatggtttacattacggctccctcttggttttataccatctatgggtttgtacaaatacataatgacatgtctccaccattatagtgtacacacagagtatatacactgccctaaaaatcctgtgttctgtctactcatctctctctcccctccaacccctgacaaccattggtctttttactgtcttcatagttttgccttttccagaatgtcatatagccttttgatgttgacttctttcactgagtaatatacatttacatttcttctatgtcttttcatagctcttttttttttgtcactgaacatttctttgcctggatgtaccacagtttattcatccattcacctactgaggaacatctcggttgcttccagatttgggcagttgtaaataaggctgctataaggatccatatgaagatttttgtgtgggtataagttttcaacattttgggtaaatatcaaagaatgtgttggctagatcctatggtaagagtatgtttcgttttgtgagaaaacaccaaactgtcttttaaagttgctgtgccactttgcattcctaccagcaacgagtgggagttcttgctgcttcacatcttccccagcattaggtgttgtcagtgtactggatttcggccacacaaacaggtgtctcattattgtttcagtttttgttttcctaatgacataatgtggagcatctcttcacatgcttgtttgtcatttatacaacttgtttcacgaagtgtctgttaagttatttggcttatttttaaatctggtttccttccttcctccttctctccttttctttgtctctctctttctttctttctctttccttccttccttcctccctccctcgctccctccttcctcccttccttcctttcttccttccttcctcctcctccttttctttctttctttccttccttcctttctcctcctcttctttctctttccttccttccttcctcctcttctttctctttccttccttcctttctcctcctccttccttctctttccttccttccttcctccctccttccctccttttctttctttcttccttccttcttctcctcctccttttctttctttctttcctccttccttccttcctttcctttcctttctttccttccttccttccttcttgataggatctcacttgttacccaggatgaaacgcagtggcagtcactgtggccttaaactcctgcgcttagatgattctcccacctcagcctcccgaatagctggggctacaggtgcaccaccatgctcagctaattttttgtagagacagggtttcatcatgttgccctagttggtctcaaactcccaggctcaagtcatctgcccatctcagcctcccaaagtgttaggattacagacataagctaccacacccagacttgtattcttactgttgagttttaagagttctttgtaaacttggataacagacctttacaagatgtgtcttttgtaaatatcctatcccagtctgtgggttgtctgctcattctcttgatattgtctctcacagtgtggaagtttttaattttaatgaagtccagcttatcattttttatcataaatcatgcctttggagttgtatctaataaattactaccatatccaaagtcatctaaattttctcctatagtatcttctaaaagtttctagttttgcattttacatttaggtctatgattcattttaagttggttttcaggaaggatgtaaggtctatgtgtaaattcatgactattcttctttagcctattgatgtgattgattacattaattgatttctttattgttgaactagccttgcatatctgtgataaatgccagttggtcatggtgtataattatttttatacattgttgtatttgaattgctaacattttgttgagattttttgcatcaatgttcatgagagatattggtctgtagttttccttttttgcaatgtttttgtctagtttcagtattagggtaagctggcctcatagaatgagttaggaagtatgccctctgcttttatcttctaagagagatcttacaggagtcctctaattccttccttaaatgtttagtagaattcatcccagtgaacccatgaaggcccaagactttatgttttgtaaggttattaattatttattcaatttctacaatagacatagatctattcagattgtctatttctccttttacaaatattggcagatggcatctttcataaaattgattcactacaatcaaccaataatcaaatctgtgggcaaacagttgtgcataaaattcctttatgaccctttaatgtccaggacatttttattttgtaccctcagtcaaaactgtagaacatacatatgatctttgtacttgttgaaaaatatttgttgcctttcttttcaaaaaactacctaaaataagtaagagttcttattcttcacttaaacaaatggaacactttattattgtgtgtgcatttagttggctgttatttccacttaaatttctcattttttatttcagtggtattaatcaaaagcattgtgccatgtggctgtatattctcttggataagcaaaaggatgctggacttgtacaatatgtgcctgtgatcacatatattcttaaataaatgtgaagggcatggctttgtaaagaggctttgaatttcttgacttcaagtttcacttctaatcattaaatcaattggaattttctttatggtcattttaaagactattataagctgttactatttaccagcttttcagaattaaagaacttgaagtttttccttttatctttgaaaggaggcaagcatctctattgtcacaatcagcctccacacagcatgatggggatggccatgtttttctccctaggagtattgcattgtcacttgagctgttcaagatttgggatgtgatatttttaatctgaacttccaagaacccataaatataattaaatgattctgatgaagccagtcccaaatatctgggccatgacatttacttcatcatttaattgggcagagaaacaaacattaatagaataaattggaaatcttaatcatacaaacatgcagatatggagaaaatcttcacattcccttgcacagctcatcctcgttgttgcctctgtcttctttccctctgttattattctaccgctaacctgaaaatatcttcttacattctttccattattcaaatgcatccatcgtgcaaaataataatttattcattcattttctgagctcagtaacctacaagggaatgcttaattgttggctatatcttttttctctagtaatttcatacatgcctctgtttctaaatcattgttatgcttctgaagaataaggatcataaaatggtggtacacaacccttaaagatgtaagaaatttgagcaatatttagacatgatacaaggatcattttcaatatggagaaactgagccccagaagatttaaattcattcaatcatgtatttggtaagtgagcattcacattgtggctggtactgtgttgaatgccgtgtatacaatgcagaccaaaaaataacagagtttctgttctcatggacttcagtctgaaggagggattcagccactaatcaaatagacacttaagaggtaaaattttaaattgtgatcagcattttcggaaagcatctatagtgatacaagagaatttactaggggaaatggaccattccttaggttctaccatcagctagaacagagtataaattggaacccagattttcttcttcacaaataatcccttagatcgttgaccacatagtttacattagatgaattcttcccaatcagttgattcactatcgttcaggtgatctgcagttgcagataagcgtggtatacaaatttgagtactgaggccatttatctctttagccgtggtttcatatagctgattttctgctctcttaggaaccagttctgagaaaaatatataggagttgttatttacactgaattttgccagcatgaggtaggccaaccaatcagacctatagcttctgtgttctctgactaggctcccaccaaaacatgtttaaccatcacctagtacttgaaattcgaattcagcataacagctacatgactacctggtgtatttttgtacttctctggcattgagaagagctcccttaaggccacacattccatattcagatagatcttttagagttgtaaagatgtttgtttaatataatgcgttaaagtgtagctaccttccaagagttagaactcagtattagcaccatattctcatccagccactgagatatgtgacaagtgaaaagtggtgtaagatatatatgcacacatatattcctggtggagacaggctatgacaactttctgactttaatcttgcaaatgatggagtacttgacaatgctgaatcacagaaaaaaatccaaagcttgctctgtgtattaaaacatccatttaaaaatatttagaaagagccaccaagcacttgtgagcatatgtgcatatgcccgcagttccctttgctctggaaaatattcaagtggaaagctactgctctgtttcataagtaacagcaatttgtgacaagcatggaatatgctgggcatcatcaactgcattgttatcagctgcagtacaatttaattagcgagcctgagtttgattatctgccagtgcatgctaccttaactgctctgttccagtttgaggactaaattttgtctgatcatgttaacatatttgagagcatacctcaacattctcaagtgttttgttcgtcatattatgctcccgcatcaacaaaattgtattaaaagccttgacgtcagctcaaaatattctgaagtgaatcaaaagcttattatttctagacgtaagaataacttgacttcatgttagatatgatttcctcatttatagtgctgcttaaatcagatgaatgtaaaaggatatactggtcactataatttcaagatttttttagatttaggtgtgtttgtgttcatgtttcagaatgagtgtagttccagcttcagataaggaaaggaagtttagggtgacaggaagagaacacagtagccagaaagccagatgacaaataataagattgtccaggcaaggtatcagaatcaaggcagtccaggaaagggctaacagggcatctcccagagcaaacgcagatgaaaacagatgtcacatcagcaagcactggtcagagtcgtttgtgtctggacttcagatgctagaaacagcaaactagagggctttggccttttcagtttggctcttgacaaagacattttccatttgtagacgctgtcaaacactcattcttttcatctgtgcactctcacatgtaaaattaatggcaacaattagaagcgaatgaccggacctaacacataaaatatcgacttaaagaaaacatataggaggagctggctgaagaaaatatgagaaggtttaacatatggtatttaattttttctaacattgcacaaatgcaatattttctttaaaatgtttcatataaatcttggcagaatttatattgttaattgacttctgtctttttagataacttaagtgcttgtatattacccccggccaattgtaaatgcttggaaaggaagccttatcgtatatgcctttgtttatttgtgtttttttgagacgaagtctcgctctgtcgcccaggctggagtgcagtggcatcatctcggctcactgcaagctccgcctcccgggttcacgccgttctcctgcctcagcctccagagtagctgagactacagatgcccgccaccacgcccggctaattttttgtatttttttttttttagtagagacggggtttcaccatgttggccaggatggtctcaatctcctgacctcgtgatctgcctgcctcggcgtcccaaagtgctgggattacaggcgtgagccactgcgcccagcgtatatgcctttgttacagtgtctatgttacctggcactgtgtgaattatagggcatctgcccaaccaagtctcgataaatttaatatttagtgtgtataccataaactaaaatcctaataaagtgctaagtgcagtatgaaagccttaagggaggaaaaaaagcaaaattcacattgtgttaaatctcgtctcacgtaagtgcacctggcttacagagtagataactcaatggggtcaaaactgaacatttttatttttctccaatcactgcccttaacaagactctgtctagtatttctttcccatcacataatggcatctttgaagctgtgatcccaaattttatctaacgctgtcttcttttcctatcaagaaggaacctatgtgaggaagagccaatgtctgatcttcctcttctcctctcacatcagggtctttgagaagactgagggggaaggtaaaagtatgtggacttctcttatttacacaccttcttccctttctcttctgggtctagcttttcttggggtatggcagagagaagaaaagggaaactaaagaatcttcaggttttacagacctggccgtgtattggtggtggggaggcaactctggtgccatgcaggcttcatctagagaccccagtcctactccggcacaaactcttcttttctgctgctagtggtgtcatcaccttagatgtttccctgctgctgatgtggatggcttccttagggtgatctttagaacattcttagtgagacacagacacatctccctataacccacctatgccttaggctcattcatgggcctttatcttactttgtctacttatctcctgggtggggaccttgtctcctgccctctcccctaaactcatgtttcttcacataaaaacacagaaataggaactcttttacactgctggtgggagtgtaaattagttcaaccattgtggaagacaatgtggcaattcctcaagaattgcccgaaataatatttgaaccagaaataatatttgacccagcaataccattactgggtatacatccaaaggattataaatcattctactataaagacacatgcacatgtatgtttattgcagcactgttcacaataggaaagacttggagtcaacccaaatgcccatcaatgatagactaaattaagaaaattgtggcacatatacaccatggaatactatgcagccataaaaaagaatgagttcatgacctttgtagggacatggatgacgctggaaaccatcattctcagcaaactaacacaggtacagaaaaccaaataccacatgtcctcactcataagtgggagttgaacaatgagaacacatggacacgagggtgggggtggcatcacacaccgaggcctgtcagggagtggggggcaaggggagagatagcattaggagaaacacctaatgtagatgacgggttgatgggtgcagcaaaccaccatggcacatgtatacctatgtaacaaacctgtatgttctgcacatgtgtcccagaacttaaagtataataataataataataaaacagaactttgaagttctcttctacagctttgagagctttggataactggaatgaaggcatggggttacctccatcttcttcctggcacaacagagcaactgccccttttgccatgctcttatgaatgcttcaggcaaatgtgattcccaggaatcttcaggtgaaaagcagacaccagcctctccttcatctatacctgcaagctccagagagcagatggtaagctttctcctcccttccctggggcaagcatttcattctcttctgagggtgacactcttgtgcctgcaggtactactgccagcatgactgtccctgggactctcgctcatgcaaaccccataaataatcatgaaaagtcctaaaaaaacactcatgctgatttttttttacttcgtagacagttcttagaaatgaatagatcccctacctatcatcatatacttttactcttaatttgtgtttaaaaataattaagttataataaaaaaggcaaaaataatctacttgagattcagcaaaaaaaaaaaatcattatagcaaagaattcttagtcttagatgtcagagtgaattcctgcataaagctttataatcttctcactaaaagtcattaacattcattatacatagaaatagtgaggagaatagttaaaacagctgtgtacattaatagataattttaaaaagtattctgggtaaagaacattctgcactgtggcattgtagttaaaaatatggaaccctgagtgagaagaatctgggttcaggttatgaactgtggccttgagcgcattatgcaacctcctgagcttcagtttcctcgtcaataaaatgggcatagtgattcctagcccagaattattgtaggaattgaaacagataaggcatgtagacatgcaaaaagcccttaataagtagtaaacatcaccttgtaccccataaatatatataaattgttcattaaaaattaaataaaataagtagtaatatctttattattttgacaaaatataatcctctattatcctatgtacttgatttgtggaaagacacaattatcctctatacgtgatttgtggaaagacagtctaaaaccaagagagagaaattcttctaataattcttttaaacaaagtaatttcattttgaaaaagaatgccagttattcttctgcttcaaacttaagcattcagttatcttaagacttcaggcttcaaacttaagtattcagttattttaagactatccaaggatatatcaggataaatgtacagaatatcaatatttcactgagatggtgtgtttcactaagtcatttgcattgtataatgtaagatatcatcttctaggtgggaaatgagaaatacattccatagatgatgagtttggaaacattttgacccgaaaggaattaatatggaagacaagttttagaaatgctgaggctcagactttgaagcccatgttctacctatctagtgtgtgcatgtatgtgatcacattgcctcacataatataatgcagaggtcaaactgtgtcatttctaacatcccttcagctctagctttccacaattaagtgagtggaatcctgctgaatgcagttgttctatttttaagtttcatttttgtctgtacttttcctaaagcaaagatcacctcgtctaaacttcaagaattataagatgcttttttctcagtcagaaaacccctacccaaaacttgagaattttgtgtccctatcagtattacctaattagtatttcctatctattccaatctaaaaaaaaaacatcataacaaaaagaatattctatactctatatcacttatttttatttcataataaggcaaagctgttatcatatgtgaaaccctacttgtccctgaaaatcctggtctttaatgaaaagtaaaaataaataataacttcttttgtggttatgttgtgatactcctttttatcaattggtattaccaagttaagggattaatacaataattgagctctgttttgaattcagaatgatccaacttactcagtgtgagaaagaatttagaaaaaaagaaggtaaatttagtttcacactaaggaactcgtgttaatattagccctattaataatgataaacataatggttaatacttgttgggttgggcactgctgtgcaaaaggcagtgttctgggcattttgcatacactgattcggtctatccctagagcatccccaggaggtaggtatcaatcgtgtttcctcattattgtagtgaggaaactgataaacaggaattttagccacttactgaggtttgcctagattgtgagtaacacagacagtacattggaaaaaacaacatttgtgaaaaatattttacctgtgattctgagctgcaaatatttttaaaattgtacaatgtactctaaaaattgatgatgataatttactatagtaattatattgtaaaatagaatgctcttaaatgatgtaaaactaaaaatgtaaaacaacatacaaatgcatttaaaatgttaaaaggaaagtaaatatatttataataaataacatttagaatgtatataattagtatgtttaatgagtactaaatctttctctttacagagttacaggaaattctggttttgagattctgtaatttgtacaaactcattttattaaggagagaaaatggtgtttagaaatagtcactgagaaattgttctctatttctactaaggaaccaccctcttcctctaggctataaactggatcttttccctaaccccctacttttttaaataaagcaggaaagtaatgatctgggccacttttaaagcacattattataatatttgaatttaaggtgtattaaacattctgacattaagtgtcatcattctcatagtccctaggcctgggaacgtagcctggcatggaggcaccatgagggaagcaggtagctgcatgatgttccctaggagaaaagaggttcaggaagctgagacagacacaagaaagctgggaaagcatagcaagggggagggagagagaagaggtctgggttgaaatcacggaatgagcaggttagaagaaaatgaacctgctaaggaggtccaggaggaggagccagaagcaagggaaatgagaggaaaatgcagacaccactagagagcagtttggttgacctgccaaatgattcagaagactcggaagtggaaaaatcttcttttcccatctgcagcctctccagagagagatgatgatgatccaggagctgagctcaacgaagacagaagtacatgctcctctctcctcaaagggaaacatcaatgaaattcaccttgctgaatgctcagacattaattttcaaggaagggttccagctcaggatggggcttagggtgtggcctatgaggcactctcctggggcacaaaattttaaagggtgctagaaattccagtaatcaagataaataatattttaatgcaatatttttaaaaactgaaattaatacaaaaaatctgggatgcacaaaatatcagaaagtttaataaatccaggctgttttaccatgtggcattgttgtgcaacagcaattgtctcagcccatgtccagggcatctgaatgttgacaatggtgtgaaaacggattgggcagcacggattcatatatagtcatatttttaaaaaatatagagctgttattgacttctccacttggcccaaactataagaaggtattttgatatatgtatatggggttcttttttttctttatactttaggctctaatgtgggactgcttctgaaagcatatatttgatgaggcaaaattaaaaagggaaggcaagcaggctaaatacttgaagatgttaattttaaaaataaggagctgggcacagggaccattccctaaattgcattagagaattgtattgatgggttgaacataggggtaagggggaatttagaactagatgaaaccaatttgacttgatctctccattttacaagataattttgtttgcagtaaatactaacaaagtagctagagattttagagaaaccaagaagtggtctttaaagaggccacggaagaaaagttattgagtaaaagtcattccctagaaaataacacattaattaacatatccaggcatagacacttgacagtttgacaaaggtgggctcgaaaagaggagaaggcaaatgaattaaatgacaaattctacacggttcctgcagtgatgcctttgcttaggcagtaatacagattagaattttaaaatgaagaaaacgaactggaccagcctccctaaaattatcaataataaatttatgcttcattcagactcaatatgactgaggttagacagttctccgttataaaagaaaatgtatctattaacttgttatcttcaagaactgggattttgcattttcaatggttttgagttaaaagtttttgtagattccttttaaacatttactgcttatttataagtatgtttatcatttacttaacctcagttgaagcatattctgcttacatgttattagatgtcttgttataaataaatggatagtattttaaggtgaaaaatttcatatattaatgttcactgcttaaaactaaaaggtgaaagttaaaattattttattaaaacatttatttttatgtttgtataatttcattttgtttaaaatggccttcattaacagagaagggatcttgcactggcattttaaatgttgggatctttgcttgtggccttggtttctgagtgagaaaaggaaagccaagtggtatataaataaaatttagataaaataatcaaaaatttaaaactaaagtatttgagtcattattctcaaattttttgggttaaacccaaacataaatggacattcactgtacaaaacaaaaatgtaatattttgtggaatttaaaatatatatgtaattaaaattcatgactactataaacaaaccaagattgcaggtatagccttcagagtaagcattaataaaatatgtgactaacaaattaataagaaattagtggacaaatagaacttttgattaattaaagaaaaaagaatgtagagaaagaggaccataaactcagggggtcaagtggaaataactggtaagacaaaaacacaactatatcagatattacaataaatataagttaaactaaataaaccaaataagaaataaaatacattgaataagaaagaaagcccagcaatacgcagcatagaagaaacacattttaaatacaagaacatataaaattaaaagtaagagaacagaaaatgtttactatgaaaaacattaacaaaaaaagatcatctagctatgctaagatcagaaaagtatgctttaaggaaacgagctttataaaagttaaagaagggcatttcagaataataaaggggtcattgaaacaatagagtgacatactcctgggtctgcatgtactcagtgacaaggtttcaaaatatatgacagaaatggaaggaaataaacgtgaaacagacttccaaaagctgacagaataaagggacaaaaaaaatttagtaaggtttgaaaagatttgaatatcatcattaatttgacctagttaacatatatagaatagtgcactgaacaacaaggaaatgaatgactaagtgcaatggataccaatattaactatatgctggccacaaattaagtcttaccaaagaatttactaattcagaatatattctctgattacatcagaattaagacaaaataatgagaagaaagctaccaaaatctccgcctgcttagaaatcaagcaataaatgtctattcaatacatagaccaaaaaagaaatcaaaacagacattagaaaatatatttaactaaatgataataaaggtatagcatataaaaatctcatgagatacagcaaaagaggtgcttaaataaaattctatgatcttatgttgatccaagggtaccaactttctgttataaaaataagatctggggatctaatgtacagcatggtgacaatagttaataatattgtattgtatacttggaattagctaagagagtttatcttgagttctcatcaaaaaaacaaaaattaaaaagggaaactacgtgagttgagggaagaatatgttaattaacttcattgtggtaatcactttacaatatatacctatattgaatcttcatgttgtacactttaaatatacactttatttatttatttatttatttatttatttatttatttatttatttattttctgtgacagaatcttgctgtttcacccaggcctggtcaggagttcgagaccaacctggacaacatagctaaatatatactttaaatatgtgaattttatttttcagttattccttaacaagctgaaattttttataattttaaatgtacatattaaaagggatgagaaagattcatcagtatttgctgcttcacattgcacaattatgttatggaggtggcttctttccttaaacctcatgtacccacctctgctggcttacaacttttttctgtggcttcctcacctctctcagcctccatagaagttcttgctctggattaggcttcagcttaagggaatgttgtggtgggtttgaccttctaaccagaccactaaaactttttccatatcagcaataaggctgttttgctttcttatcatgcatacgttcactggagaagtactctgaatttccttcaagaaagtttcctttgcattcagaagttggccaactgtttttttgcaagaggtttagtttttggcctatcttggttttcaacatgccttcctcactaaccatgtctagcctttgatttaaagtgaaagacgtgtgactcttcctttcacttagagggcatcgtactcatttgcctaaattcaatactgttgtgtctcagggaacagggaagcctaaggagagggagagagacaggggaatggctggttggtggagcagtcagaacgcacataacattgattaagttcaccatcttacgtgggcacagttcatggtgctccaaaacaattaccatagtaacatcaaggatcactgaccacagatcaccataacagacgtaatgataatttaaaaagtttgaaatattgaagaaattgcaaaaaatgtgacacaaagacacaaagtgagcatatgctgtcggaaaaatggcaccaatagacttgctcgaagcaggattgttgcaaacctttaatttgtgaaaaatgctgtatctctgaagcacaataaagtgaagcatggtaaaataaggtttttctatattatatatatatatatgtatacatacaaaaaactaccaaaagaggagatggcaaactatggccccagagcaaatctttctcacagcctgtttcttgaagctagatatggtttttatatttttaaatctttatgaataagaaaagaaggagaaataggagaagatttgctatacaacatagtgcctataaataatactggtattgtgcacctgaatatttaagactgtagacttatgttaagtctccaaacaatgatgtaatctttcgttgaatttaaaatatatataattaaaattcataactacaataaacaaatcaagaatgcaggtatagccttcagagtaagcactaatagaatgtatgacatacacacatatgtatacacacagacacacacataaaggggcatagggaaacttttggaggtgatgcacgtgtttattaccttgattttgatgatggtatcacagttgtgtgcctacgtccaaatgcttcaagttgtacacatttagcatgtgcattttttatacagttataccccaataaagctgataaaggtacatcagggagtttattaataaaatattgagttatttgcatttttaatatttatggtgttcatcaacttttataattagtaactgaggaagatatttttactcattctaaataaatatttacttttgttcctaattttgggtttcttgttttgcatttttaaaaaagttcctcccaattgtcaaagtttctgggcccacaaaatctggacctgctcctaattttttgccacatatctgagtctgggtattttcttcgtggcttttagggggctttggggttctactgccatgcctgtgattcctagtatttggaaggtaactagaggttgcagaccagaaggaacagaaagccacctgacctaagctctagctgtggtagaaaaaggtgtgtaggcctgctatggtgacatagggctagttactttacctgtccctttgctctacacaactgatactatgcatagttccttctacctcaatccaggccctgttacctctgtattgtatcaccaaattgtaatttgaaaaaaaaaaaaaaaaaacataataaaaagggctcaaatatgccaagattttgttttattttattattatctttttgagacaggatctcactctgttacccaggctggggtgcagtggtgcattcacgggtcactgctgcctggacctccagggctcaagcaaactttctgcctcagcctcccaagtggctagaactacaggccacagtgcctggctaatttttacaattgttcttgtggagagagggtctcacatgttgctcaggctgatctcaaactcctgggctcaagcgatcctcctgccttggcctctcaggcatgaatcactgcacttggcctccatgatgttaaaatgagatatttgtgatatacagcatgctgaacaatctctaacatgataattagaataaccttcaaatatgtaaattctaaccataccttagagcacattttaaaattccctgtcttctattatattacttgctcccaaatattcaaaattattaattcaattgattgattctgagaagacggtagggtgatggcttagtttttcaatctctctaaatctccacacaaaaatagagggaacagtaaagaaacaaaaatctgggcatctgttaggatttagtatatattttttactatttacctatgatatgctctatttcatgtgaatatagtttgttttactactataattccttataaccaagactaatataatagattttctgtattctccagtagatctaagtgagtttccacttcatattgaatcatcactaagtaaacctatttatattcctgaggaaatttatatttgaaaacaactgggaaagcatgccctgaagtaggtggtaatgataaaagttaattttgatggagtggcgttttcaaatgagtcaaatgtggccagtagctcctcatctataaaaaatacaaaagtaaattcagccctaatttggtgaatcaatcactttttcatttcattgactcttgaaccaagggattatgttcactcttgaatataaaacctcattcattaaaagacagcctttgaccaaaccaattccatttatacaaatgcaattaatttaaaggagctgagtgctcctttgcacaatgctttgcagcagtagtatgctcatcaaatccaatgtggttgtttacagttattatagaaacattatctccaatgagccaaaactacttctaggaaatgtagtagttatatttatctccaaaatgttttctttctcaaaattattttatctgtaaatgataaaacagcaagatttatcagtttttacttctataagttacaaatactgaaatgtcccacataaaccttgttcagttatgaacacatttatgaaccataagttatggtgtcttcaaaccatttgcatttttggagcaataatttttaaatgttatttcctcatacaattcatgacagatgatgttcaaatatggatgcactccttctcatgcatacaattatatatttatgaaacctaatatttacagggacataaagtactgcagtaattcatgcatactgcttttattaatgacaggtggttcccagatgggaccatcaactgccggtacaaggcacagtgtcctggccataatccaactctatctccccaactcaggaaaatctaccaaaacacaataatattagtatgacaataaccatgttctactctgcaaaaatgttatgagttaaaattttactttaattatttgtggaaatagtcacttgcagtactttggattagtatgtcatgaaccagagattaagaattacagtttgaggttataatcagatctctctattcaatttcctgccgtaaacttttcatttaaaaacaagtcaggattcaatctatgtttgctatataaaggtattaagtatatgaggaaaataagtgtatatatattaatattgcaattatatgtctttggagctcagagagattaaattatcaagcctgtgctcagccaggattagaaacaattctttttaattccaattactttaaattttactaaaaccaattgactaaatccaaaagtaaaaaaaagtactgaattttgcaagaaatgaaattttataaacatttttagaaaacattatttcacacatactaaaaagttgcaaaaattatacaaagaactttaggaggccaaggcgggtggttcacttgagcccaggagttcaagatcagcctgggcaacatggtgaaaccccatctctactaaaaatacaacaattagccgggcatggtggcttgtgcctgtaatcccagctactcaggaggctgaagcaggagaattgcttgagcatgggaggcagaggttgcagtgagccgagatcacgccaccgccctccagcctgggtgacacagcgagactccatctcaaaaaaaaaaaaaaaaaaaaaaaaaattatacaaagaatctctgtcaacactttgctaaaggcctcaaatgttaacatttcacattttctttactctctctctccatagatagagatatgttatatataaaaaatatctatattgtatttatatacatatgtatatataaatttgttatattaacacatacatatgttatatatataacaaatttatacatacacatacttatgtgtgtgtatatacatatacatatatatatatatatatatatattctgagtcatttaggagtaaattatggagatatatccctttattcctaaattattcagtttgtatttcctggaaaacaaattctcttatataaacacctgacagtgattaaaactaggaaattaactttgatataatgctatcatctcatgtacagactttattcaaatttcaccaacttcccattaatattctttaaagaaagggcaaaaaatagtttcttctgcaaaatctaatataaggttctttttttatttagttattgtgcacctttggtctcttttgacctggaactgtcttttatgaccttcacattttgaagagcacagatcacttattgcaaagaatattgttcattttgtttttatctgatgtttcctcagagttagatttcagttatgggttttgtgcagagtagcacaaaagtgatgttgtgtacttagcgcctgatatgagaatgaacattatagtacacaattgttccatcttgatcccttggttaagatgctgtctgctaggttcctccattgtagagtcaccatcttcactttgtcactaataagtattttatgaaggagatgctttgaggttatataaatattatctttctcatcaatttgcatccattagtttttagctttcatggatgtttcttgccagaaataattattatggtgtttgccaaatgttgatcttgtatctcatttttcttttaaaatgtattagctgtcattgtcctataaataatgccttcatttatccatttatcattttttatttcagtgggttataattctttactgacatttttatcctcagagttatcctatatttggccagtgggatgcctttcaaacagactcctatgtccttttcacatggtcccatcattctttgagcacgttcttactttctgacacagaaagcttctccaggttcatcttgtattttttcattccatgcccgagaattagccagttctccagggagccctggatctttttagagacgaaaggtatttataaacaaagagctaagggctatacgaaccctgtagcaatctactttgtaaaaacatttatttatacatacacaccaatatctgtctatacattaatctaatatctatcatttatctttataactatgagctcatccccatccctccaattctaacaaaataccatatgccattctagtgtctttcagacttggaatttgattttgggttattttaacgagttagcctgccacggtttcatggatgctaatagaagatacaagacttctgagtcagagacaaaggacattttactcacagcatagcaagcaacatgatttgcgtgggatcctcttgctctcaagtcccatggggatgatgtgcgggccgcagatgggaactggatacacagtggatttgcagcatggctgaagaacttattggtttgtagcaaaataagcaaacctgtttttttgtcttgaagtcatgacttcatctctcaaaactgcttgcacatccaacgctgagaaacggcctggataaaaagtggcgagggtgttgcattcctggcacacccagcaatgatgcacagggatgcccagagcccttcgtggattgctgctccaaacgcttacccttcccattttgtgatactcttttctgatgatagcaaacctgacttctgctacgcttcattcatttatgtatctgctcaatcctacagtatgcactaagaagtttcagaatttctaaactatacctctgaaacactaacctaccaactactaacttgtttgccttttttttttttagccagaaagtatatagtcaaaataccaaattcaacaagtaattgggttagttccttatttctcagttgagtgtattatgttattcatttccttctgtttgtattctatggtacccctccctttttatttattttatttgcttttaaagattaaaaaaaaacatgttctttccctgaaaatttcaaaaaaaaaagaaaaagaaaaagaaaaacatagcatgttctaacagacacgggccgatttgagggtgaatggtggcagaagggagatgatcaggaaaaatacttatcaagtatggtgttgattacctgggtgatgaaataatccatacaccaaacttctgtgccacataatttgcttatatgacaaacctgcgcatgtactcctgaacctaaaataaaagttagaattaattaattaattaataaaatagcatattctaaaaatcaaatccataccaaacatatactaggaaaaatgtcactccattgttaccctatccctatcccttctccccataatttctatctcatttcaaaccaccctggtgaaagacaagtttctcattttatttcttcttctcaagttcaccagcttttcattgtcgatgttctgaatcacataacttttggataagaaattactttctagacaaccaatcatatttttacaaaagattatactctctttagctattcataaccaattgaaaatgaaagaaatcaacctcaaacaatcttgtccctcttgaaaataggaaatcaaatcaaattagaactgttttctaacgcccgctatgttggaaagctcttggtaaggatacacaaatcttcctagtttattaggaataaatttgggaattaagcatctattctacctttcttgtacaaagtgcatttgtgagtaatcagacagttgataaaagaaccttctttctgaaataattctaaacaaattcagaaagaatttaaaatacatgtaatatttttcctaataaaatcatagaactaggtaacattcatcagttttaaaatccttaggtaaaggccaataggaaaccttacaatggatggatcaggttgatcacacatgaattcacagatcaatcttaatatcaagtaaaagggattgaaacaagacgtcatgtaccatctgatacagagcaatagaaagcactcacaaccacctatgaaatgttcttgtcaaaaggaatttagttaagcatctagatctgactttcagttcataggacattcatagagtaaatgagcatgtttaaaaaataccatgatgctgctattcagattgtgggaaattccaacaaacaaacagcaagaaaaaatgaaggagaaaaactgtaatatatcaacagaggttaagaggcatattacacaaaggcaatgtgtagactttgtatcttcatttgaataagccaactgaaacaatgcatttacaatagaaccagcaaaattggaacactatttagatacaattttatgctctggaattattgtttttaggtgtgataatgacattctcctcatatttttttaaagttcctgccctttaaagatacactgttaggtatttacagatgaaatgatatcatatctaggaattcaattaaactatgccaatgggggtgattaggcagaaatatgaattaaactacatttttatgtttgaagtttttcacaataaaaacatgtttttaaaaaccattttttagcttttttccttagggacattaaaaattttaaatagaaatttggacatttgtaaaactaagttttaaagactacagctattaaataaaatagttgctttgctaaactttatcaagctaaaaaggctctaatatttatgaagaccagcttcgttttacttgagtcacctccttatttttatgacttgatgtatcatttgtttttggatcctgcagtctgagtatagcaagagagtgccggaaacatggagagccagaactaactgatatgggctgattttgaaaatactattacttgtttgaagttgagattacctcagaccaattttctcaagcagctagtgtctatgttttctagagttaaatttatttcatattgcaagtattttaacctgggcatggtggctcacgcctctaatcccagcactttgggaggccgaggcaggcagattgcttgagctcaggagtttgagaccagcctgagcaacatggtgaaaccatatctccacaaaaaacacaaaaattagctgggcatggtggcctgtgtacttgtagttcagctacttgggaggctgtggtgggagatcacttgagcctgggaggcagaggttgcagtgggctgagatcgtgccactgcactccagcctgagtgacagagagagaccctggcttaaaaaagccaaaacaaaaaccaaagtattctaaaattcaaggtgtaaaatgttgattcatattaaattttaaataacattttattaaaaggtcaaatagtagtaatctggcaaattatgtgtgtgtgtgtgtttgtatgtgtgtgtgaatatatatatagagagagacatagcttactctattactgttttattttatcttcaattgacgaatgattgtgagaggtgacagagtgctggcagtcctcagagccctcgcttgctctcggcacctcccctgcttgggctcccactttggcggcatttgaggagcccttcagccctcccactgcactgtgggagccactttctgggctggccaaggctggagcccactccctcagcttgcagggaggtgtggagggagaggcgcgagctggaactggggctgcgtgcggcgcttgcgggccagctggagttccgggtgggcgtgggcttggcgggccccgcactcggagcagccggccagtcctgccggccccgggcaatgagggacttagcacccgggccagcggctgtggagggtgtactgggtcccccaacagtgccagcccaccggcgctgcgctcgatttctcaccgagccttagctgccttcccgcggggcatggctcgggacctgcagctcgccatgcctgagcctcccacccactccatgggctcctgtgcggcccgagcctcccagacgagcaccaccccctgctccagggcgcccagtcccatcgaccacctaagggctgaggaatgcaagcgcacggcgcaggactggcaggcagctccacctgcagccccggtgcgggatccactaggtgaagccacctgggctcctgagtctggtgaggacgtggagagtctttatatctagctcagggattgtaaatacaccaatcagtaccctgtgtttagctcaaggtttgtgagtgcaccaatcgacactctgtgtctagctgctctggtggggccttggagaacctgtgtgtggaaactctgtatctaactatctgttggggacttggagaacctttatgtctagctcaaggattgtaaatacaccaatcggcactctgtatctagcttaaggtttgtaaacacaccaatcagcaccctgtgtttagctcaaggtttgtgaatgcaccaatcgacactctgtatctagctgctctggtggggccttggagaacctgtgtgtggaaactctgtatggaactaatctgatagggacatggagaacctttgtatctagctcagggattgtaaacgcaccaatcagtgccctgacaaaacaggccactcggctctaccaatcagcatgatgtgggtggggccagataagagaataaaagcaggctgccccaaccagcattggcaacccgctcgggtccccttccacactgtggaagctttgttcttttgctctttgcaataaatcttgctactgctcactctttgggtccacgctgcttttatgagcggtaacactcactgcgaaggtctgcagcttgactcctgagccagcgagaccacgaacccaccagaaggaagaaactccgaacacatctgaacatcagaagggacagactccagatgcgccaccttaagagctgtaacactcaccgcgagggtccgcggcttcattcttgaagtcagtgagaccaataacccaccaattccggacataattgtatgtatttatggggtacagtgtgatgttttgatacatgtatacagtttgtaatgattaaatcagggtggttagcatatttgtctactgtattagtctgttttcacactgctataaagatactacctgagactgggtaatttataaaggaaagagatttaattgtctcacagttccacatggctaaggaggcctcaggaaacttacaatcatggcggaaggcgaagggaaagcaagcaccttcctcacaggcagcaggagagagaaaaagcaagcgaacgaggaagtgtcactttttttttttttttttttgagatggagtttcactcttgttgcccaggctggagtgcaacggcgccatctcggctcactgcaacctccgcctcctgggttcaagaaattctcctgcctcagcctcccaagtaactagattacaggcacccgctaccacacccggctaattttttgaatttttagtagagacaggatttcaccatgttgcccaggctggtcttgaactcctgatctcaggtgatccagccgcctcagcctcccaaaatgctgggattacaggcatgaaccaccacgcccagccaatgccacacttttaaaaccattagatcttgtgagaactccctcactatcatgagaacagcatggcagaatctgcccccgtgatccaattgcctccctccctcgacaggtggggattacaggttccttccttgactcgcggggattacaattcgagatgagatttgggtgaggacaaggaaatatattaatatatattaatataaagaatataaaattattcaaagaataatttgaaataaaagaacttggttataaaaatgaacagatctataaaagagacactgtaatagataaaagttcttcatctcatctacattttacacttactcagtaccatctcctcataccccttccatatggtacctctcctaatgtaaccatagtactaaaatatagaggactctagaattgtaaatcctcacggtagcaattcacaccccttggcttgacaaggctattctttttagccctccccagggggtattctctaaacataaagactcattcctgtaaggaatgcctcttcccacaggtctctgctttgtactctaatactgggggacttcaatctacttaagggagaatgtcaactcctaattgagtggaagatatttctagaagtctcatagaaaatgagttcttagtaaacagataccattgccaaacatgcatctccagagatctctgaagtagagattttgatagaggccttaaaaattcgttctttggggaggtaagtgatatttttgatacccaatagattctttttatagtttggtttcaactatgaaaagttatttcagggtcacagcagacttaattgaagataataagggatgtttataattagatgaaaggcccctgacttcattgggtgcaacctttgttaaacagcagtttcctgtgtacaaatagcttggaaattggaaattattcaggaaattgctcaaaaattacagaatggcttaacattttaatgtcaagtttaaacagttgtactggagacatacaaaactctgaggtcaattctgagttgcacaattgagttatatacctcagcatctagaatctattctactacaggaggttgaaagtttaatcataaagattaggaagaaagattaaagaataatttgaaataaaagaacttggttataaaaatgaacagatctataaaagagacactgtagtagataaaagttcttcaaatcctatatttcagaggcaaaaatggcctgtaactgttgagtgaagacaggattatcagaaattctggaaagatttgagtcaacattactgaattaggcatggtaaatctcaagtgagctctggaccatggacaactttaaatggcagacacaaacatgactttaatcgctcaattataaagcaaatattttttctaattttagacaggtaacatctatttgttttaatataagtatacttatttcaagggaaataactcatatgtgaattctgacatacattttcaaacataaagaatataaaagacaagcagagaaaaccagaaatcctagttcaagaactaagatgctcctgtgctgtaaactataaaattaatgtttcagaaagctcatttataccctctttccataaaaaaattaagctacttttcagcttctatataaaatagtggatgttcagttttagaattacacctggtattaggagataaatggaaagaaatataaatctggctttggctcagggtttattcccaacatcttttacatcttcatcttgtgtcttttttatcttcagcttatgggaggagagtaaaaaattctcagaaaaaaataaaaaggtttgttaatttctccaaaacatattggactatagtagctttaacagcatggataatcttgcaaatattcctaacatcattctttgcatgacctaatcaaagaactgctgacattttgagacaaataatactgagactagcttccaaatttacttgttctcatattttcagaattccaatggatatgtttttgtgtctgggggtattactgaaatgctttcattatctgtaacccaactgtcttttaggtggggtgggttctgccaaatgaaaatcattgatgaatctgattatgcaaattttaggtgtagaaatgagagagatgtaaatagctaccaaaggagaattgacaagtctgagcagaagaagcacagatatcaaaaggcaaaggaggaggaagacttggtgagatagtaaaagtccacacactcaaatgagaatctctttctaaaccttcaacaaggattattaatctcacaaaagtatatattgattttttacaggaaaaacaaaaggtagcgactaagttgtctgagtctgatctgacatgaacaaaacaaaccaaggtatgagggatcttcaaaaagttcatggaaaaatgaaattaaacaaaaaataagaaatatcaactttatttttcaatctaagctccatcacgttcaagacacttttgtaagcaatgacaccgacatttcgtccatccctaaagaagtgaggatcctgggaatttaaccacatcaatgcagccttttttacactattaactgaagaaaaatggatgccctttacagattttttaaattagggggaaaaaaaagttgcagccaaatcaggactataaggtggatgcctatttaacatcgaaactctcaaacttgcccttgtttgatgagagcactgagcaggagcattgttgttgtagaggactctctcatgaagtttcccaggcatttttctgctaaagctttgactttctcaaaacactctcataatgagcaagacattattgttctttggccctccagaatattccgaagcaaaatgccttgagtatcccaaaacaccgttgccacgacctttgctcttgaccagtccatttttgcttcgattgggccctttccacctctcagtagccattgctttgattgtgttttgtatttaggatcatactggtaaggtcatgtttcatctcctgttaacaattcgaagaaatgcttcagaatcttgatctgcttgtttcaaaattccagtgaaagctctgctcttgtctgcagctgatctgggcacaatggttttgatactcactgactgaaaagtttgctcacttttaatttttcagccagaattgtgtaagctgaaccaattgagatgtctagggtgttggctattgtttctattgttaacaattggtcctcttcaattagggcacaaattttttttccttgcaaattgttgtgggtggtctgctgctgcacgcttcatcttcaacatcactattcccttcttaaaacaagcagtctatttgtaaattgctggtttctttggggctttgtccccagaaacttttcaaaaagcatcagtgatttcactgttcttccacccaagctttaccatcaatagatgtttgttcttaattttagcagaactcatgttgctctgatagagactctttgtaaactaatgtcttatccttcttagtatctcaaactatatcctgttcagatacattataacaggttagtatgagtttattttggtgcaaaaaagttttgaagtccatgcacagtttttttcttaataaacatcttccgtgaatctttgaagactcacatatatgagttaaggagcctggcacagaagagtgggagaacaccaagatattagcagatatgatagaagggcattgaacttccaagggaaatctgaagatatctaagtttcagagagtaaagagggctccaaatgacttttgagttacaaaacatttggagatatgtatgcaactttatgcttcaaaaaaattaaaatcacttctagtttatttgtaggacatatggaagaaaagcagagctgaaaatttataactaattttttcaccttgttctgataacttctagaatcactgtgaggaagtacagttctcactatttttcttccttagaactatagacttaaaggaatattttacctgtaatgacaatatatgcctaacaagtgcgatcttttctccaaaaataaagttggtgtagatcacatagaacctgaaaatataaagaaagtaaacagatatctatggaaatgtcaactcttattttattttagtttagtttagtttggttttgattttgcttcaaagaattgcctaaaggaacacgtttacatgtaacaccgaagtcagtttcggttacatgtaacaccgaaggcagagtaaactaaatgtttagcaaacaaaagaacttctgagggtagaaaaataaaaagaataatattataagaatgcctttcttctatatataggaaatatttttcttgtccagtttttaaaaagcagagggaagactacatcaggagagcagatcagctctaagagtacttagcccttcctgcagaaatcttcaccctctcagctcttatggctctgaagaccaacccttccattcttgcctcaggaacctaagggttttggggtttagcagatttttttatgtcagtctcgaaagggaggaatcagattttcaaagttatcacatattattttaaatatccaattacaacaaacaatgtatgaggcatgtgctgggtgaggagtcagagccgcagcaacgtgaagtgatcagcttacaggtagtaagaagaatttactgacaatagtataggttggaaatccttttattagataggattgaagtctattattagatagaaagaatgctgcagaagagtgcagtgggaagcctcagcaagagaggactgactgaacatgccatggtggattttcccttatgggtatttatggaccttaaagcaggagcttaaggataatttgaaccatataggccatgtaggtcatgataaatgattacatttatagacattttcgtgccttaatattagcaagcgttgcagaatgagtttcaatatgaatgcattccagagatgtatagacattctagttatttataaattttaggaaagaagcctagtagcagatgctggctttggataatagggaagtctaattacttataaattcctcagataaggaattttgcctctggacggtctgcttgatggccaccaagtgatcttggctctcctctgtatgtaaagaaactagaaactatggttcatacgtaggaaaaaaacgtggccattagaaactgtctctaaggaagtccagacaatgatttcctaggtgaagtctttgaatcagctattgcaaatatgttcaaagaagtaaagtaaaccatgtcttaataactaaaggaaagcatgagagtgatatctcaccaaatagagaacaccagtacagagtcagaaactataaaaaagaactaaataaaaattttgaagttaaaaagtaaaataattcaaatgaaaatttcaccaggtagtctcaacagcctatttgaactggcggaataaaccattggtaaattcaaatataggcagttcaaattatctagccttagaaacagaaataaaaactaaaggaaaggaaatgaatatagcctcagagacctgtgggacatcatcaagtgtatcaatatacaaataatggaagtcctagagggagaggaaagaaagaacaaataacatatttgaagaaataatggccaaaagcttcccaagatttatgaaaagattcatttatatgtgtaagaagcttcgtaaattccacataggataaactcacagagatctatacatcataatctaaatgagaccgtgaaagctgtgagagagaagcaatctatcaggtacaagggatccataagatcagcagctgatttcccagcagaaaacatggaggccagaaggcagtgagattacatattcaaagcgcaggaagggagaaaggtaggctgtcattatcttatatttctctgagtcccagaactgccatcatcttggtgaggattctttgcctcatccttgattcttcagttcagaaatcatttttatctttttcccccacccccatccatttgccttaactctgatagggtaaaactggaaaaaataaggcaatgacttcaaacaattggaattaatgagaggctcaagtaatatgcacacatgcaagaatagtagaactaactaaaaacagagaaagtaaaaagattagtgatgatgttgctgaaatatgaaaagagacaaggttctgagtcagatgaatttttacattttgattcttcatttctgtttttctcccaaggagaagtcctattactctctcctgaattttaagagattaataaagattctaatggatcctgaagttcaggatcagcagaaagtttcaaaggggattttccaggtgggaagaaagtatgcagaacagaaagagatggaacagtcaaaagacaagtgttggtgaagatgtggagaaactggaacccttgcacactgctggtgggaatgcaaaataatgcagttgctataaaaaacacagtatggatattcctcaaaaaattaaaaatagaatgattatataatccagcaatcccatttctgcatatttatctaaaagattgaaatttagatctttaagagatgttagcactcatgttttattgcaggtctattcacaatagccaagatgtggaaacaacctattatgcccatcaacagatgactggataaaaaaattgtgggataatatacacaatggaatactactcaacctttaaaaaaaaggaaattcttcaatacacacaacacggatgaatcctgagaacatgatgctaagttaaataagccagtcacagaaagacaaatgctgcttgattccacttgtatgaggtatctaaaatagtgaaattcatagtatcagagtgcaatgatggttactgggagctggggatgggggagaggaaacggtgagttaaaatttcagtcaagccaaataaataaactctagagatctgctgaacaacattgtacctgtattcaacaattatgtattatgcacttaaaattttaagaaggtgtagtttcttaccacactaaaaaaaaaagagagagagagagatgagacaacgaagaggaactttgcctgctttagtattaagctaaaagtcaattctactccaaagactctttaatctatgtcactaggatgcatatctctgtactaaatccttttaggggaattaaagcaaatagtggctctttcagatggctgttatcaaatatcttttattataaagatagaaatttgagtacctaatttgggaacttaaaattttcataaaacttttcaataattttttactaaatacatagttatgattctgtcctcaccaaaaataagaatgctcctcagggcactcaacgcaagtataaaagatatctataagtaaataactaccaaaagattacattataattttttttgagatggattctcattctgttgcccaggctggaatgcaatggtgcgaccttggctcactagaaccttcacctcccgactcaagagagcctcctgcctcagcctccaagttgctgggactatagatgcatgccaccacacctgggctaatttttgtattttttgatagaaaaggggtctcactatgttgtccaggctggtcttaagctcttgacttcaagcagtcctcctgcctcagcctccctaaatgctgggattacacaaatgagccactgcgccctactacagtataattttaataaaggattaaacctcatataaactttatcatttagaggatatttacctaaaatcagtgcttaaatatactaagaaaatgtagcctgaataccatgatggggcaaagagagtgagtgagtgattgatttttcttgaattaggacaattcaagtttttaaaaaatgttactcaacatctgaggcattcaaaaagatgcataaataacaataaaatatatacccatgattccctcaacttataaagccttttatttatttttttaaattttttttattattattatactttaagttttagggtacatgtgcacaatgtgcaggttagttatatatgtatacatgtgccatgctagtgcgctgcacccactaactcgtcatctagcattaggtatatctcccaatgctatccctccaccctccccccaccccacaacagtccccagagtgtgatgttccccttcctgtgtccatgtgttctcattgttcagttcccacctatgagtgagaatatgtggtgtttggttttttgttcttgcgatagtttactgagaatgatgatttccagtttcatccatgtccctacaaactacatgaactcatcatttttatggctgcatagtattccatggtgtatatgtgccacattttcttaatccagtctatcactgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaaaaaaaaataaagccttttattaacactcctctgtgaagcctgctatgcacctattcctgctatgaatcattctgtcaccaaaggcaaccactgtcctgaattcattgtttttcattcctatatctttaatatttaagttgttttcatgtttttaaatggtatataaatattttataccatacatattttggcaactattattttactctatgttggagatatccatgcatataggataatgtagctctagttcacgttccctgctacatagttcggttgaatgtacgtgttcatttattcagtcaccaattattcattgagtatctataatgcattgtttaggtgctagggatatatcacccagcttttctaaattttacattctcgttacagtctatgtgccggtgtccccacaaaatcctaatccccaagatgatggtgtttgacagtaagacttttgagagtttcctacctagggtatttcatgtatcagcaggttggtgaggaggagtcattttataggtgtagagggtcttatttaatactctgaaatcaaaagaatagtgggtagtttatttatttgttcacttctttattcacagctgtaatcccaagccatctctaagtatgttcattctggagtccagacattctgaaaaccaaatggaagaaaaggagccaaggtgactaagaaggatcagccagaaaggaatgaggaaaagcaggagtgcccagaacctcaaaagctgagagaaagtgaacttcaaagaacagaagtgcatctgggtagatatcctaaagacttgaaatcagtatgtggaagaggcatctgcattgctatgttcattgcagcattattcacaataacccagatgttgaatcaacctaagtgtctatccatagatgaatgaatgaaggaaatatgatctgtatacataatgaaatactattcagccataaaaaagagtgaaatcctgtcagttgcatcatggaactgaaggacataatggaatactatttagcctgaaaacagaattcatactccaagccccacaatacgcaatatacctttgtaacaagcctgtacatgtacccctgattctaaaataaaacctgaataagaagaagaaaatcctgtcattttttgacaacatgactaaatggctgaacctggaggacattttgataagtgaaataagcgaatcacagaaagacaaaagccatgttttcacttatacgtggaatttgaaacaaactcataatagcagcaagtagaatggtggttgcagaggctgggagtggaaggcatggggaggtgatccaaggctagaaagttgtggttagacaggaggaatagatgatgggtatttaaggggatggatatgttaattagcttgattcaatcatcccatgctatatacatacatcttaacatcactgtgtgacatataattatgcatggttaaaatgtgtcaaaaaataaaatataataagtctgaagcaaatcaaaaaaattaaaaagatgatatggtctattttatagctgtgccatactatctttagctagttctctattgccccaattttactattttaaatcaatctgtgtatgaacaacaacaaaagacaaaagtggagagtggggtcaatggtgctcagaatcaaataaaatgatgacagtgttcactgaattgagcaacgtggaagtcattcttgaccttagaaaaagcttatacagacatttttgggcagaaggcaattggcaatggattaaggtgagtatgggatatattacagagggcacttttactgtgggctactgttcccagtgatttaactaacagaagaggtttataatggtaggcagatgtcacaccaagtgtcaggttctagcccaagctgaggtctgagggaagtgggtgggtgagtggtgggtagctggaaaaacacttgagaaatcctaggcaaccatggcatggctttattctctttctgggtgcaagccgtatgtacagcatcagcagggtagttatgccttctacagacaacagtggctccaagccaagcatgagctcacgtgagtgttcacctaatgcacctcacatggcatggttacataatgttcagggttgtgcgcctgcgctccaaaccctctgagtcatgctgcatgggaaggccacctcggcctgctcttgactaaagcacagccatttcccttacagcagagtgcttcctgctacccaaacacagacccagaccaggtttggtgaccttctcatgtttgcatacaggaaaaaaaaagccatttgtttcttggttttatatatttaaaagattttcagcacaaaacttgcttttacttgaatttcgaatttcttcattgtaaatattttaggcagtgaagagttattttctatacctttttgttataaaggattttgtaattgaacaaatttttcaacatgtagcctgattaaaacatggtaatttttcccctttgtctcattctcaaatattaattgattttaaaatgttcctaaagaaaaagcagactattgttttaagtgtatgctatgtcattgagaatcaagcaacaggagcacaacacaatgtgagaatacaaaacattttataagatgaattccaaagcagcataaaataaaattatcagcgagtaatgaaatagagagaaatatggatctgtagttgacgttcagagactcagaaatctaatcatcacaattgaagtgagagaaatacatcttaatgagtccttcaacatcccctcaagatttcagtatataaatatttaaaagcaggggacttaagcaactctacaacagtttcgttccagtccaaagtattgaaagaatctaacttgttctttttctgcctaaagtattgagagatactagcacaagtctatgatacaatctaatttcctgtacatttgtaatagttcattagactgtggaggaactaaaatttcctctagaatataaacatgtagggcctgtaatctcagcactttgggaggccaaggcaggcagatcacttcaggtcaggagttcaagacaagcctggccaacatggtgaaaccttgtctctacaaaaaatacaaaaattagccgggtgtggtggcacctgactatgatcccagctacttgggaggctgaggcaggagaattacttgagcctgggagtcagaagttgcagtgagccgagattgtgccactgcaccccaacctgggtgacagagcaaaactctgtctcaaaaaaaaaaaaaatatatatatatatatacacacacacacacacacacacttaaagaacataaatggtcttaatatttctagcatgtgcaaattttagaaagtcacatagtaaacatattatcatgaaactttatagctttattttctatgtagaacgcctctcttaaagattgtgatttttaaaaaaatttctatagtcagaacatcttattttattcataatacatgactaagttattagtcaaatatgttttgaaaatcatcctaatttcttttactgtagctgttagatatcttggtggaaacacatggttatgttttaacaggcagctcccactgacatattaacaatgaggtttagtgagcagtgtgatgtaggaagaaggtgctgctttgattctgattaggaaagtcaggtgggaggatgagaaacactagctgataaaacaaagaacttgagcaggatcaggaacttcgccaaggaattagcctttgcaaagagagatgtctacttctctgagaagaagaaagggaagatgggttcacatccactccttttgagaaggaagggagacagctgaggcaatttacagtaaataatctcaaacttcataaaatttcaataggtcactggcaaagaacagagggatagtggtggagtagaggggtgtgaacaacaggaacgtttagaaaagctactgtaggtggtgcaacagatatgctgctgtaaaaaaaaaaatctagcaatagtaaagatacagctgagcttgcaaagaatggcttcaatcattcactctgctgttgtgacttgaaccatcagaacttatgaatacatctaaagcataaacagagactctaatgctaggttagggactaatttgatgcttacaatggaatggacaaagacatgagctttcagtggtgttcaacacgtgtgaacagccactgcagggacttggtgcacgtgtgtttcatgggtgaagaacgaatgaataaatgaatgtacatttccttccctctcagtgttcattttccaggtgtctactatagcctatcatttgactttttgttgagaatagctatgtagaaagatgtgccaacattttgcaaaatttgtgactatctgaggagaaatagtcactatttcttaatgagagaattctggaaagaggtatggtgactgtaatttttgaaaattactaaaagatttattgtgtttagaacttctctctttctggactcaattttcttatctaagtacaagaggtaagaatattgatcattggtactattgcccagcactaaaccattttacatacaagatttcatttaatttttataatagtcctaaaacataggcactatattcacctccattgtttagatgagaaaactgaggaataaagtagctcaatttcacatcaagaaaatgaaggagctgggttttaaacctagaatgcaaagagagatgggcctgtaggcctacgaactgtgctaaatatatttatagttatatactttaataaatttggaattttgaattttaagattattggaggacaaaactatagatggtcatcaggaagaacttataagaaagttttcactatctgccaaattcagaaaagagtaacttttcaaggggaaaaaagaaaaaaaacttaaaattttttttgtgtgttttgagatagtctcattctgttgcccaggctagagtacagtggcatgatctcagctcactgcaacctctccctcctgggcttaagtgattctccagcctcagcctcccctgtaactgggactaccagtgcgcacaaccatgcctggctaatttttgtaatttttagtagatacaggattcgccacattggccaggctggtctccaactcctgacctcaaatgatccacccacctcagctttccaaagtgctgggattacaggcatgagccactgcccactgtgccctgccctaaataaataaaatttgaggcaactgaagtcataattttttacaaggaatcttcccttgtacttcagatttggaatgcacaaatcccaggcatatgaaagagtgtggcaaggtatactcaaataaacggtataaacttcgaaaaaggttttacacataattttcccctaggcagtaatttgagtattatgataatataaaaaaattacctttttaattggaatataaaactagtatactttttaaactaaaacctgggacttaatgttcacttttccatgatcttaggctatgtagctatccttcttagtatttactttcttctacctttaaacttgtactaggaaagtttttgaaaaccattgttcaagggcagtaagaagatgtggcacaatttatctagcaattaaagataacatgatgttatctttaggaagaaaaccctaaggcactcaaataattctaaaatatatggaggttgtgttttcttgatctctgctcctgagtggttagaatgatccatgaattggaaggacttcagtttgcattgcagggacaggagtgccgaatccagatctttgtaataattaatttgcatcactgctcagtactgagaatacaagtgcagaaagagaagctgagacataattgctgacaaatacgctgtgtgtattgaaaaccagaaaatttgcagctgcctcacagacgccctcattgtgcagatttacaatgaaccacaaaagagacatgaggtaaatgtagggtgtgtgctgcaagccattttgatgaaatatctgggggacaatttaatatgaaatatcagttggtaaaagagaccagctgcccattaagaaggatgactcaagctaaaaattctagctcctattttataatgaaagattgccgatatataaaccttcatttgggatataaaatagtgctgggtttgaatgtgtaatggctatgcatgcaatcttccaaaaatctgaaggaacagttttttttctgaatctggtcaaaagtcaaaacttctttggaaatccagcatgcaggaacttagaaactatcttagatgactttcttttattcctaaatctttctgtgtgcatgcatgggatctcaatgtactctcagctatagaattctgaattatttttatgtagacaaccaaccaatccttctgttccagcctcccatgaatctcactattcaagataatagatgtatctagctgctgagctttctgaggttttgcagtgcaaatcaacttacttctaacgctcacttccagcttagctttgagcttccttcagcctgcgaagttgattaccacgtgttcctattctttccagtttccagaattttgttgctgtcatcttctgttctgttctctttgttcttgtgggttaaagcccttataaatataagtcccttcaatccaccaatgttagctgcacattctgctagcttttaccagaaaacatttgaacaaataaatctgttttaaatgttgaaactctgagcatcttgacaacaacaaagggaggaatttgaggactaaggatcttcctggagttctttactgtatctatgtggaaataaaagcatgtttttaaatgaactttagattcctgttgaatgcaaggtttataaatgacctctactttcatgttaagacttttcaactcccggccaggcacggtgactcacacctgtaatcccagcacttcgggaggccgaggcaggcagatcgcttgagatcaggagttcaagaccagcctggccaacatggtgaaaccccatctctactaaacgcacaaaaattagccaagcatggtggcacacgcctttaatcccagctactggggaggctaggcaggaggatcccttgaacctgggaggcagaggttgcagtgagtcgagatcgcaccactgcactccagcctgggtgacagagtgagactccatctcaaaaaaaaagaaaaaaaaattcaactcctttgaaaatgtgtttatctctgaatcctacctctgtgaaactttcctactgacttctttctagttcgtacacttgctgctggatattagagtgcttatcgttttaagcaataggcccttaaaaggaaacacatctttccccagctcctttctatatctttgtttagtagcatttgttttatcagtcttaagtcgaactattaatccttattggccatcaccttgctcagtccttagtgcccatccccttgccaggatgctaactttccactgggactcggctcgattctaaagggaatattaccaaccttcacccatcctaacagaactagaactcacagtccttgaaaatatcaatgacagaagtgaagaatccctacagctattgccattttaaactgagtgtgttccaaatggccctggtagctgagaagtagagattatttgattcagtttcctaaaatagctcacttctctctcatctctgtgttgctcttgctgtccaggctgcccgcaatgctctatcacacaggtgtcattttccattccagccttctgtttgtgcagaagcgtaagttctcttccctcccttcttcccttctccattcctcccttctcccttcctttcttcctcccttcctctctactttttctatcatattaagatcatattgtacacacaatttgtaccttacttttctgtcaaagcattttccaacaccattggctcttctgtgaggatgttgttttagtggctgatacttcaccatttaaactttcctcaattcataaatttcactcattcctttccctcctgctttaaatccatgtacatcttctccatggtgcttcttcctgactctctctgagagtgatgctgcttctctctttcttttcaagtaaaaacatgcactcttgattccacagcctctattgtttctccttaatgctctttttgtttctgctttttgaactttcaatttctgaaatctgactctgcctaatcatctcaggtcttcccatcaacaagtaaccaaccccgaaaccttgtttgactttgctattctctcaaagcattgttctaagtgtttttcttaacacatacactaatttgtctcattgtctggtcaccccaaccactctttaacttctttagttaaatttctgttgtctccattcaacttaaactgcactcaaggctacgagaaacctcctagcaggcccaggagcctaaacttacctagtggcctttaatcagtttttcttttcctcaacattcttcaaaataccatggcatttgccctttcatctcccagtctctctaacccctccctcactgtctttatttatgttttctctatcagctcccattttaacttctattccattctgtttatgcttagtttgttaatggtgtgcttgtttgtttgtggcaaccaagtaaagtagcataaaaattttggaacttgaattctagtcttcccaaatgggtttactaataccttctatctgtcaccagtaatggttagtatgagaagcaagtatctgtatgtgttcattgtgcatatctagaattatatatttttaaatttcattaaactgaattatgcaatgttctaatgtctgtgtgtgtgtgtgtgtgtgtgtgtgtgtgtgtacacagagagaaagcgagtgccttaaggctagcgaacatagctaaaaaaattgctgagaatcagaaggattattcaacacaaaattttaaatgtatggggaaagaaaggatttaataagaatcaccaaaagaaaaaacttttggtaaatagattccaggctaaatttgtttttgctaatatgcagataaaataactagtgggcctcttcttaatttatagatgtgtgaaaattaacctaaagaaaaagtaagagagaaaattgatttaaggtataataagtggcttggagtcaagcaaaattgataagataaaccagatctcttttaagcttgcttctgcaggcaaaataagctttaattcaaaacctcattgaatctgtattagtgagtatgtagagtatatagcaactagatcataggaaaggtcagtctcactatcccctgaggcagagttggttgttcttacattacacagttgcctttgaagcaaaggttaacatcactgttatattaaagtctctctgcatcctacaaagggacccttcagccctgtctgtcatgagaacaatgtggttttccctttctctctcctcagttaggttatgctttattatatctccttagtttatcaagtccagggatatagatctttaaaaatagatcacgtctccataataagattctccctgtgaaggtctctggaaataaaaacatcatgatgtttatgtcctacagtaccagcccatcctacgatacttacaaatgtaacatctgcctgcacatgaaatcttgtggttataaactgaagtctgtagctgagaggcttttgtccagatgcccctgacttgtaagtgaaagtatgagtacttacgttgaagattgtcttagaaaagaggttcttaaaaaggctgtcacaagtttagaatctggccctcaaggaaggtcagtcctccttgctctcagggtgtctggtctctgcttcctttggccttttaacaaacttgtttgaaaaacagatttacaaacatctgatagttctttgccattctgatttcttaaaaagtggccaggtgcagtggctcacgcctgtaatcccagcactttgggatactgatgtgagcagatcagctgaggtcaggagttcgagaaaagcctggccaacatggtaaaagctgactctactgaaaatatgaaaattaccctggcatcttggcatatgcctacaatctccactagttgggaggctgaggcaggagaatcaccttgaacctgggaggcagaggttggagtgaatcgagatcgcaccactgcattctagcctgggcgacagagtgagactctgtctcaaaaaaaaaaaaaaaaaaaagagtgcctgaaaagatccacctatatctttagatgttcaagactataatctacctcaggaagaatatatagtacaacctacacagaaattaactttattgaaagaacatttaaaaaaacaatcatgcttcaggagttgaaatatcattacatttatcttaaatatttatttacttcaaaacaagtttaaaggcaaccaccagaatctgctcagttctggtcttttacatgtttactatccaacacctgaggcacatgaaggctcaaccctcctcctactcctgttcccaaggccaagatggatcctaaagagggtgagggtgagggagaggagtgaggatgggggtgggcagacttcaggagctgcatgtcagaatgggtgacatcccagcacagtaactgctagttcccacctgacctcgggttccatagacaatcccacagtttggtatccctatacttaagcgtgtgtctctgactcctgtctagtatactaaaggggacctctcgcattcattaattcatttattgactcattcagtcaacactgacagtgcttagtatgtgtcagatactaggctgtttgttataatagaaagatgaacaggtgtctactcacagcaatggaaggggaaaaaaaatgacccaaacatcttggatgagcttaccttttttgacaatctcctgccatcagacctactgtgccttggctagatgattcctttcccaaatctttcactctttctcttacaaaacagacccttcctgcatcttaagtagtcttttgtttatttttcttcaagacagagtcttgctctgtcacccaggctggagtgcagtggcatggatctcaggtcactgcaatctccgcctcccaggttcaagtgattcttctgcctcagccttccaagtatctgggatgacaggagcacgccaccacacctggctaattttttgtatttttagtagagatagggttttgccatgttggccaggctggtcttgaacttctggcctcaagcaatccgcccacctcggtcccccaaagtgctggaattacaggcataagccaccatacctggccaataatgtgattattttatatgatgtttttaataatgctttttcacttaatataagaagaatgttttctctcatcattaaatagtcttttaaatctagttttaatagaatcataaagtccccctgtgacaggtatcccattattaactagttccattttctaattaatttttcttaaactttttattacaaattactctgtggtggacatcctataaatatatatctgcataaatgtagcactgtcaaactattggttacctgtccaatatccactatccccttcttccttaattaaagaaccctgagcagcaccctgaacattgaaaatatcgcagccccgatcccacgctctgtagcaacttggcgtggtcatttgccccagtgctggctaatgatatataagcagaagtgtactagctattaggttggtgcaaaagtaattgtggttttcaccattacttttaaaaaccgcaattacttttgcaccaacctaatagaacttccggattaaaataatctaaatcagggtgtcccatgccttttgttctgcaacgtccttctttctgtctagaacatggacctgattcccagaggtgcattggccagcgtgcaagcctgaggaaggaagccacaccatgaggacagtgaggcctgatccttgatgatgtctgtccttgaactagccatccacagagtgctcccatacatccccttatatgagcaatgtaaacctgttttaatgtaattcttctcaaatcctccacatggctatgtttcactattttctttgagtggtggctaaacagaatataatttttatagagtttattattttaaaatatgttcaattaaaactcaattataagacaaagaatccaaataaaatatttgaacctaacgatttgagtacacatttcactaaggaaaagaaaaaagacaaagaggagaaggaaaagaaatgtaaatggctaataaacacataagaaaatgttcaacattattaattgttaggaaaatgcaaaataaaatcacagtaacatgccaagaaattactaataaattttcatttattacaatggttataattaaaagagacagacaatatcatgcgctggcaaagattggagaactggaattctattgcacagccattaggaattaaaatggcatagccactttggaaaacagtttggcagtttctcacaaaattaaacataaattaccatccgacccagcaattctacttctaggaatctatccaagagaaataaaaccatacattcacgggaaaacatgaacactaactttcatagcagcattacttataatagccaaaatgtgaaattatccaaatggttcctgaataaatgaccagtgcatgaatcatagacagatagtgaagtctatatagcaataaaaataaaagatgcactactactgcgacaacatggatgaaactcaaaaacagtgtgctaagttgaagaagcatccagatgcaacagtctgcatagtgtataattccctttatatgaaatatgtggaaaagcaaatttacagagccagaaaacagattcacggttgctgaagactggtggtagaggctaggaataactgcagaacagcactagtggacatttggagtgatggaaatgtttaaaaatgggtgtggtgatggttgtacaactataaatttactaaaatcatcgaactatacacttacaaagggtgaattttgttttatgtaaactagacctcaataaatctgtttttaaaaatatatccaaatattttcactacaagtgtactattgtggttaaaatttttgttgttgccaaaacattaaagcctaatggtagagataaattatgcttgagacagtttgaaagttttccttaagcatgagatactctttgtgcagaagaaaaatctcatgctgcaaatgtgaatgactaggaatagaatgaagaaaagaactcctgagatatatatggaccaaaatgtaaaaaaacaaacaaacaaaaagactgcaatttaggtcacttcactttggaaagccgaaatgatattttgaaaccttcccaaatgaacagatggcctaaacccttggtccaaaaatggaaccatttatttaattcttactatgcatcaggcactgtgttaaacaaacagttttcaacatttgttccttactaactcacaactccatgaggtattaaacatctccactttacaaatgagaaaacggagactcaaggaggcttagcctcctccccaatagcaggagatggcaaagcagagcctctgatcaaaccccagcataattccaatgctgaagcctacactgttaacctctacaatggaccactttcaaatcaccatgcctcatctcagagctccagtgcctagaaaaacaaaaggcacttagtaggtaatcagcaaacatttgtcaaatgcattttagttgagatatatatggaagtaatatactgtgctcttaataatcttgtagaaataagctgattattatcaatttttttgttttcttctattctcaattagtaacacaaatgggagcattttataatgtggatcctcctcagggcattcttgtttgcttgctgttgtttttacccaaaccaatgttccagattttagatcctgactaactcctcctcctttaggaggttagcttttttggtttaggaatacatcattgggacatctttcccaaacttcagctctatacttctagaattctattatacatgttcctctgtgtgtcctgacaaatcagatcttttccaccagtctcctcttcctcgttttcttatatctattaatggcaacaaaaatctaccctgtcaaaaatctatcctgtggctcagacatagaaatttgatagccatgtttagtaaatgtccaattcctatcatttctaccaccacaagttctccacatcacctgaatccaattcctatatataactctctcgtcatatgacatcttatctcactggacttctgttaccaaggaatcgatccctggatgtcaactttcattttcatcccatagacaattaccctagaggaaagttcttaatatcttgtcaactccaactctgttacttctcctgaacgtggctggttataactcaaatcgaaaccagatgtaaacggagccaaaacaagtgcaaccgcaactcaaaatgtcaagtgtcaatgtcaaggaactcacatagcatgtgctgtgtgtctgacttatttattgttgttgtttgattttttttcttagtttggggagagaagagggagctttggtgaaagctgtttgattgtaagctacttctcaatgacaatgacagaaaaatatgatgaagcaggaatcaatgttcaaaaatgagctggaaatacctgcttagggtgggctgtagctgatattgactagcatgttagagaattgaacttatttcagtataaattatgtaataaaaagataaatcagtagttatacaaaatgtttcatggtaattcttattttcacacacaaaagtatatttttctttgaaatgccatcattttcctctggagaaactggaatcaaacaaatgcactatttagaaaaattaaatctcagaatacatttttaagacataacaataacgcaaaaaattctgatttccaaaatatttatctatcacaaaacatagtttgctaacttatttgtctatgtacagctcacagcaatgctcttctcctttatcacagagttctcaaataaactgtgggtagcctagaatattcagagcttcaattgccaaagctgctgaatacccagaatttcattttattggacttttatgcaaaattcatatggagttacataaaattctgcctctgagcattttcaatgtaatatttgtttcttcgttgaagactgtttttcactttctaggtttacatatgaattcattttcagagtgcctttatcttggtttctactacatagtctcatctcagtggagctctgcgttgcattaccaatggtgggctatcattctccaggtgtatgtattgtcagtaattttactattgggctttctttgtttctctagtaacttccatataataccaattaattgttctgctgtaactattattattgtcaatttagcctttactagaactttggtttattgttaagaatttatttcgcctgataagaatttgttaatatactaacaaacttaaagtgatttattgagcacctatctgtgccagatatttggctagacccaggggaattcaaaaacaagtcagaacaaagccagaggcctcacataacctgacttcaaaagatattacaaggctatagtaactaaaacagcatggtattagcataaaaatagacacatacaccaatgaacagaatagaaaacccagaattaaagacacacatttacagccaagtgattctcaacaaagccaacaagatcttacattgggggaaaacaccctcttcgataaacgatgctgggaaaattggatagccacatgaagaatgaaactggacccatgtcccttatcatgcacaaaaattaacccaaaatacattacagacttaaatgtaagacccaaaactacaaaaaacaaacaaacaaagaaaaacctaggtaaaactctcctggaccttggtctaggcaaagaatttgtgactaagacatcaaaagcacaggcaatagaaacaaaaatagccaatggaacttaattaaactaaaaagcttctgcacaaccaaagaaataatcaagagtgaagagacaccctgttgaataggagaaaatgtctggagactattcatccaacaggaaataatatccagaatatacaaggaactcaaacaactcaataacaacaactaaataatcccactaaaaagcgaacaaagacatgaatagacattgcttaaaagaagacatacaaatgggtcacaggtatgtgaaaaaatactcaacattactaatcataagagaaatgcaaatcaaaaccacaatgcgataatcattttatcgagtcaaaatggctatttaaaaaaagacaaaataatagatgctggtgaggatgtggagaaaaggaaacccttatacactgttggtaggaatgtaaaccagtacatcccctgtggaaagcagcatggagatttctcaaaatctaaaaatagaattaccatttgacccagcaatgccactacttggtttctacccaagcaaaaagaaataaactcatgaaagggatacctgcacttgcatgtttattgcagtattattcacaatagcagagatatgaaatcaacctaagcatccatcagtggatgaatggataaagaaaatgtggtatatatacacaatagaatattatatgaccataaaaaagaatgaaatcatgctatttgcagcaacatggatggaactggaggccattatcttaagtgaaataatctatgcacaaaaagacaaatatcacatgttctcacttatatgtgggagctaataaatttgattacatggaggtagagagtggaaagataacagagactggtaaaaatggggaggaggatgaagagaagtggcttaaaagtgcaaacatacagttaaatagaaggattaaatacagtgtttgattgcagagtagggtgactatagttaacaaaaatttactgtactttgacttgatcactctgtcttatatacatgcaagagcatttcacaagtaccccataaatctgtacaaataaaaaagacacaaacatttgctccagtgaggataaaatatgataagacgaaaggtctttccttaaataacagtgtgagctaaccagagattatcaacttgatcatcttttttccctctgatatagaccaacaaatgattagttgtttgttgttatatggaagcatattataatcaaacagataccattgtctgaatttgctggtttggctagtctagtaatatacaataaaaaaaaaaaagaactacaactagaaattagaattctagcatttcaaaaatgccttttacatgcattattttatttatgcatcacaaaccctaaacattaaagaaaacagacctttcctacctaccttacactacagtaagacaccaggtgctcacagacaccaagattattgtttgaagaagtgtgtaaatataagcctccaggacagcttattcctagttggtttttatttcaagacattatatgggagttggcagttatacattatagacatttaataaatataagttcgataaataatattattaagaatttttattaataattattatcaaaattattattcttaataataaatttctgatacttggtgctacaatttcattcaaatccaatatgcttacatgaggtctgcctatttgaaaggtttttcatccacaataataataattaaagaaaccctcaaatcaagtgcaatgaagggtttctttccatggaaaaaattctttaaactacactctaaattccacaataaagaaatgtctcatttcaaaaatcaatattagattcttctcacaacaacaaaagtacattaatattatggaaagtgctcttcagaactatcagatagcagaatcctggcatgtcattgttattctttctcctttgtcatctttaatgagaagtccttttatatcacgatgttatgttttagaatattgaaaacatatcagacaatagataaaatatcatctggctctacagtgaatcttttagaatttttatttttaatgtgcttagattctgcatctgttaattcccagttgattactcagaattgtttctcctgccaaataccaactaccaagtctttatttttatttctaagtcctgacggttcctctcctaataaactaagaatatgaaaacctacagaaggaattacaattgccctaccttacaggattgtgtcaaagttaatgaaataatcaactattaagttcattaatagttcatgactttcataagacaggtatgacaataaatgcaaagttttactcatcacaccaaagtgtcatcatttatgctttgtcaaaaattaaaaatatggcataaaaactttcctgaaatcagctgattgttcctaaaagaatgactgttgctttcatttcttgtactgaagtatatccatttactatgacctttaataatggagactttttattgggtcacataatatactagtatgtgtcataataggcccattcttggcgcagtgactagatggagcacatttagcttggctactggacagccttcatcagcgactcatgatgctcatctctacagcccagaggacatttaaagaactaaataaagatatagaaggcggccccttctctcatcagtaagccttaccatctaagggacactctggacatcggaagattccaagtcgtctcttatggtatagaaatatttgtagagaattttcgaaagacggatgatttatttctgtctttctctcaaaacaccccggggccagtacttcatcactatgtctaggccttgtattgcctaaaataagcatccacttacaaaatggtggtttcttcctttatttggaaaggaaaattctctgaaacaacttaccaaaggcttcatcttcaatggggccatctattagtgacatagttgggaaaagccaattaatgcaaggatggtgcataactgcaaataagcgcaatacaatattatacaataccttgaattactcatttcaattggccacttgagggcgccaaagcagaagcaataagagtccttagtcttagcacttcagagaactgcttgctttctctacatttctgtttacacagatggtcttgcttcaaacaccactgcatggtaaacagtatctttaaaactggcagatatgataagatgaatattttctcattcctgcttttggttacttctaaactgtgcaacaaagctaagagtttgtgttatcgcatggaaacacattcctttattctcagcatgaatttcgcatgaaaccaagacttccatccaaacacactgaacataatttaattcattttctttcatacttcttacttcaccttcaattttttatgactatttctttcccactagcatttttctactactctgactccattgtacaatcaaggatttaaattccatttgttacattagtctcaaagccatttaagtaacgacatagcagtctgcttgctagaatgctatggtggatgctttagtcttccttcttttcaagagccatggtgctttgaagctttaagctcttatgtctttatgctctttatgtctttatgatctttaagttcttatgtctccatattttgattatttatttacatatcttttcctattaaactatgagttctttgagtgcaagaaatgggccttaaatgtacctttctgtcttctgtgtaagctctcaataatagctggctaagtgagaaaagaagaacatgattcctgatctcaagtagaatttagtctgatagggaacgtgagtcaggcaccttgaaaagttaaataatattaaagaagttaatacaatgtcaaaatatgagttgtctacagtggtgttgtccaacagaaacataactgaaagttttctagtagctacattaaaaaggtaaaaggtaacaagtaaaaataattttaatagtatatttatttaatcaagtatacccaaaatattatcatttcaacatttgactgatataaaatatttattatgatatacttcacattttttgtctttgaaattcagtatgtatatctagatagatagaaagttgatggatggatggatagatagatagacagatggatagatagatagataggtttttttgtttgtttgtttgtttgtttgtttttgagatggagtctccctctgtcacccaggctggagtgcagaggcatgatctcgactcactgcaacctccgtcttctggattcaaacaattctcctgcctcagcatcccaagtaactgggattacagatgcccaccaccacgcccagctaatttttgtattttcggtagagatggggtttcaccatgttggccaggctggactcaaactcctgagctcaagtgatccaccctccatggcctcccaaagtgctaggattacaggcatgagccactgcacccaccctgaaatacagtgtatattttacacttaaaggacaactcaattcagacacaatattttcatcagaaatacttgatctgtgctgagattacttacaatttacaattgaaaagtagattcacatgctcaagttgttccaaatacattttaaaacttttccaataatttgagtaccaaaacattatttttgtttaatattcatatgcacattgacaaaactggtttgttttttaaaaagaattgtttagactttgaagcaaaatcatatacctttaaaactatagctccccaagttaagtaaactcactaactgttaagtcaaccggttattaacattgaattcagactattgtgtaaattaaaaatcaactcctaatcaatcaatatcaacaaagcattcttcatgtttttcatgtagtttgtgcagccaatttatataaaactgtcaattacaattaaaatcttctgaatactgatttataaatatttgtaaaatctttagtattgtttagaagtataaaaaggtttaatttcaacagaagttctcatgcatgtctacctaatcacaaatatgctttttctttctattggagcttcaaatttatattattcacatgtagtgtggtatcagtgacagaatataaaccacattgtcatttcttttgtctttaattattaaatatatggtaaacatttattagtttcaagaaaatcttgaattggagttagcagcacaggaaattttgtaaaaagtcttccatgacttaatgcatgagctttggtcaaagaacttaagatcattagagtcctaatctcgtgtttctttcagcagtcctctaaacttgcagtgattcctagcatacacccatatgtactgaacaagcatacccattaaatatttcgaggagtctgtctgaaaaaactgcatacatactgtatgtatcatagcacagaatgaaagaagaaagaaaaattctcgttttaaaattccagtacactagagcagtttcatcacaatagaaattatttttttcataattagcttaaattcttctttggagatatgaaagaatcaaaaatatctatgccgtgcagttgtgaaaccacacttcttcatatctttggaagtaaatcctttgagacaaaaggcacccacattgctaattgaacactatctcttctattgcaagactcaactaaagtgaaaagaaagtgctttcaatttttccaatttggattcattagatcattgatacggttagaagggtcttgtattatgaagcaactgttcggttaattaagtgtagatatttcactttttataaaatacctttttaaggcttttctgcaagattggagaacagaagttccatatctgacacagtgactccttttacattccttcatctaaaaatggctttctttttcatacaaatatacaagccatttaatagctggccctagttacaaggtcagatttacttaaacattataatattttcattgtgatgattggactgttcatccttatttttgccaactaatttttttaattcttttttaacttgtaactgttgagaggaaagttattattaaattcactgtgtatttcctgaaaatacatctaaatattatccactttattaacataaaatcttttttcacaacagctttgaaagctttttaggttttgctctgccacaacaaattgcaattgccattcatcattgggacatatcttcttccaatttctgtctctcactctttctctctcttccagtcttctgggcatagtgctagcttctgcaactcttgattttaaatcagcaacatgccttcattttaaatctaaaaatatatgtccatacttactttttaacaagaaaaataatttaattatactacaattaaaatataatagatatccccaacatagtaccataattatacctaccttacaattagttactgtgactttggctgtctgtctcaacaactcgaatacattatactgttttatcagtgcttagaaaacatatttggaactgagtcagttcagtgatattgactagatggatgatgcgtttatctagaaatgaagtccatacccccatccaccctcacctcacatacattgtgatataataatgttttatgtggtacaacaaaaaaataaaatattgtcctaccaaaaaacagagttgtgtttaataaaaaatgttatttgcattgcttcagattctaaattcggagataaattaattaaaactaaataaaataacaaactcgatgtctcagtcataggaaccacatttctagtgctcagtagcctcaggtggtgagcagcctcccaactgaacagtgcagctgtaggctgtgcattccccaagattacgggttaaacataacatttttgttgtccaccatacccagcacataaacaattatggattgaatttggtatcctattgccatacatgattaaagtgagaacaaacatgtgtttgcaaatgcttcaagttcctaaagaagacttcgcaaaagaattgagactttaactggtattaaatatttaaaggcaaaaagcaacagagaaagtgcactttaagcagctaagtaacaaaccaaaacagagcacagatgggagaagaatgaggaaggtaaaaatctagaacgttagattgaggtcaggagcagaaagccagaagtggacattagccagttggtagtgcgggacttctaagaattgtaaacaggaaagttattatgaaagacacattttaggacttatcacgttagagtgatattattctaaatttttttttaggaggattcatctggcgactcagcaggttagtgaagaaaaagttagaagaatattaccctaaatcacggtcaggtgataagggtctgcattatgacagctggaactgaagtgaatgaaataaatgtgagcaccacaaaggaagtctcatcggggcttggctgaatataaagagagggaggaattaaaatgtgttctgtttttcatgtggtaagaagggattggtttacaattgtcccaatggtccttgtatccctgctaaggaaacatcataattatttatctttatttcccttcctaccaaattaagaaatcaaatttgaagaaaaaccatggctaatcacatatgtgaaggagtctctctgtcgctcaggctggagggcagtggcacaatcttggctcgctgcaacctccgccttctgggttcaagcgattctcctgcctcagcctcccgagtagctggaattacaggcgcgcactaacgcgtctggctaatttttgtatttttagtagagacggggttgcgttatgttgaccaggctggtcttgaactcctgacctcaggtgatccacccacctcggcctgccaaagtgctgggatttaaggtgtgaaccaccgtggctggtctgtggaggagacttctgtacaatagtgcacagggagctggagcgttgaagttttatgagcccacaagttatctgaggaataaggaaggggtcaagaaaaatgactcaggaagtagtcttcaaaaatgcacacagttcaggaactaaaagagaaagggaaataagaaaaggaagagacccagaaaaatgttgtgctatggcggtccaaccaggaaaaaaaaaagtgtcgtaaaaaggaaaaaattgagctgggcgcgatggctcatgcctgtaatcccagcactttgtgaggcctaggcgggcggattacctgaggtcaggagtttgagaccagcctgaccaacatggtgaaaccctgtctctattaaaaatacaaaaattagccgagcatggtggcaggcaaccgtaatcccagctactctgggaggctgaggcacgataatcgcctgaacctgggaggcagaggttgcagtgagctgagatcgtgccattgcactccatcctgggagaaaagaatgaacgaaagaaaagaaaagagaaaaaattggctgggcgcagtggctcatgcctgtaattccagtactttgggaggccaaggtggaaggattgtttgaggctgagagttcacgaccagcctgggcaacgtagtgagaccttgccactacaaaaactttcaaaaattagccgggtgtgatggctcctgcgagtgtggtcccagctacttgggaggctgagttgggaggatcacttgagcccaggagatcaaggctgaagtcagccatgattacgccactgcactcaagcctgggtgacagagcgggaccctgtctcaaaaaggcaaaaactgtcaatagtttaaaaaagcattggtataccagtaaggggcttacaactttgtttttttagactacagtttttcagtttgtggtcttttagcaatatttgctgatatttttctgtcctggctaattttttttcaaatgtaattctaagtacttatcaatttgtaaatatacattgttctctttcttaatgaataaaaggtaatctctccaactccaatcttaaacttttaagttatatgaaaaatttatacattttatgtgcttcatgaaaaaatatgaatttttaccatctactagaattaaaataccttagaagtagaaagtacttattttattctccacacatccttaaatagcccatgcaattacaaagtagttagtaagtatatgaactaaacaaaaatgattcatatatgagtaccaatatataaatatatgcatcctgaaacaggttaccattgacttctgaagaagaatgtgtaattctatcaaccattcaggtctacatcatttttttattcttagctgtaccacaggagactaaaccaataaatacagcaatttttaaaatcaattcacctggtattcaaggttttaattgtactttcttctcttctatagctattgctacaaatgtttaaagagtcaaatgaaaagattacattgaattaaacagtaaattcattttaaaatacagaaaaaatacaatactattgaaatgtcatataaattattttacatctggtgaaataaaatattacagaatattataaatggagacacacaaagccagatacatatgttaaaaaaaaattatgtatggactaatagataggaaatcatgctaaaatgaccacaccctgtatgtttaagtatgttggaactaggtagggttttttcatcttttcctgttttaccaaaatgtctatattgagggtaaccttctgtaaacaaatttgaatgtatacatttaaaaacaaagctctaaataacctttctaggttcgccttgcttctgaatcttctgcagtctgtttaaagcaactggcctgcacatgctgatgctctcacagatttaagagtttaagaagaaatccacaaattcaagcatatacatctaataagttaattgagtttttaatggcatttatttgtattttgataactagttagcaaatgaaaagtgcactggaaagaatgcattaaattacttaggtgaaggaatgacatacataaaaattgtcaaagggatgacggaggaaaataaaccagtttcattaaaccaacacctaacacatgcagtgaaaaaccccttgttctgatggcaatgaacgttgtatttctatcttaatactttgcattacgactgtccaatgcattgtatagttttcaaggacccaatcatactcttaaagtacttccttaataagaggtaaattatataatagtagaacacagctgtgtttgctacaaaaattcaataaaacaatttaataatcttcataaagtatttatctacttgagtgaattaactaagtactcaatagaaattgctttagttctccacagccatttactcatgtggtatatcctctgtgcacatttctcaagtgctcctctgaggtgtggacagcattccacacacattggacaaagactgctgaaccagccgaaatctacagatgaagactccataaaagtaacaagcaaggaaaaataaactacatgacatgccttgattccatgtctcttttcgtcatgttatatatttttcttgtgaaataaggtttggaagaatctgagggccaaaactgaaaccaaaaagtacatggcaaaaaataacatataaataactcttaaaatatgagggaaaacataaaaatataaaaaccagatgaagaaaataggcaaagggcacaaataactcccctgcctcctcactccccagttctctctctctctctcgcactctctctctctctcacaaagacatataaagaaatgatactcaaacttatgaaaaggtgttcaacctcacttaaacacatgaaaagatgttcaacacaagagaaacaaaaataaacagacatcatgtatggcatctatcacattctcaaatatcattacacactgtcaacaagactatggcaaacgggttctatggtacattactggttctgtcatacataattgcatacacacatgcaaaatggtgaaatctacatggagcagaatttagcaataactcacaaaacaacatatccatttaccttttgctgcagcaatctcatttttctagaaattaatgctaaacgtatatctccaacaatacaaaaacatacgaattagggttttcactgtggcactatgtctaaactgcaaaatactagaaacaacctcattgctcataaataggagaagagttgaataaactacattacatccacacaatgaaatactctaccactggaaagaatagataggtctgtaatttttgatatggcatgatttttaacatacttattaaatgataaaagcaaaaaaaagtatgcaacttttattttaaaaagagaagaggagagatatatatgtatttacttctttgtacagaaaaaaacctgggaaggtaggaaggaagtgtaaatctaaaattaatgtcatgcactaccacaaaagggtaggggaaatgagaaaataaatcaagaggagaataagatttatctgagcatatctttttatataaactttacttttgaacatgttactactttcacagtcccaaaaataaaacaacgttcacaagaattggagaaaaaaactaaaatagcacaccagtcagaaaaaaatgagcctatatagctatatcaaattaataaagtaatcatatagaaaaatattaaatcaagtaacttgattataccctaagtgggatatatcctgattattccctaagtgggatatattctaaaaacagaaagggcatatagtctaaagacagaaaggactgccaagaaatcatgaactttacttggttagtttgctgttgatgtgatatcagcggagcaattctgaaaatattttttgtattatagataagagtcaatggtatgtacgttgatattgtcgaacaagatatggaaatggaaaggaagaattctatatattgaatgaaaattctagatatcagtctgaactactcactctcaatagatggataattgacaggtagatttatatgaaagatttataaatagatttatatatagtctagaagcagtgacacctgcagtagcaataagcacatcggtcagaagaagaagagtacaatgagagaacagaacattttgttttgccacaaagtaagaaagtgccccaaaacaagatccaagggttaccattagcaaaatgtggctgaacttcagtaaaaaataatgatcaaaacaatatattataaggcataaaattttaaaataaatagagttctgggccgggcgcagtggcccacgcctgtaattccagcactttgggaggccgaagctggtggatcacttgaggtcaggagttcaacaccaacctgaccaacatgacaaaaccctgtctctactaaaaatacaaaattagctgggtgtgttggtacatgcctataatcccagctacttgagaggctgagataggagaatcgcttgaacccgggaggcagaggttgcagtgagcagagatcgtgccatcgcactccagcctgggcaacaagggcaaaacttcgtctcaaatatataaataaacaaataaataaagttctgaatgattgatattcaaaaaaggcagggaaaggaaggaaagcacactcttcttgacaaaagaatgacagctaatacgtccagaagaaattctggaattagaaaattactgttttggaattcccagtggaatcattgattcaggcaacaatcatcaatgtatgctaaaaccattgggtcaaattttcttgtaaaacaggatattcatatcatttaaaggtcttaccccaaaaacgatgaactaattacacagtgtagaaagttgtttttatggaagaataccaagtgatcaaatgtaacagtaataggacaagctgatattatttgcttcctaatgtaacccactggtaagaacaccatttcacctatgactattcttcccaaaaaatgtttcaaagagaatctggtaatgaggaaacaatcaaagaaatcctaatcatagacatatgtaattgtgggacaatgcacaaaaccactgcacaaaatcagtgtcacaaagggcgtatgtggaagagccattctagaacaaagagtctaaagagacataacaacaaaacccagtatttgattggcttctaaatccaaaatttaaaaaataaactaaaaaggatattttgtgggaaattggaataggagctttcacaaaattattgaattgatacacctgtgattgcaaaataatcaatatactgtcttaattatgagggagagaaaataaaagtaatttaatataaaataacatataagtcaatattttgttatgaacgtacaaatatatttgaatttgaatacatgataagacagtcagatgtttgtccctgaatacagacttatcatgggtgaaacagctgtacatggagtctactatcagtgtgctgtgttaacacaagcgccatgaatgacacgcatgttactgcctttagttttcgcagtagggaacaatgactgggaaaattccaaacaaaacacaacacaaacttctttcattttacattgtagttgcattgctaataaaaatcagtaaaacataaaatcttgcaaaatatactctgcaattatatatttaaaatacctccgttctaggctctgaaaattataaagttttctaagtacatgaatgtctggtggtgtatttttaaaaattgtacaaaatcaagactattatttgctgggcaagacagtcctcattgcaggatgttgagcatacctgggcccttcccactatatactaaaggtgccctaaggtaggtgggagccaactctgaggtggagatcaatatgcaggactttattaaaaagtgttcttggtttcaacacagtggaagggaaggaagtaagattgggcagagagggaaattagtctccatgaagtcctcagattatcccatgggacattctgaagtgaggagccttccagcatggacagagtattgggccaggatacgcccagatcagttattggatgtgggctgctctgggaatagggtgggttcttggacaaggtgcctgttgtgagcagagagaatcctgaagagagctgacagctgagagctatcagacggcagcacagccagcagctggagtgacaatcctccacgcctgaagggggagctgggtacagataacaaagtccactatacattcctaagaagtatgacaataaaagtaaaagccaatgttttaatctatataaaatgtaactgtattttccaccgaaagtgtaggacactcttaagatttttttaaatttttgtaaagatgattttttagtttccttccccatcaccccttgtacacacacaaacccacatgcacaatacacacacacctcttagatttggaattggaacgacattaaattcataaattaattgacaagaaaattgtcttctcattcgggaaaatggcagaggttttcacttaattataactaaataaaatagacattaatagtttaaaaaaccctgataactgctaataaaggagaagtcccttaatttactgtaagttatctgcaaaagaattcagtttttgcagattcacctactggctgaaatttgtcacccaaaatcagttctgcactgttgcagacattgacaggcacctgtagagcagtgcaaaatttgactcaccaatcctcacgttctcagctgaaggtgaacagaccttgctttgcctttttgtttcagtgctcatactgtaaaaaagtgtcctttccaccgggcgcggtggctcacgcctgtaatcccagcactttgggaggcagaggcgggcggatcacgaggtcaggagatcgaaaccatcctggctaacacggtgaaaccccgtctgtactgtgaatacaaaaaattagccgggcgtggtggcgggtgcctatagtcccagctactcgggaggctgaggcaggaaaatggcgcgaacccgggaggcggagcttgcagttagccgagatcgcgccactgcactccagcctgggcgacagagcgagactccgtctcagaaaaaaaaaataaaataaaataagtgtcctttccttggtttgtttagtgccacattgttgtatttttattggcgattatactgtttaaaacagcccccaagcatactgctgaagtgctatctactgttacaaagccagaaagctgtgatatgccttatgtagaaaaatatgtgccacataaactttatttaggcatcagttacggtgtcgaatgccatgagttcaatgctaatgaatcaataatatatattaaacaagattacgtggatatattgatttaaaaagttgtgatcagaggtgcacagcaacttaaccttgtatttctccttggagcaatgattcagcattcactaatccaatgtttgtcactaccttataggatataacttacaacatcttatggaatagaactactatgaataatgataatgaaatgtataagggttagaaaggaaagaatgaaacagtccttatttgcaaatgatattagtattaacatagaaaatccaaaataatccataaggattataattaataagtacatttaataagtaaattaataagtaatatttctatttacaaatttattatataaaaatcaattatggggggagggataaaagactataatttgggttcagtgtatactgctcaggtgataggtacaccaaaatctcacaaatcaccactaaagaatttactcatgtaaccaaacaccacctgttccccccaaaacctatggaaataaaaaaataaaaataaatacaaattaaaaaataattttaaaagtcaatttcatttctatgtaacacaaaatagaaacgtaaaatttaaaaacacatcacttataatagcgtcaaacaattaccaatagttggaataaatctaacaaaagtcatgtaagatcactacaaaaataactataagacgttgataaagaaatttaaaacctcagaatcaaagagtgtactatgtacgtgaattggaaaactcaatcatgttaccatattgattctctgcaaatttatctatagcttcagtaaattgtcaatcaaaatcctagcaagattttttatagaatatgtcaagatgatcttaaaatatatatgaaaatgcaaaagtccaggaaaaaaccaaaattgtcttatggaaaaagaataaagttagaagagttgtgttatgataaatcaatagttgactggtaatattaactggcaatactaaaatagtataagattggtgcaaagctaccaaaatagactatgaaacaaaacagagagtctaaaaacagacctgcacatatgtgaacacttgatttttgtgagaagtggcactgcaaagcaatagggaaatggtattttttttcaatagatggtgctatttaaatgtacattaaaatagaaaaaaatagaaacttgactcctaacattgtactttttataaaaatcaattccacatttgctatagagctaaatataaaagggtatataataaagcttctggaagatattatagaagaatatctctatgaccttatggttagcaaaaactccataatgaaaacacaataatgcaaaagtcataaaataaagtagagaaattaagcttcattaaaatttaataattctgtttaccaaatgataaaattaaggaagtgaaaaattgatccataggttgggtatatatatctgcaattcatatattagcaaaaggttgatttgtagctgtaatatataagaactcttgtaaatcaataagaaacaaaatttaacagtaaaagagaacagtcaaatggtcaaaaaacgaaaacaaaataaagcaaacaatgaaaatgtgcttatttctcatttgtcagcaggaaaatgcaaataaaatcacagtaaatgccattacatcttcactagagtggctaaaattaaaacaactgatgataattgcagaatagatgaaattctcacagactgctggtgggagtgcaaattggtacaatcacctgtaagaagtgtttatcagcatctaccaaatctgaatatatgcaggaatacttaccctataacccagcaaatccacagcccactcctaaataaccagtagaaatgtatacacatattccaaaatgtatataaaagaacaaatgtccataagcagtagaatggttaaattgtggtatacatggtaattgaaaactatacagcatgaaaatggaaaaaaaaaaaaaaaaagccctggtatttgaaaaaaaaaagcataataatcttacaaacatattattcaaaataacaagatacaaaaacaacacaagctgcatgattccatttattaaagccaaacacaagcggaagtaatctgtgatgttagaggtcaatgttacaggtcaggagagtggtcacctctgaggagaaagaagggcatgcaattggcataaggcagaggagcttctgaaatgctgcctgtattcattcctgatctaagtgttggttacttgagtttattttctttgtaatatgccatcaatctattataatttgtacatgtttctgattgtgttttgtttccattttaaaaatttaaactaataattattgttccatacaaaccatcctcatcagtgcccaggtccacacactttctctttttctgcatacatccaattccaaacatgatacatgtagtcccatacaaatattctatgctcaattgaaaataaataatacactattgtcttttcaaggagacaccaacagtcatgtccagtttctgggttctgtgctgagtttaagagctctaggggcgtgaattcttcttggttagttccaattgtggttcctcatggcccaagaagtagtcaatggtcccaattaatgagaaatcttatcatcccaacacactcaaagtaccaccttcaaagataacaatatcctcatcataataagagcttcccttgaaaaatagagaagaggaagagccgcagagtgctgattggtctgtgatactcatccccgtgggaaggaagggtaatgattccttgctctacagtaaaatgaggcccccagaggcaatctggttggttacagttgttcttgctctgaagactttcttgacacacctgaagggaccctgggggtgggggagtggggagtcaggggcagagggatgggggatgattctcttctggggctgcatggctttaggacctttcttccttttggcatacttggaagagctgatgattgcttttgattataagcactcaagactctctttttagattttggcatttcctagcaataagtcccttaaaaattcaatttgatgatgaactttaattcattccacaaatatttactgagtgcatatgattgtctaggctttattctagatacttgggatatatcagggaacaaaacaaatgtaaatactaaacccaaggagattgtgttctggagggagcaggctgagattcaacaaacaacacaataataagtaaattatatgctgtagaaggtaattagtgccggtaataaagaagaagtaaagcatgacctaccatagaaaggaaggttggaattggaggacagcaagatggtggaaggggaaatggtaaaagtttagtattaatattgtcagtagaggccactttgcaaaggtgaaatttaagcaaagacttgagttagagagggagtcagccaagcagttatctgaggcaagagaatccaaaggagtggaaaacataacaaacataccctaaggggaagcatgattgacctgtctaaggattgtaaagggtcatggtggctggaggaaatgagggcaggttgaacaagaagtatgaggaagtagcaaatgcaaaagaactgaaaccataacaaacagtctcttgggccacagctcaaacaaattagaattcaagattaagaaatgcactcaaaaccacacaaccacatggacattgaacaatctacttctgaatgactcctgggtaaataatgaaattaaggcagaaatccagttctttgaaaccaatgagaacaaagagacaatataccagaatctctgggatacagctaaagcagtgttaagagggaaattgatagcactaaatgcccacatcaaaaagctagaaagatctcaaagtgataccctaacatcacaactaaaagaactagagagccatgagcaaacaaaccccaaagatagcagaggccaagaaataatcaaaagcagagatgaactgaaggagataaggacatgaaaacccgttcaaaaaatcagtgaatccaggagctggtttttttgaaaaaataaaataaaatagaccattagctagactaataaagaagaaaagagagaaaaatcaagtagacacaacaaaaaataataaagggaatatcaccactgaccccaagaaaatacaaacaaccatcagagaacactataaacatctctatgtaaataaactaaaaaatcaagaagaaatggataaattcctggacacatacaccctcccaggactgaaccaggaagaagttgaatctctgaataggccaataataaggtctgaaattgaagcagtaatgtataaccttccaaccaaaaaaaacaaaaaaagcccaggatcagatggatttacagctgaattctaccagaggtacaaagaggagctggtaccatttcttttgaaactattccaaacaattgaaaaggagggactcattcctaattcactttatgaggccagcatcatcctgatatcaaaacctggcagagatacagcaaaaaaagaaaaattcaggccaatatacctgatgaacattgatgcaaaaatcatcaataaaatactggcaaactgaatccaacaacagcatatcaaaaagtttatccaccacaattaagtcagctttatccccaggatgcaaggctggctcaacatgtgcaaatcaattaatgtaattcatcacataaagagaactaaagacaaaaaccacatgattattgcattagatacagaaaaggccttcaataaaattaaacatcctttcatgttaaaaactgtcaataaactaggtattgatggaacatgcctcaaaataataagagccatttatggcaaacccacagccagtatactgaatgggcaaaagctggacgcattctccttgaaaactggcacaagacaaagatgaactctctcaccactcctatttaacatagtaatagaagttctggtcagggcaatcaaacaggagaaagaaataaagcatattcacataggaagagaggaagtcaaactgtctctgtttgtcaatgacacaatcctacatctagaaaacctcatcatctcagcccaaaagcttcttaaggtgataagcaacttcagcagtctcaggatacaaaattaatgtgccaaaatcacaagcattcctatacaccaacaatagagaagcaaagagccaaatcataaattaactcccattcacaattgctacaaagagaataaaatacctaggaatacagctaacgagggaagtgaaggacctcttcaaggagagctacaaacctctgctcaaggaaatcagagaggacacaaatgaatgggaaaatattccatgcccatggacaggaagaatcaatattgtgaaaatggccatactgcccaaggtaatttatagattcaatgctattcccattaaactaccattgatattctccacagaattagaaaaaaaactttaaatttcacatggaaccaaaaaagagaccttatagacaagataatcctaagcaaaaagaacaaagctggaggcatcacactacatgacttcaaattatacgacaaggctacagtaaccagtaaccaaagcagcatgttactggtacaaaaacagatacatggcccaatggcacagaatagaaatctcagaaataagatggcacagccacaccatctgatcttcaacaaacctgacaaaaacaagcaatgacaaaaggattcccttttcagtgctggaagaactggacagccacacgcagaaaattgaaaccagatcccttccttacaccttatacaaaaattaactcaagatggattaaagacttaattatccatttggataactaaagactctagttatccatttgtctaatcttttttcaaggtaaaacctaaaattgtaaaaaccctagaagacaatctaggcaataccattcaggacataggcacaggcaaagatttcatgatgaaaatgtcaaaagcaatggcaaccaaagcaaaaattgacaaatgggatataattaaactaaagagcttctgcacagcaaaagaaactatcatcagagtgaacagaaaacctacagaatgggagaaaatttttgcaatctatccatctgacaaaggtctaatatccagaatctacaaggaacttaaacacatttacaagaaaaaaaaaagacattacaaagtgagcaaaggacatgaacagacacttcccaaaagaagacatttacgtggacaacaaatgtgacaaagagctcaacatctctgattatcagagaaatgaaaatcaaaaccacaatgagataccatctaacaccagtcagaatggcaattataaaaaagtcaagaaacaacagatgctggtgaggctgtggagaaataggaactcttttatatggtgatttctgcatttccaactgaggtacctggttcatctcattgggactggttggacagtgagtgcagcccatggagggcaagccaaagcagggtggggcattgcctcacccaggaagtgcaaggggtcggaggatttctctttcctagccaagggaagccgtgacagagtgtacctggaaaatcaggacactcccacccaaatactgtgcttttccaacagtcatagcaaatggcacaccaggagattatatcccgtgcatggctcagcaggtccgacgcccatgcagccttgctcactgctagcccagcagtctgaggtcgacctgcaaggcagcaggctccaccatggctgaggcttgagtaagtaaacaaagtggccggggaagctcaaactgggtggagcccactgcagttctgcaaggcctactgcccacctctggggcagggcatagctgaacaaaaggcagcagaaacttctgcagacttaaatgtccctgtctgacagctctgaagagagcagtggttctcccagcatggcgtttgaactcagagaatggacagactgcctccttaagtgggtctgtgacccctgtgtagcctaactgggagacacctcccagtagtggccaactgccacttcacacaggtgggtgcccctctgggacaaagcttccagaggaaggatcaggcagcaatatttgctgttctgcaatatttgctgttctgcagcctctgctgatgatacccaggcaaacagggtctacagtggacctccagcaaattccaacggacctgcagctgaggtacctgactcttagaaggaaaactaacaaacagaaaggaatagcatcaacatcaacaaaaaggacatccacaccaaaagcccacaggtcaccagcatcaaagaccaaaggtagataaaaccacaaagatggggagaaaccagaggagaaagctgaaaattctaaaaaccagagcacctcttctcctccaaaggatcacagctcctcgccagcaacagaacaaagctggacagagaatgactttgatgagctgacagaagtaggcttcagaaggtcggtaataacaaacttttccaagctaaagaaggatattagaatccatcacaaggaagctaaaaaccttgaaaaaagattagacaaatggataactagagtaaacagtgtagagaagaccttaaatgacctaatggagctgaaaaccatggcatgagaactatgggatgcatgcacaagcttcaataaccaattcaataaagtggaagaaagggtatcagtaattgaagatcaaattaatgaaataaagcaagaggagaggtttagagaaaaaagagtaaaagaaacgaacagagcctccaagaaatatgggactatgtgaaaagaccaaatatatgttctattagtgtactggcaagtgacagggagaatggaaccaagttggaaaatacttgtcaggatattatccaggagaacttccccaacctagcaaggcaggccaacattcaaattcaggaaatacagagaacaacacaaagatactcctcaagaagaacaaccccaagacacataattgtcagattcaccaaggttgaaatgaaggaaaaaatgctaagggcagccagagagaaaggtcgggttacccacaaagggaagcccatcagactaacagcagatctctcagcagaaactctacaagccagaagagagtgggggccaatattcaacattcttaaagaaaagaattttcaacccataatttcatatccagccaaactaagcttcaaaagtgaaggagaaataaaatcctttacagacaagcaaatgctgagagattttgtcaccaccaggcctgccttaaaagagctcctgaaggaagcactaaacatggaaaggaacaaccggtaccagccattgcaaaaacatgccaaattgtaaagaccatcgatgctaggaagaaatcacatcaactaacgggcaaaataactagctagcatcataatgacatgatcaaattcacacataacaatattaactttaagtgtaaatgggctaaatgtcccaattaaaagacacaaactggcaaattggataaacagtcaagacccatcagtgtgctgtatccaggagacccatctcatgtgcagagacacacataggctcaaaataaagggatggaggaagatctaccaagcaaatggaaagcaaaaaaaagcaggggttgcagtcctaatctctgataaaacagaatttaaaccaataaagatcaaaagagacaaggccattacataatggtaaagggatcaatccaacaagaagactaactatcctaaatatatatatgcacccaatacaggagcacccagattcataaagcaaatccttagagacccacaaagagacttagactcccacacaataataatgggagactttaacacccactgtcaatattagacagatcaatgagacagaaggttaacaaggatatccaggacttgaactcaagtctgcaccaaccggacctaatagacatctacagaactctccaccccaaatcaacagaatatacattcttctcagcaccacattgcacttattccaaaattgaccacataattggaagtaaagcactcctcagcaaatgtaaaagaacagaaatcacaacaaactgtctctcagaccacagtgcaatcaaattagaactcaggattaagaaactcactcaaaaccacacgactacatgggaactgaacaacctgctcctgagtgactactgggtaaataacaaaatgaaggcagaaataaaaatgttctttgaaaccaatgagaacaaagacacaacgtaccagaatctctcgggcacatttaaagcagtgtgtagagggaaatttatagcactaaatgcctacaagagaaagcaggaaatatctaaaatcgacaccctaacatcacaattaaaagaactagagaagcaacagcaaacacattcaaaagctagcagaaggcaagaaataactaagatcagagcagaactgaaggagatagagacacaaaaaaacccttcaaaaaatcaatgaatccaggagctggttttttgaaaagatcaacaaaattgatagaccactagcaagactaataaagaagaaaagagagaagaatcaaatagatgcaataaaaaatgataaaggggatatcaccaccgatcccacagaaatacaaactaccatcagagaatactataaacacttctacgcaaataaactagaaaatctacaacaaatggataaattcctggacacaaacaccctcccaagactaaaccaggaagaagttgaatctctgaatagaccaataacagactctaaaattgaggcaataattaatagccttccatcagaaaaaagtccaggaccaaatcgattcacagccacatgcacacgtatgtttattgcggcactattcacaatagcaaagacttggaaccaacccaaatgtccatcagtgatagactggattaagaaaatgtggcatatatacaccatggaatactatgcagccataaaaaaggatgagttcatgtcctttgtagggacatggatgaagctggaaaccatcattctgagcaaactatcacaaggacagaaaaccaaacaccgcatgttctcactcataggtgggaattgaacaagaatacttggacacaggaaggggaacatcacacacaggggcctgtcatggggtggggggcagggggagggatagcattaggagaaatatctaatgtaaatgacgagttaacgggtgcagcaaaccaacatggcacatgtatacctatgtaaaaaacctgcacgttgtgcacatgtaacctagaacttaaagtataacaaagaaaaaaaaagttcataccacctgggaggctgaggttgtagtgagctgaggtctagccactgcactccagcctagagacagagcaagactccatctcaaaaaaaaaaaaaaaaagttcatgccttctctcctagcaattctgccataactgctcttaatcacagtattatgtgtaatggagaaaaatggcaacagcatacatgtctgatggtgatggctgaaatgaactgttacatcataaaaactaaaaaataataatcatgtaaagattttaacacattatctgtcacacaggaaagactcaaaggtttgttctaagtattactgttattagtttattaataagaattgctcttgggcagatgagaataattgcaaaaagaccctaaatattttaagtgtagactgtcattataattcataattcctaataagtcatgccattaaatgccacaagtaattttaataccattcatttatagttttaaatgtaaaagtgagaaagccaaagaaatactgagctattcagaagacaaattgttgtgtaacatatcacattaatataaagtgtgacttaaaatatacctacccatgtcttaattataagaaatttaataaatcagttgaaaactattttaagtgctattgacaaagactcttccttgacctaactctaagtcagacttttgggcttttgggttcatctggtttagtccagttctagcaagaatcctgctggatcaggttagcaaaaatccaccacccttgatatctgatcgaattccccacttctcccaccctcagtatcttatcactctggcctgccttcagcaatcatcctggcaagtgggcttagcgagcattattctcacccctgatgtttcctcttagtaattttctatccgcttgacgacctcaccccccaacccaactccttggctagaaatctccacttgtctttattgtatttggagttgagactgatctctctcttaccacaaaacccgtttgtagtagggaagtcttctctaccgtctttatcaagtgtcatgaataatatttttctgtaacatagacgtgccagaaaatgtgcttcattttacaaaaggtctgtgttaaggaaccaacttctgttaaatgatgaggatgctatttgcactttctgataacaatgaaatattgtgcaattagcatagaggactatttgagtggattgagggatgaactgcataatgagaagctaattacagggagagatcctctctgcagatatttgtagaatattttcgttttgacaaaaatgcagaatatttatctggcatttacataaatcagttgatgtctgggatgaaattgtacaggaaaagattgttatcctaaaccaagaggaagtattctctgtgcccgttatttcataattaaatttcatgttctcttgtaatcaaccaaaatataaatattgattttgccacctgtgtttttaagtacagctgagaaagacttatctgaaatcgtttttcacccgaaagtatgtgtaatctgtggactgttaaggaactattttctaactcttgaagtttgtgataaacaattttttgcccatgagacaataagttagaatcactaaatgagtaaaacacttagtttacattatcttccctgtatttaatgactcaatctctgtttctgtgtgtttaaaaatttctcaaaaaatacgacaacagcaacacattcccgcctctcttggctccaccctatccaaccccctcaagaagctcaatagtcactagaaccttctgaagttgacccaggaaagctaggctataataaacaaaccatgaatatcgatgaggcacatactttgaaatttatgttacttttaataagtttaggttttaattaaatgaatttagaaactgattgtggtgtataggtttataattgattattgtatattacaaagcaaaaatcaggttccatagtctaacaccagtttgacaatgggcagaagatatgacatccagactgctcccagaatatctcttttgaatgttcatgataaatacgtttgaaatttattataaataactgtaacataaatttatttttatacaataccttgcaatttccaaattacctctgcatatgttattgccttcctcactacactgtgagcatcttaagaacagagatttctgttcatctatattatagccttaagtttctcgggttccatgggtaccctcttgcaagttcctgaggtgctacttggtagccccaaacattcctcctcattaatccagatcccaattttacacgctcttctattgacttctaaatttaataatcccagtctttttttctttttcccaagccctaggggaaaacctgcttcctgcagttaccacctttgccctatgatttgaatgtgtcctctccaaaattcaggtgttgaaacttaatggccaatgtgatgatagtaagaggtggaacctttaagaggtgattagatcttgagggctcctccatcataagtggtattaagacccttatagaaggggcttcatgcattgttccggctcatttgcctttctgccttcctccatgtgaggacaccatgttcctcttctcctgaggatgcatagcaaggctccatcttggaagcagagagcagccctcaccagaaaccccaacctgacaatgccttgatcttagatttcctagccatcagaagtgtgaggaataaatttctgtttttcataaactattcagtctcatgtattttgttatagcagcactaaaacactctttgaatcactacttttacctgtttaaatgttcagttccctaaaaagtgattggtaattcttcatattaaagtctgttaaactaactggtatgatttttctttcttgattggaccctgactaacagaagagagagaattgcaatactgtcagaaagactggaatgattgtattggctgagtttattattttgaaatcttaacactgcactttacatccaggtctgtcagaaagactggaatgattgtattggctgagtttattattttgaaagcttaacactgcactttacatccaggtctttgtacataaatcctttttttaatggacttttccactggaaacttgctattgagttgcatcaactcgaacatcccacttcttcaattggtgaacactttagggcttctaataattattatacattttctgatactggctaatttttttgaaaacagatgcctgcggcttcagttttactacctcgttttgtgagtgacactgtaaaacttttttgttcttatggccaagaggagaaagagaaataaatgaagaaactaacacaaacttatttcctttagtccctttccttaatgaaaaggaaaagaaatacacaacaccaacagtccaagcctggttatcagctgcattgtagaagaaatggtcagatgaataggtcttttgcttgttagggagttttattgagcacttcggaaaaaaaactcagttctctgtgtattgaaatggaaaaacagtgtccaacgtcaaggtctctcttgaaagaaaatgtttcaaatattctgaaaaaatgtttctgaggggtcagtttctgaagctagctgatttagtttcttttgacctaaaaacaggcaaatactatggggagtaaggtattgcacacactgcttttaaaaacatagttttgttgtggcctaactcatgttggccaaataattcctatttataaacagtccaccaagtcccatctataaacaatctaccaaagttgtgactagatagaaagactaagcattatcatttttatggtcctccttgcaatattccctcttttccccattacaaccaattattcttctttttagaaaaattttctgtaattaacattttcaaggaaagtcttaaaatgctttcaaatcactactttctaagaaaagaataaacctctgaaaatcacatgactttcttatacctccagttccaaatgcagcgtccacactatatctctcttattcaataagcatttttagtcacctactatgtgccaggcctgtgtcactgcgccaagggctgaaaacagagaaaacccagacctagacctgcctcaagaagctcacagccttttaagttggataaatggctatgcaaggcaatgagatatgatgactacctaaagagatgaacaaatagctatgaaagtccaggagagggaaagatacatctcaagtggggaagatcagaattggaagaggtgacatttggattaacttaatgccagtgtatttcatcacacagacacatgggtggcatgttaactgtcacaggatggatgaggcttacctgagttaaggcttaaaataagatctacccacaagacaggaactgaacttagggaaattaacctagttctaggttctctttcttagagtgtggcccagcagtaattgtatcagaaagacttgcctacttcttaaaaatgtagattcctatgaccaattcccagggtttctgatttattgactggagtgagtgaatgcaaaaatctatttaactcatgatgcagttgatcactatcctgtctaaatttgcaaggatttgtcaagcaacaggtgggagtgcagaaagctcaagttagggacatccgatataataaaattagatattctgacagacaggtggagacagagcaaggacagtgccagggaacccaggagcaggcaagattgcatatccaaagagacctgcagcaaggcgtcctgtcccctccatattgccctgggtattgggatttcaagtttaggactttcttccaggtgagaatatagggaaaaagccaattggagataacaaagtaaatcacacagttttgcggtgtgtgtgtgtgtgtgtgtttttgagacagagtctcactctgtcacccaggctggagtgcagtggcacagtctcagctcactgcaacctctgcctcctgggttcaagtgactctcccgattctcctgcctcaacctcccgaatagctgggattacaggtgtgcgctgccatgcctggctaatttttgtatttttagtagagatagggttttgccatgttggccaggctggtctcaaattcctggcctccagagatctgcccaccttggcctttcaaagtgctgggattacaggcatgtgccactgtgcctggccaatggcacagttttaaagttttctaggcagtgtgtcaaaaaaaggatgtgggcactaatcgaacttacccatgatttggttcctaggaatgggggcaagatgaaaatgccagaatctagttatgagaagcaagaccagaagcatatctttttctggttttaattctggttctttaatattaggttggtgcaaaagtaattgtgggttttgctatagaaagtaaaggtaaaaaccgtaatgactgttgcaccaacctaaatagaatcacctaagaagctttataaaaacatgtactcctaagattcacactggacttagaaaatcagaatggttaagacagaaatgtgaatttttataagctcttctaggtaattctggaaattattcaagtttaaaaagcaataaacaaggactccttttctctgcccacaacaaccacagcccccaccaatcacaggtcacaaacagagcctgcagtaggaatcttgtggcagatactgggaagaaaagaagcctgtggatcaagcagttaacataaaaatctcacggcaagaagaaatgctagcttgcaagttctgtgagtcttgcagcaaacaagatatttccagcacagaatgccagcaaagtttcttgttgctgttgttttgttttattatagtatttaaaatagttcttcagcatatcaatacttaaaatagtaaaaatcccattgtccctgtcttagtgtgctccagttgctgcaacaagatatcataaactgagtggcttataaagaacagaaatgtatttttaacagttctggaagctgggaagtccaagatcaaagtgccagtagatttggtgtttctggacacccaatccacattgggaggacctaatcagcttacaaaggcccatctcctaataccttcaggttggaggttaggatttgagcatttgagcattagaatttcaaggggacacattcagaccaaagcaggtccattctcttactccagctcaacagaagaatctcatttacagacatcactgagccttctccctgtctgaatttttttttcacctagtgactattgacaaagagcaatattgaatatgatactaacttcaaccaaacaacattggcagcatgtagagtatttgctcattccatggtctcatgtcacatcacgctatttttaaatcaaattctgcttttaatctttagttttaatttacctttatctgaaatataaatgtaattaatcacgtagaaggaaagtaggagctagcaggatagtaatctagctaagctgcaagcaagtgaagcttttttgtaaggaaagagctgtagaatcacaagacaatctgtatcacaaaccagcaaatatatgctaaacagtgtctaatttcacggggtgcctcccagttgaaattgagccaggccacctgattccttattccactggtaaagaccatctcatgtgaaccagctgccatggatgtggttcagaaagctgtccctgaaaagaactctgggccatctgtgcttacagtgctattaatagaatgttctccaaatcatagaccttcatctgcaacctcacatcaagactttctcaaacatgagacccggagaacatcactcatcagcattctttgtgatctattgggaagcaccatgatttgaaggcaagggtcaaaggtggggtgggagccggatgagactgtgaactctctgaagccaggggcattccttttcccccttaccttgccagggtcaggccctgtgatgacacaattgtgtgttgagttgtactgaagcattttgtaagtgccaagccagtggaagcagctttacaaggttattacataatgggaaaagtcgtgttcattattaaaggaagatgaggaaagggaggttcatcagttaagtaacttccccacgttgacacatcctgagtagtagggccaagattcagacacgggttctctgactccacacctgaatttgatggcctgcaccgtctcatacgtttttgttttccgttcattttggttgtacttgggaacttcgactttgattgtgatttatttttcttgagccaacgctgatggagttttttatgactctagagaaaggtgaaatgactaatacaaggaagctgaaatagcaataacatttcttaaaattaattgttaagaaatatagaggcttaaaccatatagaaataatagcagatgacatgagacaccagatggagttcacctaggcacacaatgcctgcttgataaacttaagagaaattgtagaacacactaaaagaaaaaaatggaaaaaatagtcataatgtttagatctttaaaaaaaaatattttgctaaggccatcattttctctttaagaccatagaaaattagtggctaccagaaacattgcaaagataactaaagatattgatgtgaaacatggaagcagcatcctcttacttaatgtgctgctaacgaaataaatataagtaaaccaaggctgactacatatcccttatgttattttttcaccatggttctaatcttaagaacatcaaatatatgagacatgatgagtgacaatgacaaagatactttgcaatacagtctaaaccaaagcatatggcatgtgacatatatagatatgtatagatccatttattgatatgtgtgtatatatatctatgtatctgtatctcatatgacatgtaataatatactgccaagaacaagagtagaagttattaaaatatgttaaaaaaaaactaatacgaaagttaggatacaagtcaagagaacaaataatctaagaaaaatgggaatatagtttcttcagttgtttattcatatgccagacagtgctaagtgttagaggttaaggatgtgtaacatctagttcacttctatatatgcttacagtttggtaaagaagataaaaatctgttaagcaatgccttacactagtggaaaaattagaaaagatttccagattgggtgcagtggttcacacctgtaatcccagaactttgggaggccgaggcaggcagatcacctgaggcaaagagttcaagaccagcctggctaacatggtgaaaccccatctctactaaaaatacaaaaattaaccgggtgtaatggcgcatgcctatagtcccagctagagttcaagaatcacttgaatccaggaggcagagattgcagtgatccaagattgccccactgcactctagcctgggcgacagagggagactctgtctcaaacaaacaaacaaacaaacaacaacagaaagacttccaagagattgtaaacaaacatgtaaagtagaaaattagaccaatgagaatccttgaagtatattttgaagagttaaaaaagcccaaaaaacaaaaaggagaaaataaatgatttaaatgtctatttttaaatgtaagacaaaggcaataaagctgttcctgtaaccaaatttctgtttagtagctctgtattgttaccacaacataccaatgagaactctggttccacggaggaaaaccttttctatgaccctctagaatagcaaactcaatgccaatgggggaattacagagttcttttatggtttcctgtgttttgtctgtcaatattaatgctaaggacattaattgagatacatgcttctaattccccttacttgtatagaagtactgtagattagagaaaggatttccaaaactgggggaaaaaagagtccctaaaaagcagcaccataaagaattgtaaaagaggagaatcatgtcctcaaatgttaaaagaagacttatggattagccaaggaaattctcacctttaaagaaaaatgagacattatgtcaatgattatggggaggtgggagaaagacagaaatgcctcagaattgtctggatggttttataaaaccacaccacacaccacacacgtgcataaacacacacacacaccacacatatgtacctgtatgatctgatgtgcttatgacagtggcatgactcagaaccagggccatgatgaaccactaccattaggggaatatgtcttatccctctggtgtgctggagatcacagagttatttaaaaatcagagggcaagtagcagaagaactaaggcaaaaggagatgccttgtaaaatacattaacaataacagttaaagcaacagaatcaactcccaccaatggaagagtagggtaagagtaggataccctggtacttgcctcactgaaaatcatctagagccaatttaaaaggaaagcacaaacaaccctccaaaacaaatccaacataatcattttgtgaagggcaaaaatagcccccaaattacagaaatgatgcattttttaattcaacaaaagacaagatcaggaaaaaaatgagaacagagggctataagtgaaatttttgatattatgcacttatgagacactgaaatatgcaatccattttatttattgctgtggaaagtagtgtgtatattactttatagtagagttctacaggtataaattttataattgaaatagatattaattattacacataaatgttactattttttatttgagtttggttatttttagttagaaactgcctatagtttaaccctgataacacggttaaatttttacttacaaatatagtaaactaaaagagctttttcattctagcatgcccatattgtgggcttatgttttcaccctctgcaatattccaaacttgtctttaaaggaaaatgagacattctatcaatgattatggggaggtaggggaaagacagaaatgccttagaattatctgggtgattttacaaaaccgcaccacacagacgcacacgcgtgagcaagtgtgcacacatgcatgcgcgtacacacacacagacgtagaagtcctatttcttcaaagtaaaaacaagttgagtgttcatactctgtatcagaaaaaaataccaaaagtttaatgaagagcttactccccttttgttttaatttactgaaatcatctatctatatatatttttaattgtcaatattattttggattttatctttccaactactgttttcttgttgctccttgaagaaattattttggggaatatgaagcttcatgtttacagatttgcagaccctttgataacacaagaggatgacagaactgcctcaggttatcttctgagctggcagacttctcaaatttgcacagacacaacctttagtgacctttggagctctgaaactacatgaatcatcattaaaggaaaattgaaccaaagccactgggaagttcctttttcagaggattaacttcgtttcgtttcatacataagcaatgaaggtatgtatagatccatgtcatttctcaggtcgagttaaactgtcctgtgatttaaaagttatagtatgtacatgattttatttgaaactctatatagctaataaagacaaagagaacagctaattcgaaattgcctgcacaagaaaattaaaatttccaaaatctattataattttgtcactctaaatgaagattcatgtgacatgttggactcccatacagaagactacttcaggactgtctttctataattacgactttcacttcattaataattataatgccttttcctatatgcatctgtccaacagcaagtgaagacaggaattgcctgaccttacacgacaaataaactctcaattcaaatcataatgaagttggtaaaacagtttggctttagggagatgaagatgatgtattgtggggaaaaaagtctcttattactaaggtatattttatccccatataaagtagcaaaataatattatttattcataaacaaaaaagagtgatctaaaggttttcccaagttattttagattggtgcaaaagtaattgcagttttgccgttattttgatggcaaataatattaacacatcaacatatataggatatcagatctgaatttaaaaggtcagtttataaattgtatatcgttctctccagatataaagtggattccagcactctgcacgcctgagcctctgctcctgtgactatcctgccgcctctatcctcactgctgccaccttgagggagatcgtgcacctgcaggctggtgagtttggcaactagttctacggggtgatcagtgatgagcatgccatcgagcctactggcacttagcatgcggatagcaacctgcagctggagtgcatcagtgtgtactgcaatgagaccacaggtggcaagtatgtgccccacgctgagctcatggatctggagcccagcaccggggactctggtgtgctcaggctccttcgtgcagatcttacggctggacaacttcatcttccatcagagtggtgccggaaacaactgggccaatgggcactacgcagaaggtgcggagctggtggattcggtactggacattgtgaggagggaggctgagagctgtgactgcctgcaggatttccagctgacccactccctaggagcagggactgggcctaagaggggtacccctctcatcagcaagatcccagagaagtatccagacaggatcttgaacaagttcagtgtgcccttacgcaaggtgtcagacatgggggtggagccctaaaacatcaccttctcagtccaccaactggtagaaaacacagatatgacctattgcattgataatgaaactctccataacgtctgcttcagaaccctaaagctgaccacacccacctatggtgacttgaaccacttggtgtctgccgccataagtggggtcactacctgcctaggcttccccaaccagctcaatgctgacctgcagaagctggctatgtacatggtcccattccctacctgcacttctttatgcctgtcttcaccctgctgaccatccacagcagccagcactaccaggccctcatagtgcctgagctcacccagcagatggttgatgccaagaacatgatggttccctgagacccctgccatggccactacctaaaggtggccacagtgttcacggactacatgtccatgaaggagttggatgagcaaatgcttaatgtccaaaacaagaacagcagctactttgttgagtgaatccccaactatgtgaaaacagctgtctgtgacatcccactcttggggctataaatgtctgccaccttcaacatcaacagcgtggccatccaggagctgttcaagcacatctctgagtggtcatgtttcggtgcaaagcctttctgcactggcacatgggcaagagcatggactagatggagttcaccaaggctgagagcaacatgaacaacctggtgtcccggtaccagtaataccaggacacctcagccaaggaggagagaaaggttgagaaggaggccaagaagaaggtggcctagagccttcagacatggacactgggtaaagtggggaagcagtgggaattctatttactcacaatcttttctctgataaccaggtctcactgtgtgtacacttggagctcttcccgacttcatagcacacactgtaccgacaccatcattaacagcattttcatagtgaaaagaaagtgcatcccccaagaaccatctcaaattcatctctgttggccaggcgcagtggctcacacctgtgatcccagcactttgggagtccaaggcaggcggatcacctgaggtcaggagtttgagaccagcttggccaacgtggtgaaaccccatctctactaaaaatataaaaaaaatagccaggcatggtggtgcatgcctgtaatcccagctacttgggaggctgaggcaggagaatctcttgaacccaggaggcggaggttgcagtgagccaaaatcatgccactacactccagcctgggcaacaagagcaaatctccatctcaaaaaaaaaaaaaaagttaatcatttgtctctgtgaggctttgcaaatttcaaagcatcctcggcattctcagggggctttctctcctgagcctctgggatgcatcttaatcaattttattgcatttagtttgtagaataggtaaatttggacaacatgtcaatatcctaaaacactgaaaatcctaaatccttgagggtggaagttcttatcgcttcaaacatactagtgcaggacctggatatagtaggtgcatgatattaaaaaaaaaaaaatcaaagtagagatctttcacctccctagttagctgtattcctacataaattattttttgtgtgtgtggctattgtaaataggattgcattcttgatttggcactcatcttgaatgttgttggtgtatggaaatgctactgttttctgtacacaggttttttgtgccctgaaactttgctgaagtggtttattagatgtaagagcttatgtgcagagactcattaggggttttctaagtataaaatcatgctgtctgcagagatagtttgacttcctctctttctatttggatgctttttatttctttctcttgccaaattgctctgcctaggccctccaatactacattgaataggagtggtgagagtaggcatccttgtcttattccagtttcaaaaggaatgcttccagcttttgcctgttcagtatgatgttgtctgtgggtttgttatagatggctcttattattttgaagtatgttccttaaatgcctagtttgttgaaggtttttaacatgaagggatgttaaattttatcaaaagccttttctgcatctattgagatgatcatgtggtttttgtttttagttctgtttacgttataaatcacatttattgatttgcatatgttgaaccaatcttgcatcccagggataatgcctacttgattgtggttaattaggttttttgatatgctgctggattattaacttttctatcagtgtttgaataaagtaaaagtcatatgcctcatggaaatgccattgagaagcttcttagaagtttggattcctgaattacatcttccatagacttcccagaatccacatgacaacaaaatgtacactccactggtaccatttaaattaatagaacattgtgctggaattaagttgaaaagcacattcttaacatccctatttcaatgatgtaaaaaaaaaagaagaaagaaagaaatgaaaagaaaataaaaaagaaaagaaaggcttcctagaacatcatggactacggaataaaattcaaagaactctttcattcaacacaatgtaaattatattatggttcctttcccaaagctgacccttgcttatgacatgttctatattcataatgttcgtattcatgagactgtcacctgataacttttgcataagttgtttgcaccaagtaccacgacaaaagcattttcattgtctttttgttaaaaaactgatacacaggaaataaatcaagcaaatcattacattatcatcatcagtccaaattgttcatatgtagatggaataaagtcttttattattccaaatattttataaatgtttaattggaatagtaaaaaatagaatatttccaacttattaattcattctcattctttccttctgaccaggcttaggaaacagaaaagcaattttcttaccctacttcaaagagtcccatgagactcatttccccaacaaaaaactcccaaatcatcattaaacctataggtaacagaaacaaagatgaagttagtgagacaaataatagccaagcctatgatgtaacaaaaagttctttattctcagaaagctctttagtaaatgaattgttctgtttgtgagatatcagtctagactataattctatttagaaagaggcttgggattttacctcaatgaatggactagttagatatcacaatggaaattattataaccagggcctctggagacaacaaatataactttgtaaggatttcctacttggtaatggagataagaatgtcagagttgttcaaggaaagttacaatccacaatctctgttctctttctagcaaatatatattatataatatatcttagtatatattgtaagaaatatacttactatatgtatttgtatatatagtaagaagtaatggtaaataaaaggaagacagagctaatgaagaaaagattctttcaccttattcgtgcagggccgaaactgttaaatatgtgctgcttattaagaaactaatgtctgaaatggatgcacttgtctaattttagcattttccatgtattattttaacatatctcggaaaaagggactataaatcctaattcaactgtgttactatagtaaacatcatatttacaagtcattctgtgggaattatgcaaagccgcgtctccattaacactccctttgtttcctccattgccaaatggaagaacagaatagataccatcacaatcttggattaaaaagaatatctctctaggaaacaaagctgaaggggggttggtgggagaatgaagttactcaaggggcatctgattaaatgaaagaagccaggcagacagaagcacagagggtaatagctattttgatccagtgagtattgaccacaaagaaaaaaaaaaaaaaggatctacattgtcacaattactcctatctgacaaagtctaaacgtttctaggtcaccacgtaccgagttttaccaaagtgactttcagatgtcacataactatataatttctcttttggctgaagttaatcacataaactaggaggtctttgaagaccagattgaccctgatctggatgtactcattctttacagcttgttcaatgaggaaactattgcagtcttaggcagtcttaaaaataacagaaagaacattttcacaagaacctatacattaggtggggaagaaataaccactttcaaatagcttttctttcctccacttgattacactcattatgttttgacgttaggctttcaagctggtcaacatttatggagacaagaaaaaaaggggttacaacgactggccacaaacaccacactttgattggaaaggaagaataatgtccaagaatgtggtgaaattagcacacctagagtactgggaatatccagcttcaacctggaggatcacaagaaagattttcctgggcgacaagatgtcaagggaagcacctcatctgactacagaaaacaacgacatctggagaagttatttcctgcataatcgggaaaaagaaatgaatcaatcacttttaaaacaggttcttccttttctactgtcatctatgcatcattaatgattcactcaaactactgagtttaagttgagtaacatttagatgaacttatatggactatggcatattcagtcacaattattcacttatttttcttagcttgtgttaatcttcccaaatctcacttaggtatgatcagatatgtttaatcatttatgaataaattgtgtagtttttaattttaaaatattttgtcagttatacatgcacgtattcagtcaaacagttctacaaaatcatatatatttaatgagtcaaatcgttgtacatgacttacttagaaaaacatagcttctttccacacctcttgcctccattccatcctccaggcaactattttaactcttttagttctttatctctatataacctacttaaactgccacactctgaattttcagttttaggcataatctatggatttggcagtatggaaacagagacttacttctttttctctacccctaccaaacccataagcacactcatttctccatttccccagtattgttacattatctttgtggttttatattcagtactaagccacacagtacacaatggtgatttgcataattgttttctccctgcagtcttgcattacttgtttcctttgtttattacgtttctaattcgtctccctcatgctccttatttgtataactcctttttcattaagttgaaacctgttacatagattctattaattttatcccctggagacaacttcccagagtctcctgacctggtccaatatggactgcctggctgctgggtgctgcatgggtcatcaacctgagagctttctgaccacaatcgtgggtctcccacatgtctccctgcatgtctcttatgtattttatgtctcttttgtcctctttagatgtcctcccattttagtggagtgcattttccagtagattcctggtaaagaaccatggactttgtttcatcatcttgaaatgttactaacgagaaattcaattacattttgtttcttgatccttttaagctatgtttttcaattttggaagtggttagaatcttcttattccaaatattctgaaatctctcaataatatactatgtggattttgtttccatttatttctcacagcacctcttgtgaacatctttggtatggagacataggtcattcaggagcaggaaatgatgttttgacaattttctcccttttgttttcttcattctttcttttcagtttcctagtatatggatgttggtcctaccatacaaatcctctagttttcttatcctcttgctcctagtttttatatctgccttttaacctattttgtaggatattttaccctttgaatgttttactcactttttagtttctgcattatatatttaattcccatgggctctttcttattctctgactgctttttgtatagtactgtgttcttgtttcagggatactattacatttctttctgtttcttcactctctttctctatattttttcaaattgttttcatttttgttggtttttggttagtgattttattataacttgtttgtttcacatagaaggtttcttaagatgaccattgagtctgaactgtcaagtcatagataaaagtagaacaaaaagagctgatggagttttgcatgagaatggagctttccacctatgggcttcccttaggagctctgtactgtggggaaggcagatcttgagaggaatcatcagtctttgcaagacaactacttcacaggaaaccatcacaatgtctacaagctaagggacactaacttccaggagagaacagtgctcttttagagacctaggagtcttggcagaatttatgattcaattttcccagcttcctaaaaatctgctcaaatgttatcattctaattttcagtgatcccactccttcacaaccaatgccctaactttaacctaagatactctgtgagagtaaagatagaattcattttattattcagccaaatgaagtattagactttggatttggtttccagaaaccttgatcctgtaattataggaaataaggtttcttttagggcagttacagaagctctgaccttttgcttataccttgatccggaacttaaattttctttctccaagttggttcctcttagaaatcacctacaaaacattatagttcttatgtccactaaaaagtcctatggaagcacctacatagtcaaccaaaatcttgtcttctgtcgacatttgattacaggtgactctgggttaatttaagtaagcctttttccaccacataccgtgaaataccatgtttgctttgatattgtcaacaaagtcattttaaccaatcagatcacacaaccaattccagattcccattgttaagtttctgctcctctgcaacctctagaaatatcatttagggattaatcaaaaaacaaaactattatgagcattatgaaataaaggatttattataggaataaaatcttatacaatttttttaaaagctaggaaataaaggtcttaagggagcattggagaattaggcagaggtcactaaccagccttcctgaaacattggtaggcatagataagtcagagtctacaaggaaatatgtcaaaataagcacatcctgttgccacagcgagactgcatagattagagctggtaagaaagtccatggaaggtgactgactctgtgttgggtggtgatctaggatattctttctacccagagctagtagaagaaaaactggacttggagacagaaagaaccaggacaagatggaatttgtgggtacctctgcatctgtctctcaccacaactaacatgttgaccctcagaaagcaatggttgttgcatcacttctgccttaaaaatcccgtaaaacattttcatttggccaactctagcctggaactgtacagagaggaggattctgggtgttgttgtttcagcttatccaaactgacaccatgcagaatccattacaagttatgtgttaaataactgacttggcagaaacttattattaaatgaagaactatgttttccacacaaaatccttaaatgtgtgatactactaatcccatctcttgtttatatggtccctctacactttgatctttctctttttacatctgtattctcaaatttctcaattttttaatgctggaatgagaaaaaataaaatcttatagttttaaaacttcaccaataagtcatctaaagatcaggtaatgtgaaacctaaaattagtagttaaaataaaattaatatattttttagtttttccactttgcagatttaagcgaaaattgatattggggaactcttcttttagttcttaattcacttgaagtagaagaaatatcatttcagcttttttgttgtgtttatttggtaatgagttttctgtactttactactttgataactcttccaaggtttttttttggactgagtcgctctatcgcccaggctggagtgcagtggcgatcttggctcactgcaacctccgcctcccaggttcaagcgattcttgtgcctcagcctcccgagtaagtgggattacaggtaactgccactatgcccagctaatttttttttgtatttttagtagagaagggatttcaccgtgttggccaggctggtcttgaactcctgacctcaaatgatccacccacctcagcctcccaaagtgctgggactataggagtgagccactgcgcccgcccggcctcttccaaggtcttagtgttttgttcatcttttttctttaaccatttataataatttatgcacagtagttaataaaaaaaagaattacagtgaaatagtaaaataaaaatcctgatatacagtaatgtcaaatgaaaacaatattagttgaatattaatattcaactaataatgatttatgtaatgaacatgcatataaaaagcacatagaaggttattattatagtaattaatcatcagaatgcatataattgaatgtaagtttggagaagacagaaaccgaagagacgcaaattaccctagaaaacacctactctgaactagggccattcatatcttcccacaaaaagctattttatctcctatctgagaaaagataaatgtctttagagacatgcaataaaatcaaggtcatttctaaaatgtggggctagcttaaaagtaaattttgtgaagtgatcctggaagaagaatataaacacgttagaggaaaggtgaactcaattaatttgatcttctttcaagtggaattcttcagatcatagagaaagcagatggatagatgactatcaagaaataacagcaaagattacaagggcttttgcttcatgcttatttacgatatttattttaaagatttataaacattcatatttatatgaacttacatgtggatcttatgggtttatagataaagacaatgttagagttaatattacaaatacatttagactgtgagtaattttctcgaattttaatgaaatcctatataatagcttacttcaagttgccaaacaaaatgtaaatttcttcctactaatgttgcaataacattattctgaaaatctttttacttgatttaaattgtttcttttccattggcttcattatttttttatgttttacccatgataacactaaaagggacaaattggcctactagttttctcactactctccccttcaacaatttctctacagaaaaggtttctttagttatttagttaattgcattctgttataaagtcatcaagataattttataagtttgaatcaaatgctaatattctctattctggacaaacaaatgttgcacatgtagggtgggaaatgggatctgcatttatgatccctaaatggcttaatattaaactttctgattattattattagttaatttgtactaattagcttttttttaaggaaaataaaatatagaactatcggacataagaaccataatggaattcattcagcatcagttactgaactccctaagttaccatttgaaatatcagttaaaagccatgatagatgacattttttgataactgactctttaatccatttttgacaaaattaaaattaaattagtttttaagttgtaagtgaccattaaactattaatttggctcaagagagatttagcttggtttattattatgtagtgtttttgttgcagttattagccttgagaacaaggacttcattgaacttgtttgctgttatatgctaagtgcctatagttatacctgttccagattcatcactcaatgagtagttgtggaaggatgaaagaaaggaagaaaacaatttctcttttactcagatttttctcagaatatagtgagctctcaccaacatgaaagacttgcacatttgtagagtgctattatgtttattaatgtattttcacatatactgttaaaatacaatttcatagtaactttgattatagaatgggcagttttatttccatttatttatttttaataaatgttattttagatttatttttaataaactgttattgttgattcacagtgatatgggcaaatttgttatacgggtaaaatgcatgccacagaggtttagtgtacagatcattttgccacccaggaagtaagcatatgacccaatagtcttttgacgcttgccctccttcatccctctaccgtcaagtaggacctggtgtctgttgttcccttctttgtgtccatatgtactcaaggtttagctcccacttataagtgaaaacatgtgatatttgatataccattcctgtgttggttcactgaggatagtggcctccagctccatccatgttgctacaaagtacatgatctcattcttttttattgctgcttagtattctacggtgtatatgtgccacatcttctttatccagtctactgatgggcatttaggttgattccatgtctttgctattgtgaatagtgctacaatgaacatacaagtgcatctatctttatggtagaatgattaacattcctctgggtgcatacccagtaatggggttcgtggtttgcatggcgattctgctttgagttatttgagaaatctccaaaccgctttacacaatgctgaaacttatttacattttcaccagcagaatagaagcactctcttttctctgcaatatcactggcatctgtttttttgacttaataatagccatacggattgatgtgagatagtatctcattgtgtttttgctttgcatttccctaatgattagtgatgctgagcattttttcatgtgtttgttagccatgtgtatgtctttttttgaagtgtctgttcatgtcctttgcccactttttaatggggttgtttggtttttgcttgttaatttgataaatttccttatatatgctggatattagacctttgtcagatgcatagtctacaaatattttctcccattctgtaagttgtctgtttactctgttgatagtttcttttgctgtgcagaagctccttagtttaattaggtcccatttgtcaattttcattttgttacaactgcttttagcatctgtgatggttaatattgggtgtcaacttgattggactgaaggatgcaaagtattattcctgggtgtgtttgtgagggtgttgccaaaggagattaacatttgagtgagtggactgtgagaggcagatgcaccctcaatctgggtgggcaccatctaatcagctgccagctgcagccagaataaaggcaggcagaagaacatgaaaagactggactggcttagtcttctggtctccatctttctcccatgctggattcttcctgccctcaaacatcagactccaggttcttcagctttgggactcttggaccttcaaccaaagactgcaggctgcactgtcagcttccctgcttttgaggttttgggactcagactggcttccttgctcctcagtttgcagacagcctattgtgggacctcaccttgtgatcgtgtgagtcaacatttcttaataaactccactttatctgtacatctatcctattagttctgtccctttagaaaaccctgactcatatagcatctttgtcataaaattgttcccaggggctatgtccagaatgatattttttaagttttcttcatgagtttttacagttttagggtttacacttaagtctttaatccatcttgagttgatttttgaacatggtagaagtaaggggtccagtttcagtgttctgccaatggctacccagttattccagcaccatttattgaatagaaagtcctttccctactgcttgtttttttgtcaattttgttgaagatcagatggttgtaagtgtgtgtctttatttctggactctccattctgttccgttggtctatgtgcctgtttttgtaccagtaccaagctgttctggttactgtaacctggcagtacaatttgaagttgagtaatgtgatacatccagcttttctctttttcttaggattgtattggttatttgggctcttttttggttccatgtaaattttagaataatttttttctaattctttgaaaatattattggtagtttgataagaatagcattgaatctgtaaattgctttgggcagtatggccattttaacaatattgattcttcctattcatgagcatggaatgcttttccattccttttatagtctctgatttttatttttattttcagctgttgtagagatctttcactgccctggttagctgtattccaaggtattttattattcttgtggctgttgtgaacgggattgtgttcttgatttggcactcagcttgaatgttgttggtgtatagaaatgctactaatttttgcgcattgattttgtatgaactttgctgaagctgtttatcagatttaggtgtctttgggcagagactgggattttctaggtataaaatcatgttgtctgcaaacagagatagtttcacttcctgtcttcctatttggatacatttcatctctttctcttgcgcgactgctctggctacaacttccagtactatgttaaagaggagtggtgagagtggccatcctggtcttgctccagtttcagggggaatgcttccggctttggccattcggtataatgttggccgtgggtttgtcatagcttttcttactttgaggtatgttcccttgatatctagtttgttgagggtttttaacatgaagggatgttgaatttatctacagccttttccttatctattgagatgatcatgtgttttttgtttatagctctgtttatatgatgaatcacatttattgatttgtgaatgtagggaagagccaaacttacatctcaggaataaaacctacttgatcatgatggagtcactttttgacgtgctgctagatacagtttgctagtgttttgttgagggcttttgcatctatattcatcaaagagatcagcctgaagttttcttttttggttgtgtctctgccagattttggttttggaataaagccggcctcaactatgaattagaggagtccctccttctcaatttttttgaataatgtcagtaggattggtaccagctcttcctcatacatccagtagaattcagctgtgaatctgtctggtccagggctttttcttgttgataggctttttattactaattcaattttggagatcattattggtctgtttagggtttcagtttctttctggttcaatcttgggcagttgtatgtttccaagaatgtatccatctcttccaggttttctagcttgcatgcatagaggtgtttacaatactctctgagggcttctggtatttctgtggggtagacggtaatgtgccctttgtcatttctgattgtgtttatttggagcttctcctttgttattagttcagctagcagtctatctatcttagtaattctttcaaagaaccaaacctggatttgttgatcttttgtatgattttccacctctcagtttccttcagttcagctctgattttggttatttcttatcttctgctacctgcaaagatttgcttttgttttttagttcctctagatgtgatattaggttgttgatttgaaatctttctaactttttgatatggtgtttagtgctgtaaactttcctcttaacaatgctttaagctggaaaaagtgatttatgcctgtaatcccagcactttgggaggttgaggtgggcagattgctcgagtctgtaagtttgagaccagcctgggcaacaaaacaagaccctgtctcaaataaataaataaataggcctttgctgtttcccagagatcctagtatgctgtatcttctgttttcattagtttcaatgaatttcttgaataatacctttatttcattgtctatccaaaagtcatccaggagaacattgtttagtttccatgtaattgtttggttttgagagatcttctcagtattgatttttatttttaatgcactgtggtttgagagtatggttggtatgatttcagtttttttaattttttgagaattgttttatggccaattgtgtggttgattttagagtatgtgctgtgtgcagatgagaagaatattctcatactatattctgttgttgaaaggagtgttctttagatgtctgttaggttcatttggtcaagtgttgagttcaggtcctgaatattgttttagttttctgctttgatgatctgtctaatactatcagtggggtgttgaagtctcccactattattgtgtggttatctaagtctgtttgtagatctctaggaatgcgttttatgaatctgggtgatccagtgttggatgcatatatatttaggatagttaagtcttgctgaattgtaccctttttcattatgtaatgccttttattattattattattgttgttgttgttggtttaaagtctgttttgtctgaaatcagaatagcaactccttttgtattttcagtttgcttagtatatttttatctatcccttttctttgatcctatgggtgtcattgcatgtgacatggggtctcctgaaaacagcacacagtcaggtctttcttctttattcaacatgcctctatgccttttcagtggggcatttcacccatttatgttcaaggataatattgatatgggcagatttggtcctgtcatcatgttgttaactggtttttatgcaagcttgatcttgtagttgttttatactgtcagtggtctgtatgcttaagtgtgtttttgtggtggctggcaatgatctttcctttccatgtttagcacttctttaaggatctcttgtaagataggtctggcggtaatgtattcccttagcatttacttgtctgaaaaggatcttatttttcttttgcttatgaagcttagtttggctggatataaaattcttggttggaatttgttttctttaaggatcctaaatattgctgctcaatcttttctggctggtagcgtttctgctgaagggtctgctgttagcccaatggtgttctctttgtaggtgacctgccccttttctctagctgcctttaatatttttttattcacattgaccttggagaacctgatgactatgtggggatgatcgtcttgtgtagtatctcacaggaattctctgaattttctgagtttaagtattgacctctctagggactttggggaaattttcatggacaatatcctcaaacttgttttccaagttgcttgctctttccttctctttcagggacaccagtgagtcataggtttggtctctttatataatcccatatttctcaggttttgttcattctttatttgagagagagtctagctgtgtcacccaggctggactgcagtggcacaatctcggctcactgctgcaatcttcgctcctgagttcaagtgattctcctgcgtcagtctcctgagtagctgggattacgggctctcaccaccacacctggctaatttttgtacttttagtagaaacagggttccactatgttggccaggccagtattgaactcctggcctcaagtgatccaccctcctcagcctcccaaagtgctggaattacaggtatgagccaccatgcctgtcagattttgttctttttcttgtatggttgtattgaattccttagattccttgcattaggttttgattttctactgagtctcaacgatcttcgttcttatccagagtcttttttcagactggttaagaacagctgctggtgaactagtacggtcatttggaggtaagaagactctctggctttttgagttgccagagttcttgcacaggttgtttctcatttgtgtgggctgatgttactttaatctttgaagctgctctccttggataaatttatttgcttttacattccttgatctcattgacagtttgactgtggtataaggtaggttcaatcacctagctttgtttctgtaagatttcaggtggccaacactcaacttagagcttctggactcatgctctagccctagggggctggaaccaggcacacagcttggttctctgaccccttgagattaggaacccactgcattggagaagccaaagtgttccaggtccattggcaacaagactccagtgaagcagtgccaaccaaagcacttcattagtgccatggcagcagggtagacacttgcacacacaggccagcagcaacagcagcatggcaggatatatgtgcattggtgagggcagggcacaggtgaaggtggggcagtggtgtccatgtgtgcttgtgctctcagcagcaacatggtggggtgagcgcacatgcctgcctttgggggcagtgcagtgtggtccatccatacacactccagcaaagtggtgggggagctatgagcaagttcatgccagcaaagcaatgggagaaggctgcagggccaggaggatgtgggtaggggtaagcataaataactttaaagaacctcaaaggcatcaagatttacatagttctttctaaaagaatgcataaaaatgcacttcatttttgcatctcagataaaatatgtaattaaaactctgtggtctaatactaccacgtagctacatggaaaatgacaaaattcagacacatgagtccaaatgctatcttatttattataagataaagtgccagctttaaataagactgtcttcaagatcatggtggaaatcataaagaataagtagaaacctgttgactattttactctcttcagcagtttctcttcacaactgaacatttcatgttgctaacagagagcaggcactggaatggagataaatttatgtgtacatatttttctcagcacaaaattagggggaatgacctagaaaatcatggaattagcaattttctagtgttaatataattatgattataattattatacattctatttttaaaaacttagaaacaaaaagtattccagagaaaattgaccataatcacatcaagcactgaccgtcacactttctgcatttcttgctattcttctatgcataatttatatcattttgtaaatgtctttactgtgtttgcacaagtaacctggttctagggggataaaaagtatgtatccagacattgacattctttgttactgtgactaaagtagcatgactttggagagtggaaggtaggagaaattcaattgcttctgaggcagctgctgttgcacatgtcccttatcaatgtggtcatttatatacataatttctgattttgcttcatcttgtttttacaggaaagaaggggttaataatccagatgttaaggtaatttttaatggtaaacactatgtcttcttttcctccttttattctgtcatttttctagtggctctgctatggtgtaaataggcatagatggcaagtaaattcttgctattaatagttagattatgaatgtttgtacatgactaacattattataagttagaatggatgaactgtactttcatcagcttgaattctaatgtgctttctgagcagtagtgacaggaaggatggagttgaaatgggcatggtggatttggacacagccccaggcacagctgtggaatgtgctgtgtgtgaatgttccgtggggagtatcacctcagagaggagctgaaatacctgctgtactacatcttctcctttttgtctttctaagggtaaatacaaattaaaaataagaggcttaactttacctttttaaaataatggaagggactccttgctacccccccatccttttatttcagcttttgttttagaaaactttgtgaaaattgtaatttctgtttctgaccctttgagatttatgaaattctttctaaaacgatttctttaaaatatgccttttgccagttttaccacaaaggagtatttctctcagggaacatttctacattgctggtgggaatgtaactagcacaaccactgtggaaaacaatgtggagattccttaaagaactaaaagtagaactaccacttgatccagcagtcccattactgggtatctacccagaggaaaagaagtcattatactagaaagatacttgcacacacgtttgtagcagcacaattcgcatttgcaaaaatatggaaccaactcaaatgcccatcaatcaacaagtggataaagaaactgtggtacatatatatatatatgatggactactactcagccataaaaaggaatgaattaatggcattcataatgacctggatgggatggagactattattattattattattattattattatttgagacagagtcttgctctatcgcccacgctggaatgcagtggcatgatcttcattcactgcaacctccaccttctgggttcaagcaattctcctgcctcagcctcccgagtacctgggattacaggtgtctgccaccatgcctggctaattttcgtatttttagtagagacagggtttcaccatgttggccaggctggtctcaaactcccgacatcaggtaatctgcccacctcagcctcccaaagtgctgggattacaggcatgagccactgcgcccggcctggagactattattctgagtgaagtaactcaggagtggaaaactcaacattgtatgctctcacttataagtgagagctaagctatgaggatgcaaaggcataagaatgacacaatggactttggggtgtcagggggaaagggtgggaaaggggtgatggataaaagactacaaatagggttcagtatatactgtttgagtgatgggtggaccaaaatctcacaaatcaccactaaagaacttactcatgtaaccaaataccacctgttccccaaaaacttatggaaataattttttttttaaaaaaaagaaatatttttctcgagatctagatctttttgtaatgtaatcatcaaggaagatagagtatttatctccctgtttctgtgggaggctagaagccttgattcagcttgcaaaactaccttctgtcataaaaatatgacaattgtgttttttacataaaagtaattatcaaacctggatggttaccccaattactaagtgaaattatcaggaacatgaactggagcagtcaactcctcttacttgatggctagttatcgtttatcttgagacaatgtatgtaacagattggatttgtaaatatctgtctgcaatgtaaaagggtaaaatttctgtttttgcaatctctttagcagattgcttgtgatgtgactcacattctgatttaatgctcattcaataatgaaacttttttcttctttttttttttggagaggatcttttgggttaggaggtgttatggactgaattttgcccccctaaaattaatatgtagaagttctaaccctcaacacctcaaaatgtgactgtatttggagacagatagggtctttaaagtggtaatttagttaaaattaggtcctaagggtggggccctaattcaatataactgaggaccttataagaaaaggagattaagacacagatacacacagagggaggacgacatgaagacacgtggagaacattgacatctacaaggcaacgttaagaggcctcagaagaaacaagcctgctaaccccttgatctcaaatttctagcctccagaagtgtgggaaaattaatttatgttatttaacccacccagtctatgatcctctgttttggcagccctagcaaactaatacagcccattttgtttttcatttttgggggggaaatttcatttccccataacctcgcattcttagtttcctccttcattaattcttgccctccacaaatatttactgaacatgtattatatacgtcatgttattggctaggttctagcaaggcaaagttgaataaaacattaccttttcccgatagaatttaagactacagtaaaagacaaacaaagaaatgaaaaaacattaaatgtaacagataaggctgagagcttcatttatgttgttccacaatacattcagtgcctaactcagggcacaatccataataagcactaaataaatacttgttaagtgaatgagggcatgcaaagagaaggagcatacaaactagacttgtggattaggaagggcatctgtattagtttgttctcatgctgctaataaagacataccaaagaccaggtaatttataaaggaaagaggtttaattgactcacagttcagcagggctggggagatctcagtaaacttacaattatggtggaaagaaaagtaaacatgtccttcttcacatggcggcagggagaagaacgagtgcccagtgaagggagtagccccttataaaaccatcagatctcgtgagatcaaactcactatcatgagaacaggataggggaaactgcacccatgattcaattatctccaccggcccctcccatgacacatggggatttattaacttctaagagaaaaaatgtttaagttgcattttaaagaggaaataggagtaaactatttgtaggtaggaaaaaaattccaggataacgaaacagcatgttttcctacaatatggtgtaaatcagcagaatacaattaagggactttccactgtaattggagcaaagaatgttaatgtagaagtgaaaaatatgagatttcagaattaggctgaccctttaccatctgggtccaatcttattgcttgtcttttgtccccaaaactaagaaaaactactaaagaatttatatacagcaagtgacattatggggccaatttaaaaacagaaaatcggtgattgcagatgaatgagatgagaaggagtgaaggcatgtaatacaacaaaggcagacagaaagaaaacaagcacaagaacaggtgagaaaacaatcacgaaaggaaaggttgtttgagcaggaatcctacaggatattaatcgcataagtaagttagtaaatcaggaaacaggaagctatatgcgattgttactactcttactttcacactttccattgtagacatttcatcagacaagtaatgaaaggatttctaaaaaggatttatgaactcctaaaactaaaactgtctatttgttctattttttccatgaaaatagtgcccttttcagtttgttttcatgagattttattttgttggtggtggttttgttgatgctgttgttttattttcatgagattgtaaacagtccccgttagataccatactctgacaatctataaaacaaatgaaataatcaacatatgcttggctttatgaaaaagaaaatactattccacattaactgtaaagacagcaaaaaaggaatcacagtgggaaaaactgagtgtagttgctttagaacagaaattattaactgttataatacataaacatgtaaaaatgaaaggcagctcccacctcagtcaaccaaatctctaatggtagagcaaccatcatagattccactagcacaagtgagtattgagttgaaggctgcaaatttgcaacacccactaaaaccatttacatgtaaatgaccctttctcttgcacatagtcgattttagactgctcggcatcaaactttttagcatgcagtttgtgcagcgtaatgaggtgagtggagaaggagaaagaattagtataaactgctgcactttcctgggacttgtattgcttttgcctttttctggaacagtggcttcctggccttttctcttactcaatgtaccttctccatgaaaagctaatagcaaataacaaagtaacctaagaaggagaaaaggagaaatgaatattagaaactcactatttgcagctcagaaattgtgttaggtattttcttgggctctctaatttaatttaaattgcaatagcaaatttaggcaaactctacctcaatctctcttcattttttttccaagacacattcacttcaaccagacacattacattcactttgaaaaattaatgcaaatgtctcaaaggcatcctggattgttttatttattttgttaacaattcacgtgttttattgcttattttatttatatattttttaagatggggtcttgctatgttgcccaggctgcacatgaactcttgggcctgagcaaacatcgtgccttggcctcccaagtagctgggaatacaggcatgcaccaaccactccctgtgctggtttattttaatcccatttttgtatttggcatttcttcctctaaaaagtttaaactttttaaaactctatgttcatttccttacatattcataagccttaaattattctggttatgattttacccatctgaggataaagtctgttctctctctaagacatactaaaaggctgagaatatttcattatgcctctcttatcaccttgtccctcatagccgctccccttcaacccctctatcctatcaccttacccaaattgttcttcttcactccttttgataaactccaaattgtgcaaacaatagcttcaaatctaagaaaaattgtttctacttcaaaagaattatctttgaccaactactcccaaaactagcagaacttcagctgacccctccacctacaccctgtaaaacgttttgtcatccttcgccagatcggaatgctccattggagctttctcatgcccaggattcttgaataaattattatgctagtagtaaactagtttcaaaaacatttttctgctttttgcacaagagaatgagtgctacctgttagttttttaatgttgtatcattgaatgcctgatgatagaaattagaaccagtaagttaacactgaattttgcaaaataccatcagtcaagggcctagcaggaaacagctggcacatataaaaggttgtaactgaagaaaatcttaatgggatgagtatttacagagctgtaggcagagttgtgctgaaccagtaacaacaggaagccactactaacccaaggcccagagccatgaaaaagaggcagacaaagtcttgacccagcaacttccagaaccatgaggaaaaaaagaagatgggaaatttgtaaataccacggtcccactctcctcccaccctctgatctcctgttggtttttagggagggctgaagacaacaggaaaccagaaagcatgggagcccaaaagatgcttcttttagagatgagcctgtgagagcagagcagggcagagaagagcaacgggttgacctgtgatatggttttgctgtgtctccacccaaatctcatcttgaatttccatgtgttgcaggaaggacttgaagggaggtaattgaatcactgaggcaggactttcctgtgctgttctcatgatagtgaataagtctcaccagacctgatggttttataaggggggagtttccctgtataagctctcttctcttgcctgccataatgtaagacgtgcctttcaccttccaccatgattgtgaggcctccccagccacgtgagtggctgtaagtccattaaaactctttcttttgtaaattgctcaggcttgggtatgtccttatcagcagcatgaaaacggactaatacaatctgacatggaaaatgcaggccgggtgcggtgggtcatgcctgtaatcccagcactttgggaggccaaggcgggcggatcatgaggtcaggagatcgagaccatcctggctaacatggtgaaaccctgtctctactaaaaatacaaaaaattagccgggtgtggtggtgggtgcctgtagtcccagctactcgggaggctgaggcaggagaatggcgtgaacccgggaggcggagcttgcagtgagccttgattgcaccactgcactccagcctgggcgacagagcgagacttcgtctcaaaaaaaaaaaaaaaaaaaaaaaatgcaacacaactattgtctcaggttgcattcttgaaacacagaatctggaagaaaaaagattttaatataggaagttagcaggaagacgctcttgagaacaacactcaagggagggaagcatgatggagtgaggcaaaaattgagctgcgatgcagtcagagcaacaacttcagctgatccttcaagggctctgaagctggggtaggcctttcagaaatgttctgaatggggaagagtgaccttggcgtttgttcccagcttagtcaaccactggaagctgtctgctgcaggggagagagaatagcctccaccaaggcagttcccttcagccaaggtctattcttaggtagaaatttggctgtgaactctctggcagccaaagctgccagacctggggaaaggacatctggttggaaggccaacccatgtggcgcatgacagtttccactctaatatgtccttaaatcaaaacaatccagaaaaacagtcacatggggcactggggaatttaattttctatcttaatagaaatatatttatttcctaatttttattttatgaaatatcttgagaaaaacctatctttgtatcagttaaaccacttcaagatggacgtgatttttgtgaagttgagcttttgaggactagccaataactttaaaatgaaactctaatccgaaaacagggacccaacctcatgaggactctctcctcaggagggcgaaaccatgccctctcatcgcccacctccattgttatctccatttcctatatttttaatcctttgggacactacagcttctataacatgagccaaatagagtgtaataggcagtaatatcttgcttcctgaaatgtgcatgcaaaaaagttatataggtgagagcagacgtaagcacatagggaaagataaggaccagtgcattacccaaaagaacacaaggactgtagctgattctctggagcacccaattctctagcagcagcagctcttcctggatccaatccaatgactcaattctttcttttttttttcttttttttttaattacattttaagttttagggtacgtgtgcacaacgtgcaggtttgttacatatgtatacatgtgccatgttggtgtgctgcacccattaactcgtcatttaacattaggtatatctcctaatgctatccctcccccctccccctactccacaacaggccccggtgtgtgatgttccccttcctgtgtccatgtgttctcattgttcagttcccacctatgagtgagaacatgcggtgttcggttttttgtccttgcaatagtttgctgagaataatggtttctagctccatccatgtccctacaaaggacatgaactaatcattttttatggctgcatagtattccatggtgtatatgtgccacattttcttaatccaatctatcgttgttggacatttggcttggttccaagtctttgctattgtgaatagtgccacaataaacatatgtgtgcatgtgtctttatagcagcataattcataatcctttgggtatgtactcagtaatgtgattactgggtcaaatggtatttctagttctagatccctgaggaatcaccaaactgacttccacaatggttgaactagtttacagtcctgcctgggatctaattaaaccaacgactcaattctaacagcatttaagatctcatgttagtcacattagatgcaaatctactaaaaagtagaattacttctttgatttatgaaatcaacccatattcttctccagatctgagttaaaagttgggtcatcacctaaggcagttataagaaaaaccaaggacattcctcaaatattatctaaaagcagggaaatgtcccagacagatcttactgtttgtagacagaaaggcatcacttcattaagtttcctaaaacacaaagtttaaaaatatctctaagtacagttttcagtaggaaccagggcaaggtcttagaaacaacttccttgacaagttcaagaacgatgccatgagggagaagcagaaaatcataaggaaaagagagagtgtgagatcaagtcaaaaatggagagtgagttgaccaaagtaagtagagaattttagaaaatgaaaagtgcaagagaagaattaaagctgtattgtttataatcaaccctgcaaaagtgaaatcagtgatcaggaaaacaaacgcgtatgcccttcaacaagaaaaaggaaaaggggcaaaactaatgtcaaagacaataagatgctgggcatggtggctcacacctgtaatcccagcactttgggaggccaaggcaggaggatcaccagaggtcaagagtttgagaccagccaggccaacatggtgaaaccctatctctactaaaaatagaaaaaaaggtaagccaggcatggtggtgggcacctgtaatgccagctacttgggaggctgaagcaggagaatcgcttgaacccgggaggcagaggttgcagtgagccgagatcacacctctgcactccagcttgggtgacagagagagactctgtctcaaaaaaagaaaaaaaaatgataaataaatgatagtagaaatattgaactgcggaaaagaaaaaaattctagaagtagccacaatcacagaaataataaaagcacacttaactgagttaaaagcaatataacttgagtctgcaagtgaaacctatggcatgtaaaaagctcttctcagaggtagccttatattttaattattttgtttatgagcaacagaagcagtaagttagttggagaaaatataagaaaatgtcaaacatccagatgacacagtgaactggagaatatttatatacacataatagtttagtgtgcaggctctgagacagacttcctgaattggaaatgagttgtcgatttttagcacagtaacatttagaaagtttattgctggagacttctggttttcattctgacatgtaaagagcttggaaggtgtcactctcatccaacaagaaaacttgaaacaacaactaaaatagctgaaaacactgagaaacaacaactcttcctagatccatcagaaaactgaggtcacaggacaagctactgccctgagaaccagagagagaggtgcacagagggaatcacaggtttcccagagcagaagcctgctgctagagccagcccggtagaaacacgtagctgtacttgacgaactgctacagtctcagtgtgaactagcctgggttaaaaactctggggatcccagtcttaagaggaccctcattgtatcataagatttaaaaacatataatggcttctaacacaataaaaatcatgaatttaaaataaagaaaagagatctaatatgtctgcccaccttctagcattatgcctttcaataggaatcaagttacaatagatttatagtttttagagcagtcaggtgttctgtagataataaattctaagtatgtaaatggattttccaaaataagctttacagggaaagcatagttctattattttttatggaaatgccaactaccatagaagcaacaattcgagaattattttaaaagccgttcaaaagcaataaatgtttagaatttcagaataagagacttctaactcagactaagaactcaagagctaataactgaaaattaaaaattcagacagtggaatacctcctcttctaaccacaacgtagtaataaaggttagatttatcctttaacattaaacacaaggaatgctggacaaagtatatagtacaactgttttcaaacattaatcaacaggcaacacaggacttggatccctgagatatgagatgcaatggaggttgtcttctgaccacacagaatttttgcttaaaggcagattattgactacaaaagagggagggggaaccttcacaaattacagtggttttgctcagttgaagagacagaaatcagagttcaggtagtctaatgcagcagaatgtgaagagcagaattctgaaaaagagagaactatgcaaaaaaagagctacagaaataaaaatttgatatgctttttctgaacactaagatgtacattcgtcggtggctcacgcctgtagtctcagcactttgggaggccggggctggcagatcgcctgaggtcaggagttcaaaaccagcctggccaacatggtgaaaccccgtctttactaaaaatacaaaaattagcctggcagggtggcacgcacctgtaatcccagctactcaggaggctgaagcaggagaatcacttgaacctagaaggcagagattgtagtgagccgagaacacgccattatgctccagcctgggcaacaagagcaagacttcgtctcaaaaaaaaaaaaaaaattcttgaggtggttatttatttagctcattactccttggttttacctgttaaatcactataatttgaatattttgaatttgaatgcttttataaatcaaaaacgtgatttgcatttactaacatgaaaaattattgatacagttttgttctgtgtccctacccaaatctcatctcccataatccccattgcaatccccataatccctgccagtagagggagggagcaggtgggaggtaattagatcatgggagtggtttccaccatgcagttctcatgatagtgagttctcagagatatgatggttttttaaggggttcttccccttttgctcttagctctgtctttcctgatgccatgtgataaggtttgaacttgcttcccctttgccttccaccgtgattgcaagttttctgaggcctccccagtcaggtagcactgtgagtcaatcaaacctcttttctttataaattacccagtcttgggtatttctttatagcagtgtgaaaacagaccaatacaatgatatcatgattattaccagattcacaattttcaaaatactatgaaaagataaattgttcatcctagtattaaaaagtaaagatagaacacagaaatttaatttttaaagtatagtagtcattcagtattagaagctgaagatgactaaaagtaagctaataggaatatacaaattaaaaccattacaaagaaaagtaacaatctagacttaattatgtataaaaattaacttgataaatgttcattgtcataatgaaaccattaagcccttactaaatgttatctccaaaatttttatggaaaaattctttcttaaagttttgtaaaatttgtttaagccattttgactaattaattattaaataatgtgacacaactgaatattgtttcaatataaaatataaaaacatacattcaagtttctcctaaaacagcagaggacagatgagttactactactgcttgacgacactaaacaggattaagttacagatcacaatttcttattcaaatggctctatcattgcagaagaaagtaaagacatggagggggattaaaatcagaacatagtcaaccatctttgtttttatttccatggtcacaaatagatccatgtgggtctctggcacttcaaatacttaatttggttacttaaacttaagtgattcctaagatgcaccaggaagtatttcaaccaacttgtgcatcctgacatctagattagttattaaagagctctttagaatgtatcttcctctatgtcatttcaaattcaaaactgtagattaataattagattagccttcctgcttctcaaatcataagaacaaatcttagagctttattaaaaactaagaagtagcataaaacaaagatcaataagatctgaaatgaggctgtaagtttctaagcaaaagcaacaaatattcaatatttaaaatatttttccctatataagtggctataactcaatttagaccatgcataatttaaataataatttattccattttaattaatatttaatatcatttaatacattacgttttccaaaattttctgtcagtgtattcaaggctccttctccataaccagtatggcgtcatggaaagtgagtatgctttgaaattagacttcataggtttgaactcctcctctttataagcttggtgatgttaagcaagtcatttaacctttttcagcttaggcctgtatagaaatggcaataacaatggaacctatttcattaacaggtcagccaggtgtggtggctcacacctgtaatcccagcactttgggaggctgaagcgggcagatcttctgaggtcaggaattcaagaccagcccggtcaacttggtgaaaccctgtctctactaaaaatacaaaaaatagccaggcatggtggtgcatgcctgtaatcccagctacctgggaggctgaggcaggagaatcgcttgagctcagggggcagaggttgcggtgagctgagattgtgccattgcactccagcctgggcaacaagaacaaaactctgtctcaaaaaaaaagaaaaaaaaatgtaatgtctgttgagttcctaggacacatgactatacatttagctattattctacttcaagtttttagaagaggccaagtcaataaaatgacttggcccccaattgccaaaggaaccgagaaaccaagaagaagggggcagataaatccattttgtcagcacaggtggatttattaagggatttattaagggaacttactgtcaacagaagcatggtcttggatgcccgcaagacaggtagatctctgcactgttattccctaatccatggcttacatgccatagaaaatggatatatgtgatctaacaagacaattaaaggcactctccatgacaggcaagaatgctacgtgcatcacagcctataaagtatgtggtaacatcaagattgctttggcctaaatgtaggagtacatgttcttacattagggacaataaataaaacagaagcctggagacactcccggaactggggttaatcataagtcaactggtggattggtatccaagatggagtcacttttttctccacaactgcacatattggttttctgaattatcgttaaatttgaaactgtgcaattatgcacaaaagtcatacttgtttttactttagtacaatccattttgaaactttaggaatattgtaggaaaatacaaaaatacccgataaaatttaatgatcatgctttataaaagtagtttgaaatttctttaaattttgggaattcaattaaacaataatgattacacctagaaatgagcatgtgcacctagcagtgccttacatgagattggtttttctcttttttctttttttttaacaatgtttcaccctgttgctcaggctggagtgcagcggcatgatcacagctcgctgcagcctcggctttccgagctcaagcaatcctcccacctcagccttccgagtagctgggactacagacgtgcaccaccatgcctggctaattatttttctatattttgtagagatggggtctcactatgttgcctagctggacttgaactcctgagctcaagtgatcctcccaccttggtctcccaaaatgcttggattacaggcttgggccatgtgtctggcctgagattgttcttctaattcaaacttttaaagtaaacttaatgaattataaaatactcgtttggtatcatcattgcatgatgggaaaaatggttgacctggcatttgagtacgtatgaatcgaagaataaatggctctatcaggattgaggaaccacatggtagttttactcagtcttatcttcgttagaagatacatgaaagagaaaataggaatttgcctgcaaaaaacctgggattatttaaactgagtagcagtttcggtgtcaaaattaagtgtcaagactacacaatggggaaaggatagtctttacaacaatggtgctgggaaaactggatatgtacatctaaaagaatgaaactagacccatatcttgcatcgtacacaaaaatcaactcaaaatggattaaagacttaaatgtaagacaagaactataaaactcctagaagaaaacataagggaaagcttcacaacattggtttcggtgatgatttcttagatatgccaacaaaagcacagggaacaatagcaaaaatagacaaatggactatatcatactaaaaagtgtctgtagagcaaaggagaccatcaacatagtgaaaacacaagctaccaaatgagacaacatattttcaagcatataaggaattaatattcaaaatatgtgaagaacttctataactcaatagtaaaataaataacccaattaaaaatgaacaaagaattttaatagatatttcttcagataagacatacaaatgtccagaaaatatgttaaaagattctcaacatcattaatcacctgagaaatgcaaatcaaaaccacagtaagaaatcactttatacctattagggtggtcattattaataaaagaaaggcggaaaggaaagaaaagaagtgttggcaaggatgtagagaaattggaacccttgtgcactgttggtgggaatgtaaaatggtatagccactgtggaaaacggtatggaggttcctcaaaaaattgaaaatagaactaccaggctgaatgtggtgtctcacacctgtaatcctagaactctgggaggcctaggtaggtggatcatttgaggtcaggagtttgagaccagcctggccaacatggtgaaatcttgtctctactaaaattgcaaaaattagttgggtgtgatggcacgtacctgttgtcccagctactcgggagtttgaggcaggagaattgcttgaacccgggaggcggaggttgcagtgagccaagatcacaccactgcattccagcctgggtgacagagcaagacaaaaaaaaaaaaaaaaaaaaaaagagcatcatatgcaccaggaatcccacttctgggtatttattcagaagacttgaaattaggctccagaagagacatttgcattcccatgttcagtgcagcatttttcacaataaccaaggtgtgcaaacaatctaaatgtctcaatgtgatgaatgaatacataaatgtgatatatatacacaataaaatatttttcagcctttaagaaaaaggaaatcctgtcatatgttacgacataaacgaatctggaggtctttaaaaatatgtgaaataagccattcacagaaagacaaatactgcatgatttcatttacatgaggtatccaaaacagtcaaattcacagaagcagaaagtagaagagtggttgccagaggctgtgaaggaagagatggagagttgctgttcaacaggtatagtttcagtcatgcaagatgaaaaagttctagagatttgctgtgtaacaatgtacctatagttaaaaaatactatactgtacactcaaaaatttaagaagtttcatgttacgtatttttatcacactaaaaaaaaaataggcccaacaagcagatttttagcctgcttactttgcataatctgtaaaacttcacccaacctctgctggatgttgatgagttagattcaaaactgctttgccctttggaactccctggtccggaaacttcccactatgctgctgagaaacatcacctagacacgtaggaacataaaatgtctgtctgatcttcctctctcccgggagtcctcttgccctcctccctttctggatggtggcctccatgtagcctttggacagactgctgctgtgagcaatttcctctctcagatgaccttgtccaagtaccacccgataaagcttacagcatgtcactgcctcctgtgggcatatatttttccttgattaaccccaaacacctaacactcatgatcagtctaaagctatccaaagcttacttgcaaggagcccaatttctgcttttaatggtctgccttttaggctgatggagaatttgaggagccgatagctgaagaaggaacaggtgatgctgtctgtaaattgactgctggatgttaccaagaagacaataaaaacaatacgtgccatacctggaggcgaaactccagtggacagcagtagtctgttacgtaatacggactatgctttttatttgtgtagaacttctagtttaaactctcatatcaaatcagataatgaaaaaacccttggtctggcaacacctctatatttcctgcaggaacatcttcatgaaagtgcaatatacaactgtattaccagccattgtcacgtattgatataagaaagagacattattttcaaatgttccatataattgtactctacgtgaagttgcactagttttgctaattgccctcacacaaagacaaacatgatacatttagtgttatgaaaataagatgattttcttgggaaaatttcatgatccggcttattagatgagagctcaattatagtagggcttttttttttcttagtccgggttttctttttatatctgcctccacccaatgcaggactcttatttctttatcagaattgcaatgattttgtggtctaattgcatttgtttttttcttattgcattagagcactttgctcatatcagcactgtagtactgactacatgtattatagttaattgccagcctccactagacagtgagctttttgggtgcagagaacacatcttattcattttggtatccccatcacatagcgctgtgtgcttctgttgggatagaaaaacaccaattcattttcattgatttccatcattgaatttttataagccacctcaaattctttgggtaataggcaaagtaaaacataagtagcaattttaagtcagatatcagaaagtgtgtcagtctttgttgacataagaatagaatgcatatttactgccttctagtaaaacataatttcctatgctatttttgtaaacaagaatttggtaaagaatactaaatgatgtcagtacagattcattctctcaacaaaatatggtgagcatctcttctacataaatctctattgtaagcactgggaggaaatggggaatttgacagaagcttaaagaatagtgagaaagatgtgatttatcatatcaggattctatcaattggccccaagtttcctgcacttcttagtaatatgataacttaaaggtagtaaatatggtatgtccttaatccgtcctttacagaatctctttaaacatcaagagggggctttgaaataagtgtcatttaggcaaacatgagatggtgtagcagcacaaatctatttcctgtaatactcctgtaaaagaaacttatcttgacagtaagaggcccatggaactaaagccaaagttatcatgaagtgattgtgtagaaagactttattcagtcaccaggtttgatggggtccagaatgttgcaggaaggtaagagggaatacagaattccaggattctagttcacaggttcttgataacctcaggagagtcactttttcttggcactgtgtataaaactttaggtagagtgtaagagatgtaataagtactaatattttctaacttccttcttctttctctatcttactaaatattaaatgattatttcatatctcttcttcccaaaatgagaagaatggatcctataacattaagctagcaaagaaatttacactgaaagtaaaataaatatagtgatttaaatttaatggctagtattagtcaaaagggtggatttaatggcaaaataatgttctttcttattttaaagaaatggagaacagaaggaatagggaatgctgtctttgagttgtatttagaagtgacaaaagttaacagtctcacaaaactgaaaagaccggttttggtggtcttttcaggcacaaactttctggaataaactaaaactcacgatgtttttaggctattaaatatggctggaaatctaagagtttctctgttcaagtttagattatgcccttttctatgaaagaaaagaccttaaaaaatgttgattatgattgtcaaatcctaagtgtgatgcaaactggaaaaatatacctatcctagttccctacctcatttacaaccagccagtagcttcgcactgggcttggaatgaaatgccaactcctaactgtagtctacaaagcttgcagaagctcaacctcagccatctcatctcctacccttcctcctccttgctgattctctgggtcctctggccttcttgtcttccacaagcatcctgagtccaagccgagcttaggacctttgctcttgctacttacccttcctgtgatgctcttcccctagatttcaaaaggctatttccttccatcactcaagtttcagtacccgtgtggccctctcaaaagagacttccctaactcccttgtttgaaaatatagaccctaacttggccactttctttccttttgccttgttttgttttcctcacagtgattcttgatatctgaaattcttaccttatgagtttatttattattgtcctatcacctactataaggtaagaacaaacagactggagatcttggctatcttgtacattgttgctgctccataagaacttgttgaagagatgaatgaatgaatgcatgcatggatgaacctaattccatctttaaaatatctccaaagggggatcacactttaacagtctagtttaacttgtgaggaagtgtttttcctgatatctattcaaaaatatttatcttttggctagtgctgactttttcttgttcttctcatgatagatttcatatacttgaatttttttctctagaccaagtaatttcacttcctttagtcttctcgtcttctctcttggattttatgcatcaatattttaacagtgtagatgactgtttcttccaaatctattcacattttctttttcttttttctttttctttttcttttttttttttttttttttttttttgagttggagtcccactttgtcaccaggctggagtccagtggcaggatctcagctcactgcaacctctgcctcccggattcaagcgattcccttgccttaacctccctagtagctgggactacagctgcgtgccaccacgcccagctaatttttgtatttttagtagagatggagtttcaccatgttggccaggatggtcttgatctcctgacctcgtgatccaccctcctcagcctcccagtgctgggattacaggcatgagccacctcatccaggcattttctgtctttctttccttctttctttctttccttccttctttctttctttctttctttctttctttctttctttctttctttttctttctttctttctttcttttgtctctctctctctctttctttctttttttttttttttttttgacagagtctcactttgttgccagactggagtgcagtggcaggatctcggcccactgcaactgccgcctcccagtttcaagtgattcccctgcttcaactcccaagtgactacaggtgcgcgccaccatgcccagctaattttcatatttttagtagagacggggtttcaccatgttggccaggatggtctggatctcctgacctcatgatccacccgcttctgcctcccaaagtgctgggattacaggcgtgagccaccatgcccagccgaaatctattcacattttctaccttgctctaaattttagaaacatggaaaagtagccattatatgaataatgttctgaccagtgttgaaggcatatgcatcatcatttaattcaagaaggggtagactgagaactaatttgtttactttatcttttcctaatgaaaattaaaatttcattactgtggtactcatgcatgtagacatattttaaagttatattatttatagtcataatttcctattttcatcatttttgaaaagtaataaaaatgttttactgtctccagacttttaaaatgtatctgaataacctttaaaaatgtgagtaaccataaacaaatgttttcttcaaatcctaattgacaattagtccctttttgtccttccttttttgtcatgagtttcaataatattacgttcaatttgctgagtagtctctgacatctgggctgtacaaatccaatcaatgacatttgacattatggagctgctcatggcatgccagacaccatgtcacctttgaagcagtctcttaaagtatccaaaagcgatcaggtcccgtttcatgaatatagttagaatgctatttgctttgcaagtaaaaagaacatcatcatgtaggaataagccctctgatattagctatattctttcagatattaaatagatgtacagaaaagattaaagaattttctaattttctgaggatgatagctcagtcatcccactattttgctaaaagtgaaaactctgtcttctctctcctttttttttttttttttttttgagatggaatcttgctgtgtcgtccaggctggagtgcagtggcaaaatcttggctcactgcaacctctgcctcctgggttcaagtgattcttctgcctcagcctcccgagtagctgggactacaggcacacgccactatgcctagctaattttttatatttggccagacttgtcttgaactcctgaccttgtgatctgcccaccttggcctcccaaagtgctgggattacaggtgtgagccaccatgcccagcccaaatctgcccttcttttatccttaccaaaatttttattgtgtaataactctttaccaacccaaatctgaagttttatggatataaaatgtataaggcagctagtccctttgctaagaggaaaaaaatctttccagtgtgcaaaaaatgagagtcactaaggtattttaatatctgaatattttttaattacattttgctgctttctttgcctttttcttctttcattcttatgaaagctgtgtgtacacaggatttatgagtagattccactgaaaagagagaatgacctccaagtccctccctcccttgactccatgtatgtggactatcatcacctgattcactttcctgcactctgatatcaatgtcagtctgtctcacacattctctgtggctacctaaaccattttcttggtggtgtccagattctcataatttggccttgtaccacccaacttaattttccaataaactgccaaatatattatccactaatgtgctatgtcctcctgcctagagaatcttctctttcctcatccatcgtaatggccatccttcaaagtccaaatcaaattacatcccttcccatgaaatcttcccaaattttcatctttctctctcctgataacccagtactctctatccgaatcaagtctccattgactttcctcttctgggaatctctgtattccaagcacctctcaaatctattagcattacacatagagttgatggatatggtaagtaaatgcatctgttgactgattgatttgttacaggtaaatttttatgtcctaagtattgaaaagaagtgacaaaagtggtatggacataaaggaagcagtattatggacaagacgtgacaaaatagagaagcccaaagtagcaacttttggagagtaaaaattttaagtatttacaaggctaatacactctattacctattcagaaacatttattgattggtatcaatcagttccacaagtcatctataaacctgcaaacaaatggtgcctaatttgcacagctggttgccatacatgatacgccggagatctgttctcactaaactaacaaggactttgttttttccactttgtatgccctgaacacagcacagtgcttggcacatagtagttgcccagtaagtatttgttgactgaaataatcaactaataaatttttaaaactttgaattgtgagcattgatactgaatcaggctggctacttaagctgaatttaattttgttactaaaatttagttaacattgtcaaacctgagcaaccgtgaaattacagaaataagtgttttaagttccactaaataaaacgttttaaatgtttacattttttaaagtgcctgaagctaagccaaaacaaagaagaattccaaccaggaggaaaaagttaaagctgttttttaacatccagtcaataacttgagtctctggtgcttttactccagagtagccatgccaacccataagccaaaaaggtagatccaaaattaacagttgtgttcaaagacaaaagcccaatgaaattataagtgatgtgatccaaggactgagcaaagataattgcatttactcaatgttagtttgcattataattgctattgtagccatcatcatcatcaacaccatcatcattcatagtacctatctatgtggtgtgggatagactactgacaatgagccaaggaattagggaggatgatggttaggtcaggttcagggtccagacactcaggcattaataaaagccaggtaacctatcaacaatactcatggtaccaaagacagagaaagagccccagcaagacataactgagccagagagttactgacactgagatccttatacataacgagattcttatacacactaagatcactctcataacaaacatttggcaaaattgccctgaggggatgaggaaaattcagatacggagttaggggttaaatgagctcaatgactgaaggtttacggactgtgagggatgaaaagttggacaggccattgcaattaacagagcttacccagcggagttcagacttcaaaaagttatcaacatcttttttttttttttgagacagagtctcactctgtcgcccgggctggactgcagtggcgcgatctcggctcactgcaacctccacctcccgggtttgtgccattctcctgcctcagcctcccgagtagctgggactacaggcgcccgccaccatgtccggctaatttttttgtatttttagtagagacggggtttcaccatgttagctaggatggtctccatctcctgacctcgtgatccgcccgcctcagcctctcaaagtgctgggattacaggcgtgagccaccgtgcccaaccaaagttatcaacatcttgattcagaatgtatagactaccaattccatgagtgaagacatatgtattttgttcactgcttccagtgtctaccacaatgctcggtacaaagataaatatttgttaaaggaataaataaattagcaactgttgccaggcacggtggctcacgcctgtaatgctagcactatgggaggctgaggcaggcggatcacgaggtcaggggtttgagaccagcctggccaacatggtcaaaccccatctctactaaaaatacaaaaaataggcagcatggtggcacgcacctgtaatcccagctactcgggaggctgaggcaggagaatcgcttgaacctgggaagcggaggttgcaatgagctgagatcgtgcccctgcactccagcctgagcaacaagagcaagactccctctaaaaaaaaataataaaataaaataaaaataaataaattagcaactgttaataattgctgattaattcaactataattctttttgttctcaccatacaataggtgccagaaaagctttacatttaacatacagttactgattgctcacaacttatcgtttttctgaagtctatgctaactttccaagccaaaagaaaaaaaaagctgtatctaatttttcataaccctagagatataagccatcagcatcttcttttccggaaaaagaaaattgttttcatctattcttccaccttcttttaactctcattttcacaagaaaaatatatatatataatccactctacataaagcagccagtgcaatctaccaaaacagcaaatctgaccatgtcctttccctgtgtacagccttctgtgaaaggttgccattggcatttgagggacttcatacctggcttaccagagctgccaggaactggagagcaggcatccagcctgacgtccctccacgcagacttcctttcaccagccatgccccctcctacctctgggccttgaaacatattctgcctgccggaaatgctttttctcactctctctcaaagctctatagaggtataatttatacataaagaatcatatatatttaacatgtactacgtgatgagtttagacatatctgaacacctgtaatatcatcatcacaatcaccacaatcaagacaatatgatttaaagagaaaccagagtactccatcaagacaatagacatatccaacacctcctgaagtttcctcatgttcccgtttttgtttgctagtggtaagaacaccagtattctctaatgcttatcaataaaagaatgtctctgaagccctacatctttcaaaaacattttaagaagaaatttttgaacagcaacatatagtagcatctaacaatcagaaatgcatactttaaagataaacatatactcaaaattcggaaagagcagaagaacatattttggcaggtgagtagatgttcctgtctgtcttgcataatgcctctggataacatttggtcaatctacccctttattattttccaactatgttttttattattatataatgttaatgagcatattagaataataaatgaaattacttaatgtattttggcattacattttaactgtaagagaaaaataaggctattaagggtgttctagacctttaaaatcatttttttctctttcaattctggtaactaaggactgaattactcaaagctatatctcaaaataatatacacagatctcactcatgctcgtgctattcaatctgcctgaataaatctgtcacttttaataatgtgctcagtattttaacgttaacaattatttccagagagtaatgctttgctgtataaaagctataaaaccaatagtgtcacacagcaaaagattatactatactatacgcacggttcaaataaatttaaagaacaattggtaaagcacttaagataaacttggtataaaatgaaaactacagaaaaaatgagaaataggtgttatttcccctaaattgacacacagtgctcatgtataaataagcaaaaagaattaccaatatgaaagtcaatcatatgatggcagctcaaatttaaaatatcattttatccctctgatatgtcatttctcttataatcgtgtttaaaaggtatcataaaaaatgaagttttgaaatatgttgaagaatgtgatttttaaaaagcaataaaaataataattctgtccacaccctgtatttggtgaaaggtagattatcctaaaatataactgccatctgggaatagatacattatcattttcttcctgtgactcacttatacatcatctgtagcctccattttttttccttcatctgagatggttgttatagctccaggagtggagagctaaaaagctaatagtgtccataaaggtcagtcttagtcataaaggagtagagatctgtgggttgatttcagaggcctcaaggaaggttcctgttcccaaaatatcttcttaaggatcccaaagtttattccacaagatgtattattttacctcagttaggaataagactgaaattatgagtcctccaaaggcatggcattttgacttaaatttatagcaatgtttagtatcaaagctattctaaatagaaagagtaggtggaaaggcagagagaggaagcaaagtgtaaagatgctgggtccccatggtggaaggagttgacaggaggttgccgcacgttcaagcccaagggcacacagtcttgccagtcagataaacctgggcttaagttacttcacctttgagagtccccaggtaaacatttgtaacatgagaggcaaaaaaagcacctggctgaaagagtttaggagttttttgtcaggggtggaggagggagttagatgagtaaaatgagtttataccatgtaaagtgcttagcttaatgcctaacacagagaaggcactcaatgatgttagttgccataattatccctgtttctgaaagtagaacagaaaaattctcatggcagataaatcaggtgtacctggctgcatgcctggaaaactcataaaggaaactttattagactagaggctatttaaaattgcatcctgccatgagatattctggtcctatgatggtttgttcaactagttatgcacttaatgataccagtagttcagaaagccattcttcaactatgctggagagaaagagaacatcgttttgctttgactcctcatgcaaacctgcacaaggttttattctcaggggaaacttaagtcaataaaagttatatgtttgacacttggtatagaatattccaaatttggatacagtgatgcttccatcagtaattccacaggaatgaagtttttttattaaataaaccataaattgtggttaggatataggggaataaaccctcaaacaacatatgaacatagaatatgcaataatcatttactcttagaaatgcccatgtgtaactaatgttactctacaaaaaataagagcaaaattagagaggcatggtggcgtgtgcctgtagtcccagctacttgggaggttgaggtggaaggattgcttgagcctaggacgttgagctgcagtgagccatgatcgtgccactgcactccaggctgggcaactatctatctaagttcctatctaaaagagtaagatcctatcgaaaagagaaaagaaaagtcaaaacgttaaaaaaagtttataaagtaaaaagcttacagtaagttaaggttaacttattattaaaaaataaaaaatcttttaaaataaatgtagtgtagccttactgtacagactttataaagtctacagcaatttaaagtaatgtcctaggccttcacctttactcaccactcactcactgactcacccagagcaatttccagtccagcaagccctgtgcattgtaagtatcttaaacaggtataccattttttatcttttatatcatgtttttactgtaccttttgtatgtttagacacacaaataattaccattgtgttacaattgcctacagtattcagtgaagtaacaagatgtacaagtttgaagcctaggagcaataggctgcaccatacagctaggtgtgcagtaggctataggtttgtgtaagtatactctatgatgtttgcgcaatgatgaaattgcctaaggacacattactcagaaactatccctgttgttatagtagcaataatgcaagaggaaatagatatatccctaaccatagcaagaaattttagtatacctctatgaaaattgatagataaaacagtcaaaaaatagtaagaatttggaaagcttaaataatacaattaacaagcacaaacagcagtctatattcaacaagtagagaatacacatttgttgaaagtaaacatggaacacttatagaattggactacacactagtctccaaaacaaatatcaaaaaatcaatatcatatataccaccttctcactgtatgttctatagtaaaataaaattcaaaatcaaaatccaaaagacacacctgaaattctatttatttagaaatttaaaagcatttatttataagtaatgtttgagtctaaaaagttagtattgggactaataaaacatttataatgaaatgccagtggaaaaaatacatattaaaacttttggcctagagttgatgtaatattgggaaagaaattcatagccctaattgcctatgcttaaaaagaaagattgaaaattgatcattaagttatttaactcaagagaaagaactagaacagtggcaggagtacaaagacataaaaagaaggaaattgcaagaacaagaacagaaactcataatgtagaaatcaataaaataaggagatgcacaaaaaagccgaaagctgatattttttaaagactaataaaaatatttttaagaggctggataaagacaaaaggaattatcaaataaaatatattaggactgaaaaaggtaaagtaactgtagagaaaaattaaaagaattaaaagagcatactatgactctatgacaatacattgtaaaacaaataaaaataaaaattcataaacctggttcaaacaaactaaagatatacataacttttgtgtttgtttttgcttttattacttttttcttttcttttttttcttctttttttgggatacatatatctttatatgtatatgtgtgtatagatacatatgtgtgtgtgtatatatatctgtgcgtaattgaaatgatttttgagctcacatctattcaccaaagaagctgaccctttgtacagcattactcccatggctatcactgaattgaaacctccttaaggatgggactattttgtcctgagattttcttcctccagagtatctagcacataatctgatttacttttaaaaaacaccactcttctactgggtgatttgatgagactagagcaacattttcagttaacgagttcttgacatggtcttgctgttggtaaaaatgttcatattactctatcaatttgagcatcatgctttgcttattagtcttcagagatcaaatttccatggaatttatttaactgacaaaaaaacaaggttatttatttccttatatctgttgttctcttttcttacagatattaaatcataagacttggaccttgactatgaactccacagtacactaaaactagtttcaaatgaaacaaaacaggagtatactaaaataaacaagtgtataaaaaatatttttcccattgataatgatctaaactattgatatcgagggaattctccaatttgactacatttccaaagatcactacagcactgccaatgcatagaagtgcagtttctatggactcatcattgaaaaacaagagggagagaaaaaagcagttagcacaactgtcttcaaaaacaaatacaaaactattttcagcagaatagagcacctgctttattgaagtaaatacaaaatagaaaggtaaagcacagtattttccaggtgaactcactgcagccactgatgatgtcagtttgtttccttcccttttcctttggcagaagggaaagaatcctcaaatgttcaatgagccaaccaatgctgccagtttattcaataacatttgaagtaaggacaaaacattaaaaatataaaatctatggccttgtgcaaattcatagcaatttaatgggaaaaacaacactatcattttggttttgaaccaaaccaaaagttatttaagagatgatctaaccaaaatattctatatattacagatgagtcagtttcaagtcacagaggcacaagtgatggctaaaatgcagtaaccaggtcatattttaaaaagaaaaagttcagtttttcagatgaaaaatcatgtgtagatgaaggaaaatttgtaaatcattggaggaaatcactttattactattgttattgctagtttattaataatttttagttgtactggactatacagatatgagtgaacaccaaaaaaaactctaccaagatatgcaggtactaatactctggtataatttttaaaagtaggccaggagctgtggcttatgcctgtaatcctagcactttgggagggtaaggcaggagaatcacttgagtccaggaattcaacaccagcctcggcaacatagggagactttgtctctacaaaaaaaaataaaatttgaaaaacaaattttaactatttacaaagacaaatatctatttttattataaaaaattatattttggtgactataaacttgtgaaaagacatgaaaaggcataacacattttataaaaatgatttgtatttaatgatattacatataaaccactaaaatgatagctatagatgtctacatatacaaaatatgcatatatgcatgcatgtataatatatgtatacatgtattatatatagtatagtatattaagcagaaatgtttttcaatatatttccatgtaactaaaccttgtatatatcactgcagatttctttgtcttttcatagacagaaatattttataacttgacatgagacatctgtcacagagaatgacagtctcatacattttagcctggctccccacctccgccttggattcaagaaaaacattttgatgattcacgcacagtgtaaggataatatgacaataaaatgacttcaggctatgtaagcccataaataaagggaaatcaaacctttcatacaagtaaatccacgcaagaaatcaatttgtaaaattgaaaaaacttcttctaaatgggcatgatgggtataagtctctaaaaagaataaacacatccatttgcagtttcattttttaacacattctctcagagtttcactcaacccctccccaaaaaatattttggagttttatggtgcccagcataaatttccttctaatttcttgcttttgaaacattctcaatgtgatgtgatttattagttgataggaatcaatcatttgttttccacagttaaccatatcggctagagcagagtttccccaaccttaatatgcatataaattacctggggacattattaaaatgccaattctgatgcaatagccatgggatgggattccatttctggtaagtttccaggtgacaccgaagctgctggtcagcagcctgctcatcatatactgaaggactagaagattttggctatagttatttgttttctttccctctcatacacaggcattcaacaaacatgctgagcatgaactgtgaatcagccattgagctctcagaaaatgtgaatttaaatgtaagcagctttatgaagattttttttcctttatattttgcttattccattcggttatggaaaatagacttcaaaatgcctaagggaaaatatgatttacgaatatttgttagacttgattgaaagtaactaatgttaagttatttttttttcaaactaccattgaaatcttggtgaaacaatcttcttaaagccttactaaaaagaataccttacagtctcactcctaacagaaaaactcagccaggcagttcacttatgagagtcaaccaaaagttcattttcttcaaccctgtcaaaagaaagttggtctgcaattagatagatttgggtgaaagtacaacatatttcacttacttgtatgaccctgggcaacttttatcaacttcctgagtctccatttttcttacctgtatacatgagttaataaagttatcttccattcatttaaaacatatttattgagcacctaccatgtgttaggcactgttctagcacttgggatgaatcagtgagcaaatgaacatagacttcttcctcatatatctcttggatagaaatgatgtacattaagtagcccttgccacacgcctaacactctctctatttagtagctttcaactctttgatgctttccaagtaactcccaggtaagtaaaactgtcattttcttaaaatttgagatcatttatccttagtgctttattatatgccagacatattccaagtactttggatatgtgtctaaactcatgtaatcctcgcagcagcccaaaaggaagattggtatgctcattttacaagaagaacacttactcagaaaggaaattaaggaattctccaagatcacagagctagcaaatagcagagctgggatccaaactcagtttggcctcagacaccccactcttaaccacaacaccttggagtaatgaaattagaaccaccgtaaacaagtccagaaagttacacttcgtgtactgaatagctctaaactgtggattagctaggcttattgtgccctctggtggaaatccaatgaagtaaatgaaaaggaatattaagtgcaatagaaacagaaaacggcgagtttactgacatcctgagcttttgaaaagttttcaagctcatgaacatggcaggaaaatcttccaggaacaagacaagaataccagcaagagtctaaggaatcagcaggctgtagatgcctcgcacgctgactccacacagcagagccttcagagtgacaactgtgcaaaggaaactgaagataaaatctcaagggataatatcagtgttagcaatcttagtagaaataattttaagtaaaaacatatttatcagcgtgccaaaaagcattatcacgaatctactgtacaccaccttctcaggaatgaattgctaacgggaaatgtgacgttctctttgtactgctagaattgtcaagattcacgggtttctgagacgatgccctcctaaggccttaggaaccacttccgcactccttacccaccccttagttccaggtaaagcctatgtggaataatatattatttctttgttcatcagagtttgcagtcaagcaattaaagtcaatgggcattaaatgcaagttgactggtccaactcaacgactgcacagcattttatatgaagttactagtgctgttcctgtatacgggcatctgaggaagggcgggaactgttactgtcctcttccctcttccctttggtctcgaaagtgacaagctccttgttgccaagagattctcagaatgactctgtcactatcccctgtattccctgtagtagtgagaaactgttaccctcaactaccttctttggctagggattctcctttctttattgcggtctctcaggaagatggtgttgacactggacattgcttgtgcatccatcttctgagactgtgtgacttttatgtaaatgttagtttatctagaaagaaagaatatgatcttatatgccttgtcctagaaaattaatttttcagtagagaaatccactagcattataccatacccttctccaattcaccatctacttatttatttatttttttaaatgttcatttatttatttatttattttgagacggagccttgctctgtcaccagactggagtgcagtggtgcgatctcagctcactgcaacctccgcctcccgggttgaagcgattctcctgcctcagcctcccaagtagctgggactacaggcacattccatcacgcccagctaatttttttgtagagacagggtttcaccatgttgtccaggatgatcgtgatctctgacctcgtgatccacgcgcctcagcctcccaaagtgctgggattacaggcgtcagccaccgcgcccggcccaccgcctacttatttaaaatgcttctaatttatgggagaatcatttgagcccaggagtttcaggctgcagtgagctatggtcatgccactacactccaggctaggcaacagaacaagaccttgtctcaaagaaaaagaaaaaacaaaaaagtttagttaaaaagattagcactagtccttaaaaataaataactacttaggtgtgtttagaactcgggtcactaatgcatgtctttctctggggtgtcacaatctctaatgtcgcccctgagttttcccttctgctatcctattcttagggctttaaaaaagttttctatggaattttcctaactcttagagcgaaatagatattggttttcatagtatgaggagaaaataaattatgacatttactttttttcacagtagcaaaggaatttctgaaggcatctgccttcccactctgaattcacacagtaatttgctagtgtacccctcaattgcccttaccacttctccagaaaccacataagcttcttgaccatttcacccctgaaacaatcccaggacataatacaataggttgcacattttaaagaggggaaagaaaaaaaaaaaagggcaatgattttcatgattcaagattcccttcagtaatttatttgttctgatcgtcttgttaggagtaattttccttccgttccattttatattttgcttattttgcatttatttcattttatcttctattttaattagtatatatttttggtttttctccctgcctcctagactttctcaggtggacttcctacctggccatacaacccagaaacttatttacgtgataattttcctaatttcctcaaggaaggtacataacttgtaccattctagatgcctaggaaaaatgttaactcattacatataatagacgcactaggttatgaaagctcagttctctcctggacacctggttgagaaagactctgcattagacgtcacccagcatagttcattatgcatagaaggcactcaataagcgtttttgtaaacaaacagataaatgaatggctctaaacttttaagtgtgagctttgaattcattttaagatccattcagtccacactttaacagaattattttctagtagtaagtttactttctctgcttatctactgaggacaaaaaagcttttcaattctcagaagtaaataaaatatgagatagaaaatttagcatcagattattccagtcttatcaaaattctagaattatgtattaagggacttcattattttgactatcatacacgtacagatacttgtaagcattaacactttggccttaataaaagatctacaacagctacactcatttattttgtgtcagaaattgcattagtattttatctgtattttcaaatttaatcattttgttaataatatcagataggcaatattgccttctctttataagtatgaaaactgaagctcttagatgttaaaaatttgcccaaggttaaatagtatgtggaaaggttagaattgcaaagcagagatatctaatggtaaaatatcattctttacattttgggacactattatcctacaggtactgtgtgtaaataaaagttcggatatatctaatatatgactatgtaccctcttctactcatggatacagttatcttttgcatattgtcaacataaaaagaattgtattggccaggcgcggtggctcacgcctgtaatcccagcactttgggaggtgaggtgggcagatcacgaggtcgagagatcgagaccatcctggccaacatggtgaaactccatctctactaaaaatacaaaaaattagctgggcatggtggcgtgcgcctgtagtctcagctactcagaaggctgaggcagaagaagtgcttgaacccaggaggtggaggttgcagtgagccaagatcgcaccactgcatgccagcttgggtgacagagcaagactgttgcaaaaaaaaaaaaattatattaacaaaatgtagtggatatttaactatcagtgcttaaaagaaaggagtgaatagtttcttccatttgcactttcattctaatgaccaggcacttctttttattactttgtctattctctaatcctcacatgaatataaagtccaagcctttggaaaccaaatgataaagtgtagctggactttttgaccattatcttcattcctatctgtctccaataggtaaatggatttgggaccaaaatataagccttagaaaccaaaacaaatgaggcattagcaaagtaaaactttgcaaacctagacttacagattcttgagagacttcaaagctcaggatgaagggaaaagtttacttctgaggaaagtgagtagagaaggcatttgaaaaggtcacagcaggttctaatgcagaggcaaagccaagtttaatggcactccattcacactcagagaagatgtctacctgaatctatctagtcatcctttcattcattgattcattccagaaatatttactgaccactttctaggtgacctttgttgataacagtagtttcctgtcagtttaagggcagaagccaaatgagtcagtcactgcaaaaccacgaggggtaggagtttggaaggatactattacagtcaattcaaatgaaatctgttccttcttttatttaggaaatgccctccaatctccatatctataacttgacttgtcttttaaaattatgagagatctgggtattaggttactattaggttactataccatgacatatttaggtttcggtgccaggaaagactcctctggtacttatttattgtgtggtcttagaccaacacagtccaatagaaacataaagaagtgggtcatatataattcaaaattttcctgtagtcccagcactttgggaggcagagttgggcagatcacctgaggtcaggagtttgaaaccagccaggtcaacatggtgaaaccccaggagaattgcttgaacccaggaggtggaggctgcaatgagccgagatcacgccatcgcactccagcctgggcggcagagtgaaactctgtctcaaaaagaaaattctaattgccacacacaaaaaaagtaaaaataaacaagtacaattaatgctcatagtattttttttactccactatatccaacatatcgttatttcaacatgtagtcgatttaaaattactgagattttgcttttcttcattccctgtgtgcagtatgtagtgtttattttacacttacagcacatctcagtttggctttgaaagagccacatttcaagtgtgtggtagccacatgttgctaccgcattgcatagtgcagatctagactttaaatataagcagtggataaaaatgtcgaagagaaacaagatttgtgtctttcgtactcaagaccaaaaaataaattgtttatatcttcctatcctagcttaacacttcatgcagacttcattttatattctgacaacgtacattgaatagaatagcagtaatattgtttcatccctttttacagtcaacttcacatgaatagacaaattcaaaagtatgatgttataacagcaccatcttgtggcgttgcatttacattgctgaagcagaattggggaaaaagagaataatgccaaacagtcaagatagaattaggagtttaagaaattagtagaggtactatcatttttctttctcttatatgcagtcttttttttttttggtgggggggcagagtttcactcttgttgcccaggctggagtgcagtggcacgatctcggctcaccacaacctccacctcccgggttcaagcggatctcctgcctcagcctcccgagtagctgggattacaggcatgtgccactatgcccagctaattttctgtttttagtagagacggggtttctccatgttggtcagtctggtctcgaactcctgacctcaggtgatccacccacctcagcctcccaaagtgctgggattacaggcgtgagccaccgcaccagaccttatacgcagtctttatggcaggtcttcaagttgtatatactgggtatgacacactttctggacataggacatgaaaatgctaatttctgaattccagataacactctaacatgagcgttggagaatggcaagcaggcttcagtgctaatatgttaatatggtatttgtttcactgaattgtgtgagacgaaagctgagaacacccacaaaacaccagtgcatatgaacacactgagattttaacactaaaatataatccccgccatttataaataccaactgagctactacagggctgccaaccctaaacattcctcattagaataaaggcttcaatgaagctgtatctgccattaaataatcactcaaccaatctgaaattccagttggtcccatactatgttaggatggccagatataaccatgtgagaacatagcctggtaagtggtttgaccagaagtcactccagagctggccttcaagttcagcccatatttggccagggtaagcttaaggacctttctgagtcttgtcatgtattcttgccacaacgtaagccatctaatgaatctttcaaaatagactttatttaattcaatctagaaaacacataggtcttctctggatgctggaatacaaaaaaagaagtttgagtaagcttgaagctagtagaaggactttctgtaaagaatgaataatttttaaaagtagcatatatatcacaggaaccatgaaaatacatctagacgttatccattctcccttatgtaacaagctcaaaatagtccatttttgtgattagaccagtcttaaacctattttggcctggggagagtgagctcttttttgaagaacactctatacagccacaaggtggctgtcatcctgtacctaagccagtatcaattccacgtcaaacaattacatgtctcagagtcctggggaagacctagtcttttcaatattagttactatagcaaatcaatagatgtgagacagctgctcatctttctcttgcccaattctcctagaagggtgggcccgctcctattagttatttattcctgcataacaagttattccaaaacttagaagcttaaaacaacaaatgttggttggacacagtggctcacacctataatcccagcactttgggaggctgaggtgagtgaatcacttgaggttaagagtttgagaccatcttggccaacacagtgaaaactcatctttactaaaaatataaaaattacctggcgtggtggtgcatgcctgtaatcccagctacttgggaggctgaggttgcagggagccgagattgccccactgcactccagcctgggcaacagagcgagattctatctcaaaagtcaggaatttgggagcagttcggctttgtagttaaggttgcactcaggatgtcagcagggactaaagttgccaaaaggcttgcctggagctagagaatctgcttctaagaagactcacagacctagtaattggcaggaagcatcagtttttctccactcaggacttccaaagacctccgtttctcatagtgtaggcctctccataggctgctcataattgacagctaccttcctgcagagtgagtgatccaaaagagaaaaaaagaggcagaaagcacaaggtctgttataatctagtctcaaaagtgacatgccatcccatagaccaaagatgatacagcatgggagaggagtacacaaagatgtgaataccaaaaggttgggatctttggagacaatttcagaagctgactgccacagtctcctctggtcctcagtgactcacatccttctcacaggaaaaatacacttaccctttccccagactctcaaaagtttggaaaaaacttatattatcccgttatagcttcaactcaaaagacagaatcatatttaaattaggtcctggtatagatgaggctcttcaggtatgttcctcacatacaattcctcaagtatggttcctctcaatttaaaaatctatagactaaagggataatttatttgtccttcaaatacccaacatacaatggtggcacagccagaggagtgccctatgatcaggaacaagtcaaagatgtccactgttatcacttttattcaacattgtatttgaagttccagctaaagcaattagacaagaaaaataaataaaacccatccaaactgcaaaggaagaactggaatccttatacattgctggtgggaatgtaaaataatgtgctgccgtgaaaaacagttcagcagttcctcaaaaacctagacatagagttaccgtatgacccagaaattccactcctaggtaaacccaagaaaagtgaaaacatatgtttacataaaaaacttgtatatgaattttcttataagcagtattcataatagccaaaaagtggaaacaagtcaaacatctattaactgctgaatatataaacaaaccatagcatatctttacagtggactattgtttagttagaaaaataaacgatgtacttacatatgctacaacacggatgaccttgaagacattatgttaagtgaaagaagccaggccgggtgtggtggctcacacctgtaatcccagcactttgggaggtcaaggcagatggatcacctgaggtcaggagttctagaccagcctgaataatataatgaaaccccgtctctattaaaaaaagaaatacaaaaattagctgggcgtggtggcatgtgcctgtagtcccagctactcgggagactgaggccggagaatcgcttgaaacagggaggtggagattgcggtgagccaagattgcgccactgcactccagcctggtgacagagcgagactccgtctcaaaacaaaacaaaacaggaatgtgaagaattctcagcctggccatgtggtagagaatgaaagaatattttcaggaaagggaaccaagagtgtggccaagtaattgattgataaggagattagtatggatagaacaaagccagagctactaattaggacaatgggagaataacctcaaaggtactttggagattactggcgtagcccctcccgtcataggcccagagtgtcatgatctgagggaaggaaatcctgcaaaagagagcctagggtgcgctgaagatcttggggtttacttcccagggctgcctcaagtctctgcttcccacattctgatgcagcactccttgaccaccccaggtatggtttaaaggggttcaggtgtggctttggctccagcttcagaaggtgtaagtggcagtatccacatgatgttatgtctgcaggtgtgcagaatgcaaaagctgtgggggaatggtttcctccacctggatttcagtgaacattagggactacctgggaacacaggcagtagacggttgcagggctggagccaccgtcgagagcccccactagggcaatggctagtagagctataaaggtgggtccacccccaagacactagaattacaatgtgcaacaccagcctgggatagctgcagtcacctgactccaacccatatacccagcaaagccataggagtgggactagctgaggtcttaggggctcaactcccaccccagtgtacccagaaggtgggcataaagtcaaggaggattattcttggagctttaaaatttaatgttgttggcctggctcagtgacactcattcctataatcccagcactttgggaagcagaggtgggtggattgcttgagcccaggagtttgagactagcctgggccacatagcacaaactcctaaccctattaaaaaaaaaaaattgttaggcatagtagtgtgcatctgcagttctagctgctctggaggccaaggtgagaggatcacttgtgcctggaaggttgaggctacagtgagctgtgatctagctactgcactcagcctgggcaatagagtgagagcctgtctaaaaaaattaaatcgataacattgtttaccacattggctttaggactttcttgggaccagttatctctttctccttgcttatttttcccttttggaatgggaatgttgatggtgattgtgaatcctaggtttttgtcttctaggttaaaagaatttaaacaagagacacacagcaataaacagcatgaagcaatatattgcaaaagaataagtatattctgaaaggtaggtgcaaaagcaataatagtacactctgagagctgagtcagagtaggctgctcgagagtgagacagcattgactattacaagggaaactctctttatggaagtcttacatgatcattcataagggggtgggaaaagacattgctattgggttggtgcaaaagtaattgcagtttttgctgtatttttaatggcagaaccacaattacttttacatcagcctaatagtaagtatattacaggtgttctctgggtacacatgctcagtagctgtacatgcttgctttgtttttgtttttgttttcgtttttgagatggagtctcactctgtcgcccaggctggagtgcagtggggcaatctcagctcactgcaaccttcacctcccaggttcaagcagttctcttgcctcagcttcccacatagccaggattacaagtacgtgccaccacacctggctaatttttgtacttttgctagagatggggtttcaccatgttggccaggctggtctcgaactcctgacctcaagtgatccatccaccttggcctcccaaagtgctgggattataagtgtaagccactatgcccagccatgtacatgtttgtttatatactgtgggtcccattcacatcttaaatctcctcccagtggtgtgttttttactattataatgagcaatgagtcagtctgcggacaagtaaaattaaaatgtgcatactgtctacaggataaatttcctggccaggcacagtggctcatgcctgtaatctcagcactttgggaggctgaggcgggtggatcactgggtcaggagttcgagaccaacatggtgaaactccgtctctactaaagatacaaaaattagctaggcatggtggcgcatgcctatagtcccagctactccggaggctgaggcaggagaatagcttgaacctgggagccagaggttgcagtgagccgggatcatgccattgtactccagcctaagcgacagagcgagactccatctctaaaaaaaagaaaaaaagaaaaattcctactgaggatagttctgtgcttgattatgaagccagtagtgagtgctctttgtttgtttgttttccagagtgccagggttttatcacaaatggagttgactgctagagaggcccttctccaatctttcttctgtaccctcttctctcccaaagacatccctccaggggaagtcagtaggccattagaaaggaggaaatatggagagtgaaaaggggcactgcttttgtcaacatcctctgaaacaaccactgagtcctttgggctccagttgagaatcttctagtggaagaggtttagctctcatcttcaaggtccttcatttctatgtcctgggggacttttgtcctcttttgcattttgagctgtggttcgatagtcctggctggctttgacgggcttccacctccatggctgccttctccatctgggcaagccggatctgccggaggagttttctaggcttcttcccctacagagtaatgttggcacgtgcactggatgcctgcttcttgaggtggtgccgcgtgatcagcgcttgatctatcacagcttcgaccacccagtgcctcagacgctgcttgcggttcaacaccggcctgcgctgatcagctttttcttcagctcggttcggcgccagttgatttttccccccgggatcccccacagttgctcggcgacgccaatatgcggtccgtacttccgcctggggtttgttgtattggtgtggttttcacttcccgaggacatggttgtggggcttgctgttgtggtgcagtcgctgaatcccaaagacatggttacttccctgactacctatcttgcctcaggaatgtctatgctatgcctgtcccaccactgtattttggaagcacataacgcttggaagcacataacttgcttgattccacaggctcatgcctgaagtaaattgcctccttgccatcctgccttgactttagcctatatcttatttagatgagactctgggctttggacttttgagttgatgctggaatgatttaagccttttgggggctattagatgaaatgcatgtattttgcaagaaagacatgaattttggggcccaagggaacaaaaaggctatggtttgaatgtgtcctcaaaaaagcatgtgtgggctgagcaccgttgcttacacctgtaatctcaacattttgggaggccaaggtgggaggattgctttagcccaggggttcaagaccagcctgagtaacatggtgagactctgtctctaccaaaaaaaaaaatcataacaaaaacttagctgggcatggtggtgtacacctgtagtcccagctactggggaggctgaggtgagaggatcagttgagtctgggagattgaggttgcagtgaaccatgatagtacgactgtactgcagcctgggtaacagagtgagaccctctctcaaaaataaattaattaattaaaagcatttgttggaaacttaatttccaatctaatagtgttgaaaggtagaacctaatagaagatgtttaggctataagggctccaccacttataagtggattaaggttgattacaaaggggcttcaggctgcaagttcaatctcttgcccccccttttttttttttttttttggagatggagtctagctctgtcacccccaggctggagtgcaatggcacgatcttggctcactgaaacttccacctcccaggctcaagcaattctcctgcctcagcctctggagtagctgggattacaggtgcataccaccacacccggctaatttttgtattttagtagagacggggtttcatcaggttgcccaggctggtcttgaactcctgacctcaggtgatccgcctgcctcgacctcccaaagtgctgggattacagacgtgagccaccgcgcccagccttcttgcattttctttgcccttttgtcataaaagagtgcagcaaaaaaggtccctgtcaaatgtcagccccttgatcttggacttctcagccttctgaacagtgagccaataaatttctgttcattataaattaccccgtttcagataatctgttatagcagcacaaaatcaagtgaaaaacttggtgaataaccctattaatgtcttattgaattcagtttactagtattttgttgaggatttttgcatgtatgttcaccagagattttggcctataattgtctttttttgtaatgtccttgactggctttgatttcagtaaagttgcaggatacaaaattaacatattaaaattagtatcattgctatacactaacaacaaactattcacaaaagaaatcaagaaaacaatcctatttgtgatagcattaatgaaaaacttagaaatacatttaaccaaaaataaaattaaccaaatacattcagtgtatgagagatccatacactgaatattataaaacattgatgaaataaatttaagagaaaaacaaatgaaaatatatacagtattcatggattggaggaattaacattgttaaaatgtccatattaccccagtgatctacagattcagtgcaatccctgtcaaaagtgaaatgaccttttcccagaaatagaaaagaacaaccctaaagtttgtataggaaaacaaaagacctcaaatagtcaaagcaatttttaggaaaacaaagctggaggcatcacaatacctgacttgaaaatgtaccaaaaacgtataataatcaaaacagcccatactgtcataaaagcagacatatagaccaaagaaatagaaaacagagcccacacatttacagtcaactgattttcagcaaagctgtcaaggacatacaataaggaaaggacattctcttcaatatgttgggaaaattagatatcaacacccagaagaatgaaattagacccttaatcttgtcccaagtacacaagtcaaatcataatgggttaatgtcttaaatataagatctgaaactataaaaccattaggggaaaacagagggaaagagcttcttaacattggatttggcaaaaattttttggatacaaccccaaaaacacatgcaacaaaagcaatattagactaattggattgcaccaaactaatgagcttctgcacaccaaaggcaacaatcaacagagtgaagagactatctatgggatggggagaaaatatttgcaaaccacatatctgataaggggccaatatccaaaatatttaagaaactcaaacaactcaatagcaagaaaacaaccagtttaaaaaatgggtaggaacctgaatagatatttctcaaaagaagacatgtgaatggccaacaggtatatgaaaagatgttcaacatcactaataatcaatcagggaaatgcaaatgaaagccacaatgagatatcgtctcactagaatagtctttatcaaaaaaataaaacataacaagtgttaacaaaaatgtggagaaaagggaaccctagtacattgttggtgggaatgtaaattagcataattattttggaaaacagtatggaggttccccccaaaattaaaaataaaactattgtatgattcaacaattatctttctcagtatgttaccaaaggaaatgaagagatattccctcctccatgttcatttcagtattattcataatagtaaagatatggagtcaacctaagtgtttatcaactgataaatggataaagaaaatgtgatatatatacatagcatgatactattcagccttatgaaaagaaagatatcttgccttccacatggcagtcttgcaacaacatggatgaatgtggaagacatcatcctaagtgaaataaaccaggcacagaaagacaaaagacaaactgaatgatctcacttttatgtgaaatcagagtagaatggaggttaccagggactagggtgggtgatagtgaggtggaaaatggagaaatattggttaaaggataaaaagcttagttagataggaggaataagttctggagatccactgtgaagcatggaggcaatagtgaataataatgtattgtatgtatatttgaagactgctaagaacatagatttttaaatgttctcaccacaaaaaaaagataagtatgtgaggtgatggatatgttaaatcattctacagtgtgtgtgtgtgtgtacatatatcaaagcatcatgtaccccataaatatatagaatcatttgttaattaaaaataacttcaaaatgacaaaaataaagatgttttcacatgtacataggctgaaaaaaatcaaagaccagcatatctgtattataagaaaaattaaaggaagtccttcaggcacaaggaaagttttatcagatagaaatatatttatttctacccaaaggaatgaagataccagaaatgacaactgtgtgggcaaatacaagtataagaaaactttctcattacataaatatcttagatgataaacaaagaaacaaaaataatgtagtgtatgtatatatttgtgtatatatatacacatatatattgcactaacatgtatgataacagcacaaagcttagagggaagaaatagtatggcagttttatactatatataaaagggtacaataatatttgaagctagactcaagttaaaaagaaatactataaatccagaggtaatagctaaaatcacaaaatagaattatagctaattagctaataaactagatataaaggaaccataaaaataatcaaaagatggcaaaaaagagaaaaaaatggaataaagaacaattaccaaatagaaaacaaatatcaagaaagtaggtttaaatccaaccatatcaataatcccatcaagtgaaaattgtctaattatctcaaaagacaaacatttttgaagtagattaaaaaaataaatgaatacttgactatatgctgtctgtaagaaacacactaccatagaaaactacaaaaaaagttaaaaatggatgaaaaaatatactatgccaatattaatttcaaaaaacaaaacaaaactggagtgcttattttaatataaaacaatgtagattccatagaaaagccacatccagggataaaaaggtcatttaaaaatgataaagtgttcatttcactaagagaacataataatcttaaatatttatgcaactaatgacagagcttcaaaatacagacagcctctgacttacaaattttcaactttacaatgtgcaaaagggatacacattcagtatgctttttgacttatgaagttgtgcacagataaacacactgtaagttcaaacagtgggtgtatccagacataaccacattgttgaggagcatctgtacttaaaagcaaaaactgatagaattacaagaaatagacaaatccacaattacagctagggatctgaatacttctcactcaataatagcacaaatagatagacatcagtaaggatatagaagatatggagagcactatcaaccaagttgaaccaattgatatttataggtcattttaccaaagaacagcaaaacacaccatattcccttcatagagcgtattataggccaaaaacaaatactcaataaatttgtaagaattgagtcacacaactgttttctctgaccaccatgaaattagaagttaataaaaagatatatggacaattccagaatattggaaaagtaaataacagacttatacataacctacacatcaaagaagaaatccaaaggaaaattatagaacacttacaaatgaataaaaagaaaaggacaaaatatcagatttagtggtatgccgctagaatagaatttggaggaaacttttaggactaaatatttatattaggaaagaataagggtctgaaatcaatgaactcaacatttaccttaagaatccagaaaaagaatgtagaaaaagggcaaattaaagtccttcaggcacaaggaaacagaagaaataaaacaaaaaatcaattataaggaaaaacagggaaaaatctgaaaccaaaaatgagttatttgagatccatctaagtgataaacctgtagtcagactgatcagtataaggggagaaaagacagaatttatcaatattggaatgcaagagatgacattaatacacattctataaatattaaagatactagaatattgtgatgactttattccaataaatacaataaattaaattaaaaatgcattgaaatatacaaactactaaagctcactcaagaagaaatagataacctgaatagccctttatctattaaaaaactgtatttcaaacatcttttcacaaagaaaatgacagactcagatggttcccttgtacaattccagcaatagtaagagaagaaataataccaattctacacaaacatccagaaaattgaaaagaaaagaatatgtcccaaagacattgtatgaaagctacagaccaatattcatcataaatataaatacaaattcttaacaaatatatatttatacatatttaaatatataataatgtttaaaaaggataatacattgtgatgaagtggcattaaccccaggaatgcgagattgctttaacatttgaaaatcaatcagtgtaattcatattaacgaatccagagagaataaccatatggtcatatgaattgatggagaaaaaaagttgacaaaatccaacagccatttctgataaaaattctcaacaaactaggaataaaatggaacatcatcttgataagaggatatgtgaaaaacctacagctaacatcattctgaatgttttcccctaacatctggaacaaggcaagggtatcttcatcaacattttttatttctattttactggaggttttagccagtacaaattggcaaggaagataaatacaaaccatatagattgaaatggaagaaataaaactgtatttatttgtagaagacaaaaatcacctacagagaacaagtgatagactttcaattataactgaggtttgcaaggttggagaatacaagatcaatataagaataaattgtatttcaatacattagcaataaatcattgaaaattgaaattaaaatgccatttacaatagcacaaaaaacagggataaatctgatgtaaagtgcacaagacatacaatgaaaagataaaactttgctaagagagattttgaaatatggaaatcagtggaagaactctatgttaatggattgaaaaactcaaggttgctaaatgtcagttctgtataaattggtctatagattcactgtaatcccactgagcccacgcccacccggaactggccctggcccacaagcaccgcgcgcagccccggtccccacccacgcctctccctccacacctccccgcaagctgagggagccggctccggccttggccagcccagaaaggggctcccacagtgcagtggcgggctgaagggctcctcaagtgcccccacagtgggagcccaggcagaggaggcgccaagagggagcgagggctgtgaggactgccagcacactgtcacctctcaatgctatccctcccccagtcccccagccccaacaggccctggtgtgtgatgccacccccttcccctcatgtccatgtgttctcattgttcaactcccacttatgagtgagaacatgtggtgttttgttttctgttcttgtgttagtttgctgagattgatggtttccagcttcatccatgtccctgcaaagaacatgaactcatccttttttatggctgcgtagtgttccatggtgtatatgtgccacattttctttatccagtctatcattgatgggcatttgggttggttccaagtctttgctattgtgaatagtgccacagtaaacacacgtgtgcatgtgtctttatagtagaatgatttataactctctgggtatatacccagtaatgggattgttgggtcagatggtatttctggttctagttccttgaggtatcgccacactgtcttccacaattgttgaactagtttacactcccaccaatagtgtaaaagcttttctatttctccacatcctctccagtacctgttgtttcctgactttttaatgatcaccattctaacaggcatgagatggtatttcctcgtggctttgatttgcatttctctaatgaccggtgatgatgagctttttttcgtatgtttgttggctgcataaatgtcttcttttgagaaatgtctactcatatccttcacctactttttgatggggtttttttcttgtaaatttgtttaagttctttgtagattctggatattagcgctttgtcggatggatagattgcaaaaattttcccccattctgtaggttgcattttcactctgatgatagtttcttttgctgtgcagaagctctttagtttaattagatcccatttgtcaattttggcttttgttgccattgcttttggtgttttgttcatgaagtaattgcccatgcctatgtcctgaatggtattgcataggttttcttctagagtttttatggttttaggtcttatgtttaagtcgttaatccatcttgagttaatttttgtataaggtataaggaagggatccagtttcagctttctacatgtggctacccagttttcccaacatcatttattacataggaaatcctttcctcattgcttgtttttgtcaggtttgtcaaagatcagatggttgtagttgtgtggtgttatttctgaggcctctgttctgttccattggtctatatatctgttttggtaccagtaccatgctttttgttactgtagccttgtagtatagtttgaagtcaggtagcatgatgctttcagttttgttctttttgcttaggattgtcttggctatgcggggtcttttttggttccatatgaaatttaaagcagttttttccaattctgtaagaaagtcaatggtagcatgatggggacagcattgaatctataaattactttgggcagtatgaccattttcaccatattgattcttcctatccatgagcatggaatgtttttccatttgtttgtgtcctctcttatttccttgagcagtggtttgtagttctccttgaaaaggtccttcacatcccttgtaagctgtattcctcggtattttattctctttgtggtaattgtgaatgggagttcacttgtgatttggctgtctgttattggtgtataggaatgcttgtgatttttgcacattgattttgtatcctgagactttgctgaagttgcttatcagcttaaggagattttgggctgagacgacagggtttctaaatatacaatcatgtcatctgcaaacagagacaatttgacttcctcttttcctaattgaatatcctttatttattttcttgtctgattgccctggccagaacttccaacactatgttgaataggagtggtgagagagggcatccttgtcttgtgccggttttcaaagggaatgcttccagtttttgcccatttggtatgatattggctatgggatagtcataaatagctcttattattttgagatatgttccatcaatacctaatttattgagagtttttagcatgaagggctgttgaatttagttgaaggccttttctgtatctattgagataatgatgtggtttttgtcattggctctgtttgtgatggattacgcttattcatttgcatgtgttgaaccagccttgcatcccagggatgaagccgacttgatcatggtggataggctttttgaggtgctgctggattcagtttgccagtatcttattgaggatttttgcattgatgttcatcagggatattggcctgaaattctttttgttgtctctctgcctggttttggtaccaggatgatgctggcctcgtaaaatgagttagggagaattccctctttttctattgtttggaatagtttcagaaggaatggtaccagctcttctttgtacctctggtagaatttcagctgtgaatctgtcccttcctggactttttttggttggtaggctatcaattactgcctcaatttcaaaacttgttattggtctattcagggattcgacttcttcttggtttagtcttgggagggagtgtatgtccaggaatttatccatttcttctagattttctagtttatttgtgtagaggtgtttattctctgatggtagtttgcatttctgtgggatcggtggtgatatcccctttatcattttttattgcgtctatttgattcttctcttttcttcattagtctggctagcggtctattttgttgatcttctgaaaacattagctcttggattcactgattttttgaagggtttttcgtgtctctatctccttcagttttgcttagttctttcttgtcttctgctagcttttgaatttgtttgttcttgctcctctagttattttaggtgtgatattaggtatcaattttagatctttctgctttctcctgtgtgcatttagtgctataaatttccctctatacattgctttaaatgtgtccagagaatgataccagagaatctggtatgttgtgtctttgttctcattggtttcaaggagcatttttatttctgcctcaatttcgttattcacccagtagtcattctggagcagatttttcagtttccatgtggttgtgcggttctgagtgagtttcttaatcctgagttctaatttgattgcactgacagcaccttacttgtaacagcaggaaatggagtaaagagccaaacatccatcaactggtgaactggtatatccaacagcatactgccttgtaagaaaagagcattaactactgatgcacacgcacagatgagtgtcaaaatagccttcagtgaaagcaaactgactccatttatagaaaatccttgaaaagtctgcagtgacaaagatcagtgattgcctgggagttgacaggagggaccctctaccttaggtttttgttgagacgaaaggcaaagcccttaaacatctttggggcccaactgatagcatccgaggcccacccttgaatctttggagggcctagtctgaattcagcctcttaggatttccccatattcgtaattgaaactgaaacataactaactttggaattaaggaataaagacatccttgttctgggctcttgttattagcacaaatgtttgactgcagccaagatggcatcttattctatacaatttaaatccttctagctttttgagggggatggggtgctatttaatccatagttcagctggtttagtgatagacaaattagcacatcagtatttatcagtgtcttttatggccttcctgtattgaatcatctcgagatgtttatctcaagacccaaccccacaactactgaattaagctattaagtgggaaaaaccgggatcagggtactgcccaaaaatctcacaagctccccagaaaaaccatcacaaaaatccattcaatgccttcacacaaacgcagtctactgcagcttcctaattcagttgtttccaggattacaatgtttataaaaggtatacattaagcttacaattttattgagcaaaatttatttttatatgtacatacaagagacatattctttgacatataaaaaatacagaaatatttacatgtatacaaaaatattaaaacagatttcagaaataaggaaaacaagcaagtttttacaaaggatactttcttgggaaatacacacaatgaaaaaaagctttagaaaggtgacaacacatttaatagactccagaagttgatatttctgttggtatcaattgagtaagaggaacataaaatgtctgaaatgctaacagatggaaaaccagacatatttaagactgtctaggtaaaattgcatgggtttcctttaccataaaattgaatcaatttttttttaccctcagtatcactatctacttttccttttttcttaaaatatttaaattgtttgatttgtattgagaattttaaactttttctcattaaattgtaaaaatattttaagaggttgtctatcctctttatcttctggggggaaaaaaacctcaggatactacaccgatttcaacataaaattgaaaatcacaatacaattttttttaagttaaaacctaacattttctaactaacattcatgatcagtaacaattgatttaataagagatcacaatcttcgtaaattctttttgcttttctttgtaccaggcaggggacctattttacaactggctttgaggagcttgccatctgaacagtctttagtagtatgataattacagagacacttcgtacaataatcaaatccacagccttctcgtttgcaggttgcccgttgtaaatagcaatcatattttgcaggtgaattacagcgaatacaggctttgaggctttcgttctttttcaatgtcttggcaacctaaaaagaaaaaaaaaacccattaacaaatttcagcaagaattacatgtactttagttaataaaaccaaggacacccttgcaccttccccaattcatgtatgaaatatcactgtcacacatacgataactactgccctaactattgccctttatctatgcattatctgatagatgctcaataaatgctttttgaataaatctgtatgttgcattagtcattatggcataaaatttaagaatagttttattatgtaggatttatatttactgatcaacatgaatcagaaaatattctataattttggtaagttatctaaattaagcttgcaaagttatctacatttgagtagaaattttagcacacatcattcactgatctgaaggtataatagaaggccttcaagttcagaaagcttgcctttttccacttaactctcttcctcggttcttaaaagcggaaaatgcaaaatgtagtactgagtaattttataagaaatctaggtttttcattatttcttcagtgtttctaaattagaactcaaaatcactgaactttcaaacaatgccaagcagtacctaatattcatagaaatacatttctacgtactttcctaatttcatgtttcttttgttttccacattgagagcgaaatgaagaggacactaatgaaatccctaatagttctaattatactataattaaatttaaatgatcattaatatcaggtttcttaatgtcagagaataaattagttattatctagagcaaagttacattttgaccttgaaagttcttttacatttcttactctaaatctcttatgttttaagatttatgattagacaaaaaattacctcagagaattcattgtgtcgactataagtagaacctttctgatcaccttgattggataacttggtttgagcatcttttttgagagaagtctgggctgctgatttctgaacagaagccagtggggttctgaacataacatattctctggttgaagcatgaggtgaaaatttattgttgttttcctaatttaaaaaaaagttttaatagaatttagaaattatttcctgtatcctcaatgagacatttttatgtttgtacatataagaaatgacaaacaagattaggtaagagacttatccctacatgcaatttacctgcacgtacttaaacaaagcaaaacctaaatactcacacatatcaagcctaacttatagacagaaactgtgaaccaaatactatgggaaatcactttagatgcagtctatatggtacttaatacctaaaaagtaaaacagcttttccaaattttccagatgttataaaatacacatacacacaactggcaactaagattgactaaatggtcgactctatctgagaaatgagtaattttccctttgttactttagacattctatttctaggaagaatccaagaaataaatgttgagttgagatttctttatttttgaatgtggtttctaagttccagtataaggctgaaatactttatgactgtaaagaagggtttccagattacctcttttcttttctatttctagaagagcactaacagtgcatttttaactaaaaacatcatctgcaaacacttacggtaactctttgtattgctttactgtacaactggaatgcccccttatcatcttctaggatcttcttccaagttgtgctcactttagacacactggaaaagtaaatcaccataaatgaaataattaaagcatcacaaagagctaagatgaatacagtagaaaaacatcagcagtgcaaaaagatattttatattattagtgcttctcaaacctgaccacattacaattgcctggcggttttaactggtctaaaatgaagctcagggctctgtatttttaaaaagctccctcctcattaagtaattctgagtgcattgaggcttaagaaccactgctttgtacagtattttttcacaatatctgcaaacatcaaatagtagcccccactgtatatatgataccatgttagctatctggtaaaagtaatagacaaatttcaaagtactctaggcacactgctattagaaatcaactttagaaactcactatgttaacagaaaaagtagaatctgtggtactgatttgactgtccctcaagaagctgtttaggctcatgcctgtaatcccagcactttggaaggctgaagcaggcagatcacgaggtcaagatatcgagataccctcctggccaacatggtgaaaccctgtgtctactaaaaatacaaaaattagctgggcgtggtggcacacgcctgtagtcccagctactcaggaggcagaagaatcacttgagcccgggaggcagaggttgcagtgagctgagatcgtgccactgcactccaacctggtgacagggcgagactccgtccccaaaaaaaattaaaaaaaaagaagctgtttatatctgttttgctttagctctgtttcataaagaccagtgtaaactcacacttgcaaagagtacctctagataatttttcaaaaagccaaaaaaaaaaaaacaactccagttaagtcctatctaattctagcctgcataatcaccttaattctcaaagttatctgactaagtgattttccttggtagattgagaaagaaatggtggttagcaccaggtttctaagaaattgtcataaacagagcctgggaggtggaggttgcagtaagccaagattgcaccattgcgctccagcctgggtgactggagtgaaaccctgtctcaaaaaaaaaaaaaagtcacaaatctctatttgtggatctttatattttcatcactgtcaaatctaggagagccctagcaccaaaaatggcttagaaagaacaaaaattacttcatactttctggtgtgacaagtcataatgcctattagacatgtagactggaactaggctgttttacagttaagccccaaagatgtaacttacatattagaaatttcaaaactaaaaggaacaaggatcctaatccaacagaaatagttttgtaatagcatgaatataaaatttgaaatgactaggttaaatgcataattcaagttttctttcatcttagtggcacataggtagcaaaacaccagcaagtcattaccgcaattaaacaacattgtaaggttatctacaacaggttgagcatctctaatccaaaaatctgaaaacttttgaatgctgacatgatgctcaaaggaaatgcacattggagcacttgcggattttggattagggatgttcaactgtttaacctgtagggtataatacaaatattccaaaatttgaaaaacatctgaaatccttctggtactaagcatttcagatgagggacactcaacctgtacaacagcctttgcatgagctggtggtactgagccactaacagcaatgttcagtgtattatgctaatatgtatattcaaaacagtacttacttgattaagtccatgtcactgagttgtgctaaaatagttgctaagacatgtctgagtccccttcgaaagagttcgctgagaatatctacacattctaggcccatttttctgccaattatattctgcagtctaaaatttcctctggctataatttccttcagcatctcccgatctactttaggatttcgttttgcattcttttttaatgttgaacaaaccactttttcaaaatgaagaactggcagcaagtttttgttgggatattggtctgggctttgtatttgtagcaggcaggattgtagactgtcaccgaaattctcctccaggaggctaccttcttcatgttcactgaggccactttgtagagaaaatgaggaatagccactgtcttcataaagtctactggtctctagtgcttctatttcatttgtactattaagtgtctgttgcacatgttgattttccttgttatgcaagcgcttgctttcagtttcaagttgtacaatcctagggctcacaatcggtgacccaatacatgacagcctttcatagtctttaatgcagtctttacaggaaccttccaaatatgcaggggtgtaggaaactagtcttccaatgtcatcaggttttaccagtttaagtccggaatgaacatggttacaattaaaatcacacttcattttgacagaaagggtagaactttcttctttacaacctataaaaagaacataacatttacatcttaatggcaaaatttccacacatccctacttcttaaattgggatatacaaagattactttgcaatctctcagcattaggtattgtctacatgtacttgcttacatagctgtgatgttattcaagtttaattattgatatgacaataatatgtgaaaatattacttaaatcttataagtacatacatattatattattcttgagaaggcacttcagaacagactgcttttggatctgcctggctgtaacacctgactgttgtctataactgattgagtaaaaaatagtggaaaaaggggctatataataaacatctgtgtttatggaacaaatgaagaaatgtgatgtatcaaaagagtaggcgctatggtcaaagttatccttaaagtaaccacaaatacttttagattcagtgtttattccttggacttgaaatgacattatggttctctttgacgtaagcacaacccaagccactgacagcaaaagtggttaagattagtacaggaggacaaggtataagggtgggaataatcttgataaaaataataaaaattttgtgtattatttcactattaacaatgattgcaagccttaaaataactattcaagaaatctataggtagcttggagaaaagaactaataacacatttaaacatctataaattaaagtctacctgaattcccacagctcttatctccaagttttattctgatgggtgctcctggtgaccttctaatatattcaaagcgtttgtctaccttactggatagtaaactcgagtaccgggacatctccctgtaccttgtctaatatgtgctggaaactgctctttaatcactgaacaaagacattccacgactaatttaccaaagaaccgtaagtatgaatagttctgctatcaatcaaaagtaagtgttggtaaataagaatgacactctaatcaattaaccagatttaagaatatgagtgatagggcagcaggtgtaaattactgttcaattgctttaaataacttaagataaacttgctattaatgataaatagaaaaaagggaaagacttgttcagggttttattaccaccctgctccaacccccgggatctaagaaatcagttaagacacaatggagcaggcagcatcttaagatagctttaaagcaagatttcaccatccctgtgctacagacattttgcagtgaatacctctttgttctcagggactgtcctgtgcattgtaggatgttaagcagcctttacccattagacaccagtggcagcccccactcccaagatgcaatgtctccagttaccagttattgccaaatactgggcagggaaaaaggccagatgcaaaatttcctctattcttcagttgagaaccacaactctaaaaaatgattaggattttgtcagacaacagtggcctgggaagggcattcacaatttgagcaacggcacaatgctgggaaggaatatggtagatgggttcagaaaactgtttagcattgttgaaggcagagagtaagagtaggcaaacaatggggacatgagctaagaaagcctgaatcttaaatgccaggttaaaatgtgccccatctaccatccccacacaagccaatcatatatagctaacaatttatcctgtaagtaaatgtatacagcatcagtatgtttagtctgcactaaatattggtaatgcgttcatataaaacttaaccattttttacatagagcaaaactttttaactcaaagtagaaatggataccttcatagaaagtaacttgtagagagaaactgcttgtaaattcccaatgttaatacagtgaaagacacatagtatgtgctccaggatcctactaaacctaaaattaagggttcagctgcataaaaagcaaagaatatacaaattctagctccctaattaaccctaaacctagaacaaatgattctgagtggtttagttttattcagaggaaaagtaaaaaatgccaagagattgcctctatttttgcctcaaatcaactaaagaattaggtttgatttatatatgaccacaatttacatgacaggataaaaaagcagaagccacttatgaagggcacactctgctttgtttagctgcctaaaccaaaaaggcctgaaaatacttcaggaattcaaagtcattctctttctgctgtctttagaacagttactggggggttgtcctatagaacctctttcattcaacactgttctttgaatatggacagttccttaaaattagagctaataatgatgcaaatcctttatatttgtttagaagtttgcaatttccaatgcttacaaaccttttgaggtaggatggggaattgttatttttacaattgagcacactgaagtgtagcttagtttgcccaatacaggcagttaattaaatgagccagatttctcttcctcattataatgaggtgctctggaaaaacagatcttacaaataacattcatactgtttataaaaatgatagaaaagtcagaatttatgttgcaagcgcacttaaggtactaaagaagaaaatgtgtacgtttcttttctcatgtgagctggcccttttccagtccttagtaacaatgacctttccatcccaggggctttgtacatcatgcctttccctgcttagaatcttttccacttcctttgcttatttagcttctaatccattaatcatggagagcttcattttttggggggggggggggggcgggggacttctcagacctcatcaaactctactctaaagcactaccaaattgaaattttaaaaagtactttaatttccttaaaggccagacataactgttactgcttatgacaaaatccaagcaaatggcagtgcctgacacaatgaagacatatgatataaaaatgtgtttcccatttttttttgttagctaataccaacattagaatctgtactcttcctcacgaaattagcacttaaggagttaaaatgactaccacgttcctcttgcaacaacagtattttcacatggataattagatttagtatttaggtaaggtgcagtggctcatgcctataatcccaacactttgggaggctgaggttgggggactgcttgagctcaggagttcagaccagtctgggcaacataaagagactccatctctacaacaattaaaaaaagaaactagctgggcatggtggcatgtgcctttggtaccaactactagggaggctgaggcgggagaattgcttgagcccgggaggttgaggctgcagggagttgtgatcataccactgcattccagcctggaagacagagggaaaccctgtcttaaaaaaaaagaaaaaagaaaaaaaaaggtttagtattttaaaagaattttaataaacttatttgaattcacagaaaagctgcaaggatagtgcagaattcctgtacacccattgcttaacttatattactaacagtaatgcatgtcacaacaaattaaccaatattgttgcattattaactaaaatccctattttatgtggactgctgtagtttctacctaaaatcttttttctgttcccgggtcttatccaggatacattacatttagtcatcatatctccttaggctcctcttgactatgacaatttccttgtttataattaccttgacaactctgagaaatactggttattttgtagcctgttccacaattaggatttgtcaagtttttctcagccttagtctggggctgtgggtttttagaccagaggtaaggtgctatgatttgaactgttgttagccttgattacttggctgaggtagtatttctgagcttgctccaaatgtaaagttactcctttttgttctttttccatttgaaactttttggaaggaagtcactatgtacacctcacacttaaaggagtggggagtaaatttataaatcatttggaattcttctttacagcagatttgtccattaatctcctatttattcatactaccaatcatttatatcagtataaactcatagactttgggttataatccaatactatttactgtattgctcaaattgttccagcttttgctattgtgagctcttgcagttgacattggtgtccatttcacatacttaaatcattttgtgttttgaacatcccttactttctgggactacaagatgctctaagtgcatcttataatttccgtttcagccctagaatcagtcatttctccaagcactgtggtttccttttttttggaaaaaggtattaaatgagagtgaaatctggatgttggttgtagatttaattttaaaatatgaaattaatgtatttttcatttccataacaatactgcagaagaaatagaatagcatcatattttataaaaatggaagctgaagcaactgtttgcaaaaggttaaatccattccttttaactagctaagtgttttccaatgaccaggccaaatttgggaaatatgtgaagtattcatataattattatccagaaagacagaaaacattatatggcttcataacctcttgaatgaaacagatgagggctaagagttcagttgaaccatttcacttatttatccaacatccattcagtgacagggtagggagagagaaagatattaattagggatgatctttcagcaaagctgacattctgagatctgaacaccttatggaaatctggtggaggagttccagatggtgggaaacacaggaagcaaggaaaaatgtgagtgttcaaggaagagaaatatctgtagggctgagttgggggaggttattgaaaattatagttgaagaagtagaatgatctgcagatttgtggggtaggctgggtcaaaagtggagaaatttggtttacatttttaaaagatcattggcaattgtggagaatgaattgcaggaaggtaagtagaagcagagagaatagttagaagtgtttatgacagaagtagagtgtgggaaacccagactagaaggattgtagtggaaatgaaaataactgcataaattcaaggtctgttatttagaagggtaaagtcaacttgctgctaatctactagatctggatatgaagaaaaggagagtaaaaaaacaccctggggtttaagtcttgagtatcgaaggtatacagtgctatttactgagtatggaaaactgaagaagttaactcttaaaacctcactttcctcatccataaaatgggagtaagacaatgaaacaggactaaatgcaaggcaaagtccctatcacaagggtctagtcaatacaatctatttttaatcacataagccaaatcccttcatattccttacattgacaatcattaacatttgaaagtagtaaaacacatttcacaaagaagtatatatttcagagtaacacatacttttccattagaatgtatagatttaagaatcagatccaagtttgaatgaaaatccttgcttagccttttgactagctttgtgaacttggaatgtcctattcctatttttcccccaagtgcagacactaataagactcatacatggcattgtttaaacttctcatttaccaactcccagcccagtcatatagagaaaagtaaattttacaatgtttgatcttacatttaacttttcaatatagacctgatcctccatatcaaatatcataaataaggctgcagtccttaaaaatctttgtaactcttctgttaaataattaagttccagtctctaatacctacagataacgaccatgtggtcaacgttaggcatggctattccttaagaatttaagaggcccaatgcttgtgaccataaagtaatctttaagagaaaattttacaaaagcctcctttgaaaactacttggaagtaacatatatgtatttttaatttcatctcctcaaacctgtaaactggggaaaaaattccaacaggcagtcatttctttctgaggagcaaggtagtaaagacaattagagttatcaaaaaagaaaaaaaaaaaaccctcataaggccatcaagcttcagaatttcgatggtagactgacgatccaggatcttctagaaatatatttaatctattaaaattaaaattaagtatttttttctagagttcttttttaataatagagtcattacaaaatagtacaatgccgaattgctaaattttttcattttgggttatttctcaggtaaaaataagtgcatatagattttatttagaggtagcaacaaagaggataaaaataagcatttgagtgcattccattctctgcaagctttgaaataaaggactatctaattcttcatgagttatcgggaaaaagtcaccaattcttcgattcttacaaaatcatcttaatactatggacaaattcaaggttcgtagtaaaaattgctttttttaaagtcttccctttccactccaggccctgagactgggttaacgggcaaagggagaaaaaattgggaaaaagtaacgtttttgtttggatgtcccagttgagtttggtccaatgagttgggggggtgtctctccatttggcgggagtggggagggagaccctggaactcctgagggatcggtggggctgcccctcagggcgcgggacacgcggaggaggcgggagataaccgcgagcgcgatctcccgcgcccgccagcaaggctgggaccgcgaaaaatcggggaaactgcctttggctgtgagggtgcggggcagatgtagaaaaggggcgcagggggagaaggtgaggcacctggccaggccctgggggcttctcgctcgcagccctgtcaccgccgggggccccggggtgggggaggggaggggcatttggcgcctattcaagcagggtggggtaggtgggtcttccgaggaggaaaaagggcgccctgggatgccacgacccgcacctcccggggctggagtccacggtcggcgtgggtggcgggaccccgcggcccgccatcccgcccctgcacatctggctcttctggcttccccccgacacccagccgccctcctcccggacccaggaaccgctgccgccgcccgaggccgggcgtgtggcatggccgcgcgtccaggctccgagggacgtcgggtcagggtctcaggctgcgaccctccccgtgcacccctcctggcgtgcgcgcccccctcgcgaccgctcccctcactcactatccgagggtcgagggcgcccggcggctgtcactgcgctggggctggcgctgcaggagcagcggggtggccgtagggcgcagctgcaggggcgccggctcatgccagccgacgtggagtctgcctcaggtggaggaaccgctccgggggcagctgagcaacctgcctgcttcacagacctgtatctcttaaaaggcgccagctggtacttttaaaatctttgaatttggtgcctaaatccgcgcggtccaatgagacgcgtcgcttgcatgcgcgcaccaataggagggcagtgggtgggggcgccctcgtccgcgcccaattggaggctgccgaggcggggccgagccgcgaagcccagcccccttccagcttaccggctccccacgtccggaaagatgctacggccgggggcgggacctccgagcacggggaggccgcggcccggccacacgtgtggagggtctatcacgcatgcgtgcgcccgccaagattccttccgccgtcttctggaccggcctcctgcaagtcctaatctcagcccaaattcagcgctggcttccatctggagatctttgatgggtacaaatggtagccgactttcttcgatcatctctcgaacgggagttcggtgagcagcaactcggctcgtccgggaatccagactttccggaagacggaccctccccccagtccagcttagcccgcctctctaggatttacgcgcgcgctctgctctccctcctaactcgaccctccccttgacccacgcctctgcgcaggcgccttggcgggctgtggctgcggagttggcgggtcggcgcctgcgcactggagtcccccgcgattttttcctccggggtgggcgaggaggctgtgcggccttccccagcggctgtagcaggagacctgcggctgcatctcccagggccttccggcggggccgagggtaggaccgaggcacttcttccttgcaagcgcgtttatttgtattttcaaccacacttcagacgctactggtttataggaacgttaagtttactgagtgtgcagctacgctcccctgggtttttgttcctttccttaaagggccaggtgtaggagacagtagtcctgctcccaaaaaaagaataaatagaagtgcccgccctcttgggctggacccccgtggccaagggagtttttagtgatggctggcatggacgtcagtatgaaagtgtaccggagtattagtgatgcttaacttttcacaatttgaatatgcacttaagtagggcagtgcattccctgaactcagctttatggctacagcccagtgaagcaacgggatgtgaactccaaaacggcgaatcctcctttgctgtttccctctggtgcctttctgcagcctcggagtgagttcttggctgtagtcagttttcagtaccgttagtgacgagtccggtggggcgcggccaggattaggatgaatcatacaagtgctgggtggatcctgtctttacctaaaattttgataattagttgtggggcgcggccaggattaggatgaatcatacaagtgctgggtggatcctgtctttacctaaaattttgataattagttcatcatgggttttttgcctttttcatttttaaaaatgttaaaatagtgtcactcttgatgacttaaatttttttcatccccgtaaacgcacctgaggcctgtgcttccttgcctcaccctaacctggccctggggctagatcctggagattcagggttgaaaagacaaagtcctgtcctttagggagtttacagagaccaatgggaaagaagttgacagtgaacaatttcagaacacgaaagaggatatgaaagaatgtaatcgggggtagagaatgcagattagtataggttaaggattttggatggtcaggacgctttctgaggctttgaacccagatgcgttgaactggcaatgcagggctgcataataagcagagggaataataagcagagggaatgcctgactacgacttagtgaacaagagagagaggagatgaggttagagaggtaggcagaagccagatcctgtgggaccttgtagtttttccatgcagagtttagactttcttctgattgcagtggttagctgttggaaggattttggcaaggtagttatttgttgatagaatattgaaattataatagcttttttatgtaaaaaaaagaatgtaaatgttagcctttcattctcacaataggttagcattattttcagtgtacaatggtcgtgcttctcagtgtgagttaattctcactgtggctaccaaaaccacacagctagtaagcggagattcgagtgcccgtctgcaggattcaaaaagtccatgtcctttcctcttatgctatgctagcctataacactatctgctggagtcctggttggttttagtacatttcacattacttcacagtttgaccttagagataattgtattcacctcttctattttcagatgctggcataaatacaaaattcgaagcaggcaaggtttctcattacattagtttttatttgtatttttttgagactgagtctcgctctgtagcccaggctggagtgcagtggcgcgatcttggcccgctgcagtccctgcctcctggttcaagcggttctcctgcctcagcctcccaagtagctgggattataggcatgcgccaccacgcctggctaatttttatatttttagtagagacggggtttcacctttttgtccaggctggtcttgaactcctgatctcaactgatccatccacctcggcctcccaaagtgctgggtggcatgagccaccgagcctggctcattaaattagctgagcatctggaatataacctttggatcttatcctcagcttagatttgttcttcagcagtttttttattctctagaaaaaggctgatatattattggagaaatcaaaatttctgtcataatgtaatataaagaaccaagcatgttttgttgcatgctagaataatttgttaggttttttttttcagcttattgggttactgcatcattgacattaaataatgtttgagctttaattattatattattcataactgtcgataggttcagttcactggcacctgttaaaattctcatctaagtgagaaagttagggccactctggcggggtgtggtggctcatgcctgtaaccccagcactttgggagtcagaggcaggaggattgcttgagcccaggagtcaacatggtgaaaccccatctctaccaaaaacaaaaaaagcaaaaattagccaggcatggtggtgcatacctgtagtcccagctacttgggaggccgaggtgggaggatggcttgagcccagaggcagaggttgcagtgagctgagatcgcatcactgcactccagcctggcgaccaaaaaataaagggcaaggggacattctgaattttactagaagccaatagatgtatacacctcatttttcaaatcagcatcaatcagttgttgggtgtttaggtggaacatgaagtgcagagagaactgccctcattctttcgtaaaattcttatcgcagacctatcacatgcaaaacaatgggatatatggaaataaatgggacatgacacctgcccttgtgcttattatctgtgggcttgccacataatagccataataggtgttcagtaaataatttctgaataccaatcaggcatatctgtgggggtaaggtgtataaaataaagctatgtggaacactggatgagtcaaatacatttaaatttgtggaaattttggccgggactggtggctcacacctgtaatcccagcacttggaaggcctaggtgggcagatcacctgaggtcagaagttcaagaccagcctggccaacattgtgaaaccccatctctactaaaaatacaaaaaattggccaggcatgggggcgggtgcctgtaatcccagctacttgggaggctgaggcaggagaatcatttgaacctaggaggcggaggttgcagtgagccgagatcacgccattgcactccagcctggccagcaagagtgaaactccatgtcaaaaagaaaaaaaaaaattgtggaaattttcatagaaaaaaaggagttacttctatgtaccaggataagggaataatctgtaggacagggtttcttaacctcagcacatttttggccagataattgttgtaggatgtttagcagcatctcttttattccatcttccagttgtggtaactgtctctaaacgttgtcagatgtctcctgcgggggcaaaagaccctctggatgagaaccatggctgtaggggatgtcttctgaagaaatgggcacaaaggaggcctacaacataaagaacaaaataagggaaagggtaaatgcagttgcatttatcaggataatttaatttgatgtggcatggggggtggtgtataaagtgagctaatacaaaatgatgctggatacagatcatggatgtattgtatacacagtggaaagctggttttatttgggagacaatgggagcttttacattgttgagcaaaggagtgacgagatcagtcttgctttttagaaagattagtttggcagttacttatttgtaaccagaattagacagcaaatcggatgcaggggagaagtcaggtgactattagtctgcgaagtaattctggacaagagcagtggtaatggaattgaaaaggattaaaagtgtttaccaggttttagcaataaatccaatgcgaggaagaggaacgtaagatgacattttaaatttgagagtggtagtaccattaaaaactaatgaattttgattaactagtgctttaggccctttgaaattattttgaattttggttctttctgaacaatgcaccagatttctagacaaatacttaaggtgtttttagacatctatttagtgcctattatagcatggtgttagcttccgaagagacaagaatgatgaaaatacaatcttatccattagtggcattgtgagaggtctagcagtaacttgttcatcctatgccctgatccaccctttctcatttccttattaagcacacaatactgagaccagaataaagcagtgcatttactaccttgtgaagaatgttcaggtgttcaggtatggtatcttcattttgtgctgctataacagaatacaggagactgggtaatttgtaaggaacagaaatgtatttctcacagttctggaggatgggaagtctaagatcaaggagctggcacttgttgactagggctttcttgctgtgttctcacatacagaaggcaagctagcaggatgctccccgaaacctcttttattatgggccttcatcccagtcctaagagaatccctcatggcctagtgatctcttaaagaccccacctcttgatgctgtcacattggcaacacttgaatttgaggggacacatacaagccatagcaaactgaacatttctcccatgccagatagcaccatgttctttgtcagtaggtggtggtagaggggcactgcaggataaaggggcttctttcacttctaagatgatactgtgacagttaattttatgtgtcaacttggcggggccacaggtgcctagctactgggtcatactttttttttttttttttttgagatttaacttttgctctgattttccaattataaggtcaaacattattctaggtgtttctgtgagggtgttttatatgagattgacatttaaatcaatcagtgaactctgagtaatgcagactgtcctcctcgatgttagtgggcttgatccagtcaggtgaaggtctgaagagaaaaaaagaccgtcctcttcccagaacaagagaatcctccaacagatacctttggactggaccttgcaccatcagctttcctgggtttccagcctcctgcctcacactccagcttttggacttgttagacttaataataacaacacaagccaatccttttaaggaagtttgtctggagaatcttgacaaacacaaacatctactgagagttcctgtccaagttttgctcacaccctagcaagaggcttctggcttaccagttgggagtgtgaggttctttgcttgtaagacctgatccaccagcggtacaccagctctggcccagggcaagacagggaatttcccaatcactgagtaggctgtagccactctctccattaggcctgacttcaccatggggaaggggagaccctttcaagggtattctttcctggggtactctcagtcctaggacatcatagctctctttcatccctcttaaaagttaataccattatcagttaacagtttttatattaaaattatccctgttcaagttaatggtatggtttctgtatcctgactggatattaggatacagtatttactgtcttatttctactactttatgtttaaagtttttcataatatttaaactgaagttttgatcattcattaaatatttacacagaacaggacaaaggatgattttcctttgtctagttattgtaaggtagcgtccaagatttaccaccacatcatgattacagatggtcaccaacttatgttttaggattttttgactttatgatgggtttatagggatgcagccccatttcaagctgaggagctccttagggcttaggaatcatacctctttcacaccatggtaaagttggaaaattgttaagtcaagctgtcattaattaggagactgctgtgttgctaacgttatatgcatttttaacttatgatgggtttattgggaattaaccacaatgtaaatcgaggaccatctgtatattgtatgatttttgctaatgcattgagagagatctgtgtaaattatctatgacttcagaatatgcatattacctccaactgtgttaactcaacgtttttcaagagagtaagggtactttcaccctatgtggatgtactgtagaatttttctaagatacgaaagtctataaataacaaatcaacttaaactttttgggaaataatttctactaaagattcataatcggcgtattccttcaatgactgtacaagttcatccagtagataatctccttgcataaaagtttcaagatcatgcagcgtcttgtttattctgtgatctgtgacccggttctgtggaaaattatatgttcttattttctctgatcttcctttacttccaatctgtatatagagaaaaagatgagatgcagctagattcagggcaatttaaacctacaaatttaacttatttggagacttaagttcttgatttataacatgaatcaaatgcgagaaccaggttttaaacacttagaatctcaaatgacatgggaacatgatatagaaaaaagaacacgtgctctaaaatcagattaatatctgaatcctgcctcagccacttcaatgttctatgacctcgggcaacttagtttcccgatctgcaaaatacagtgtctactacacagtgatgatgacaatagagcctggcacatagatgctattcctatagtcgctgaatacatataatctctgtgaattaatgcagtcatcttccgtggtaacaaggtggtgagtttcccatattgaggaattcttaaaaggctctgtagttataaaattaaataccggccaggcgcggtggctcacacctgtaatcccagcactttgggaggctgaggtgggtggagcacctgaggtcaggagttcgagaccagcctgcccaacatggcaaaaccccgtctctactaaaaatacaaaaaattagccgggtgtggtggcaggcgcctataatcccagctactcaggaggctgcagcaggagaattgcttgaacccagggggtggaagtcgcagtgagctgagatcgcaccactgcactccagcctgggtgacaagagcggaactccatgtcaataacaaacaacaacaacaaaaattaaatacaggaagaaaaaaacaggaagaaagccaagttgagtttgctttccaactttcttgcgtaattaaaatttcaaaggattaaaaatgaatgaggactcagtatatatctttatttttagtaacggattaaaagtctgagaaaaatacctttgaatatagaaaacagggcagagatgtaagattactatcaaagaaggatagcccttagactacttgaattgttttcaacacaggttaaaacaaatatataaaaaccaagttatttaaaaaaagctgagttatataaaaatatttctatcctttaaaagcatttttaaaattctttttttacctgaatttttctagcattctgtcttttatttatttcttcttctagatgcatgctgtacagttttgcacgtaactttgtcatagccagctctttatttttcagctgagatctctcttgttgacattcagaaacaacacctgaatagtgttacgagaattaaaaagttttaataaaaaaatcttctttacttattatcaaggaatacttttcctcctcatcctttttcttcttcctttatgaggggaaaaaacagaggactctaataaaaaagggagagactataagcttaacttttgcagagtttatcagaaaactgaaaatttaagttttgagcaatagcacaaatagcacaaagtctttctttctttctttttttgtctgagatggagtctcgctctgtcgcccaggctggagtgcagtggcgcgatctcggctcactgcaagctccgcctcccgggttcacgccattctcctgcctcagcctcccgagtagctgggattacaggtgcccgccatcacgcccggctaatttttttttgtatttttagtagagacggggtttcaccttgttagccaggatggtctcgatctcctgacctcgtgatccgcctgccttggcctcccaaagtgctgggattacaggcgtgagccaccgcgcccggcctagcacaaagtatttctatactgaaggcatacatactaaacaataagcataaatcatttaatacagattgtttcccctcagctagccaccatgttttaaaagtaacaactacttatagaaactacgatacatgaaaaatcctattaccagagaaaatcacttaacttttttaggctatccattttttcccccaatttttgtttcatattctgtattacctaagacatcatccagtttaacataaggatattctcataatttaaaagaacaaaatcgttaacaatccagtactggcctcaaccactattagttaatagggactatgcccatttgagatcagtcacagtaagagattcttgtttcctttctagataactgagatttgctatccctatgctctttatcacatgtgaatcactgtggtgatacctgtgaaagacgtttagttcgagctacagtatactggagatttcgatatagtccctttgcctaactatctagaatcagatcccctcgaagtatgtgaatgaacttaatggaaagaagcccctgcaattatatgcaaaactgtatatgtgtttctgagtaggaggtccaatgctttcatatcatttttttttaaaggaagccatgttcccctcccctgcaaaaaggctcagaaccaacaatttagagcattttctgataaagaacccatgataattacttcattgtgagaattttctttttaagtgtaaaactcagaactccacctgaaaggaccatccacaccttctataaatagtaattaatacagacattccctgagtttggatccctccctcttcctcgccttgcagttatcccacggagtatcaggtaaggattctaagtaaatcaaatatttaataacaatccttagaagtatatacttctctggtaaccgaggatctatttcagtggaaaattagtcatattattccaaaattgatttctttggtgtcatatattgaaggaataagtacacacctgttggaagatgaactatccggacagcactgtccgtggtatttacatgctgccccccagctccactggctcgcttagtgtcaattctcaaatctttcggattaatcaccagattaatctatacagaagaaaagttgggattttaaaagattacatgtatcaactttataaaggcaagagcgacccatttatgaatatacaacatgtacagaattcatatatttgggaggtttaattttaagactagagagtagctagaaggataccattttaaaacttttttgctttttggaagagtagggaatcgaaatagtacaggactgtacagttttgaaaaacaaatcctttctagtcctcaaaaacctggcttccctttatccatttcttaccacagaaacagcagaacttgatactattctgcctacttttagaactgaatgtttaaggttttttcaaatttttctgagtttaaagagcctagcagcaggaaaaaaaaatggtagcgtgagaactgtgggaagggtctgttttgttttatttcaaacatatttggaggcaaagatgagccaaatggaaatgggagtggccaagaagtcatgagtctcaattcctcaacacactgggatctgaggtcaaggtaatgctttgtcctaggagccaccatcaaaagcactgtttcatgaacaactaagaaccattctgtgacatctctgcaatgctgacagtaagaatcctaccattctctgggccttctacctctatgtctccctgtgttgactccctcttatggttgctagaggaattagatgatacatggacctcagtctctcatcttttcctgaaaacttccaccccaagatggttaaacataagtgactaggtttctagatgtggctcttgccatttattctactttactctctcccttaactgcttagtttctcacctatgcttcacacaaaaattagatctaaagaaactaagacctaaagaaaggaactccattaaacctattacagagccaaatagcactttttcccaaaattagcataggaaccactaagagttccttctcaaagcattcacacttcattctgaaaaacaagtcagatatctgctatcacttttcagtagaagggaaatgaggcaaaacagaactcctacactaagttatcttaaaaatatagactgagaatttgctttgtgagaataaagtatactcattatgaacagtataacaatatactttcattttaatgtaactgggttatgaagcagcaattctgttaagtaattacctttgttaaataggattgttgctgttaataccccacaaaccagtcacacaaggcagaagtcattataaaggcaaccagtccatatttaaataggttattatttcacccacagagatgatctcacaataactacttattaggaaaatactaatacacagacaatgcaacattgtatcatttacaaatccttaattttttagcattataaaattatattttttagactgagataatatgcaactcaaaatacacaaggaagaccaaatagatactcaattcagtaaactctgaatgttaactctggggacaaggcactgtgctaggcccgggattccaaggagaggggcttatgccttacctcagtaggctggggtaatattgctacagtcatggtgctagtatggacgcggccttgcttttctgtctttggcactctttgtactctgtgaacacctccttcaaatttcatgtgcctataggcttctgaacccccaatgctggcagatgcatgtctaaggccaccttgaaaatacagggaaatagaattatttttattattcctgccatttataaataattgaccatcacatctactatcttgaggtatatttttaaagtcataaaaggagatgaacatggagactgtaaaacatattaaaatattcaatgttttaatatttatctttactgcttacaagtactaaacaaagcatttatggggctaatcagttgacatcagtaacacatctaagactacttttaaagactgttagcaatttgatggttagtattattgaaagactctccattagattttataggtcatctcaaaattactgtatgtgcattcaaatttattaggtaaatgatgagcataaaactacataagcatcctcacagataagttctaaagcctagtcatggtctttccaactcttttcctaaacactttacctgaaacaaaatgaatagtttactgacctagttcacttggaaaatattccagggtttcaaaatgccatcttttaaatgcagcatattgctgatacatatcaaatatctctgatgtaaacaacattgcctcctgacctccaactcctgcagttacttccaggatcaaatcattttcatctgtttcttctgagggaaccaaaagtaagataatctgtaaatataaaaatatcacccctcctataattaagatttaaaatttatcaaaaaataaaaagctaaatgattcaggaattttaaatatttaagtttcgccaagcaaataatgtaatattgctgagtactgttcaaccaccttgccaattagaactgtataatgtgtaacttccataaagtattaatgttacaaccatattataaatgctgttaagattcagctaaaatttcaggcttgttttattgtctgttggagttcttgtatgctttgtatcagttctctcttcagttaataagaactaagtacttgctctgattcggagattatactgttgtggaaagcaaaagaagattctagatccatcctcttgaaaattaaggcctagtatggcagaaaaccaaaagcactcaaaactacatttgtattattttaagatttcttattatggaagagaaacttgtaattttgaaactaaaaaggcccttagagattatctggtccaattctttaattatacatgtaaaggaaacagagcttaacagagattaaatgacttgtttaagggcaaagtgttagttactggccaagcaggcacaagaacacaaacctttgtgcctagatcagtcttccctccattacaatagtgtgtttctaatcaaggggatctagaacaaacacttcttagattaggtcaattaataagaaaagctaccaacattttattggttctttaatatatggcaggcattctaagcactgtacatactgtaattcttaaaacaatcttgggtaagtattattaacagttctaccttaagatgtgaaactaattttacaggggttgaataatctagtggctcaacattacccaactcaaaagttaagtggaagagctagaattgaacctgaatatacctgagtacactgctatcacacttgacattggtcagaagctatgctagttactacttttccatctctctagcctatgccaatacaacattatcattcaaattttgaacaaataatggattttacttctgtttgttgattactagacactgaacagaaacatttaatacacatatccttcttattcacacaaaatttaatttagaaaatgggtaaaatgcgagctatactacacttttcaccttatagtggaattctccccctctaacataggttataggaacattaatttttagtaattttcacatttgcctaaaggggaagcagattctcaaaaataagtaccccctttcctggctccttccttacctaacatattctttcacttatccccaacggtaattgctgtcaacctttagtctctgctttacagaattagcaaagagtggctctaatttcatataattattcttcattaactctatatgttctgtaattcacaaagatgtacaaccaaagcaatgtaatccaattcttaaaatcgtgagggcttactctaggtctggtattccaaatagtgtcagagatgcaaaataagtattcctggccctgaggagctcacagtctactatcactctaacaggggacttcaagaagttgtatttcaaagttattttgtaacaaaataaactcgtgctaacttgttataacaagtcacaggctctagtttgaggtactaaaaagggtatcagtttgcaaagagccccatcagagcaatatgaactctgttaaattgaagcaagaacaaacattaaattgctggtgaagcttgggtggaagaatggtgaaatcattgatgctttatgaaaagtttatggggatgatgccctgaagaaatcagcagtttacaaatggataactcattttaagtagagacaagatgatgttgaagaagaagtccacagtggcagaccatctgcatcaatttgtgaggaaaaaaattatcttattcatgccctaattgaagaagactgatgattaacagaagaaacaatagtcaaaccacagacatctcaactggttcagcttataaaattctgacaaaaaaattaaaggtgagcaaactttccactggatgggtgccagaacctttgcatgcagatcagctggaggcaagagcagagctttcaatagaaattttaaacaaattggatcaagatcctaaagcatttctttgaattataaccagaagtgaaacatggctttaccagtatgatcctggagacaaagtacaatcaaaacaatggccaccaagaggtggaaggggtcgagtcaaagcaaaagcagactggctaggggcaaaagtcatggcaatagtctttttggggattctcaaggcaccttgcttattgacattctaggggccaaagaacagtatctgcttactatgagggttttgagaaagccagagttttagcaaaataccagggacagcttcaccagagtcctctcctacaccagtgctcctgctcattcctctcatcaaacaggcaattttgagagcttcaatgggaaatccataggcactcatgttacagtccttatttggctcctccttttttttgtttcctgatcttaaaaactttgtaaagggtacccattgttctttagttaataatataaaaaagactacattgacatggttaaattcccaggaccctcagttctttagggatgcattaaatgctggtatatcacctttttgcttaccaaagtgtcttgaacttgatagctggtggcacttatgtcaataaattaaagtttatatatatatttttttatcttttaattccagttttccacaaacttttgaagtcctttcatataacctcttctgccccatgtctacctccagtcttcttaaaaaaaaaaaaaaaaaaaaagggaagatatgccactatttcgctgcctttccagaaaatactatcactgtgacatttatctttctgtgagagcgctacagtacttttagtatgatgaaaacaggaccatgtgaagtttgttctttaaaaaccagtttattgatagtcataatcatttcaaaatgtatgcatatatcaaaacatcacatcatataccttaaatatatgcaattttgggggtcaatttatacctcaataaatctagaaaataaatttaaaaaacccagtttattctaaacagtaacaagctagtcacttgtttttataaacctttaataaactttaatgcctaagaatagcacaaatgctttattctttgcagaaataccatacctgatgcttcagctgagttatttctttttgacacaaagtgatttcattctctgcaagtttccttaaatcttcattctcatctaggaaaaaaagggcagaagttaaggttttccttaattagtgttaaattgctagcagacttctaggaaatagttttatggttattatagctgaagggaaaaataaaatgtatatcttgtcctttcaataaataccattcaataaatgcctttcaataaatgtcctttcaatcaatttcaccattttatacattagttttcataagcatgtaagtataaaattttttttctgataaagtacaagtacaaatttctataaaaatataaagaagctaaactcttccataatttcatctccatgaaatattcaccttaataaatatgcttttagacttccaacttagactgtataataacgaatgcatttagctaataagacagaagggatacagaaggttacaccagtaaaactaaaattcaattaaaaagtagaaatttattctcttataagcaaatgtttcattagtattttagtatccacccaaaaacatttattagattctgcctaatgtatacagaatgtttatacgaagtactcctctgtctctctctctggctttacctttattgttgtttcatctttgaattttcatttttaccttataaaacatactttctcattcctctaccctatagatgatatgcagcatatataaaggaggaggaaagggaaaatttctggctattaacaaattgttctctctattgaaagttcaaacccttacaaagcatcagtttgtatgcttatctattaagaaacaaccatgctgggaagtgggataatacatatataagacctgccctcaagagagcattatagataattttagtttccttatatttttctagaagagaaaaacaaaaaataacctaaacccttatgtgacatggtttggctgtgtccccacccaaatctcattttgatttgtagctcccacaattcccacctgttgtgggagggacccagtgagaggtaactgaatcatgggggcagatatttcctgtgctgttctcatgatagtgaataagtcttacaagatctgatggttttataaagaagagttcccctgcacaagttatctctcttgtctgctgccatgtaagacgtgccttttgccttccaccatgattgggaggcctccccagccacgtggaactgttagtctattaaacctctttttcttaaaaattaccctgtcttgggtatgtctttatcagcagtgtgaaaacagactaatacactatgtgattaaatattaaaacagttgtgccttgaaggaatctgttggttttggaatgggcagaaaaaggaaaaaaagattaactcaaggagagagaataacaacagcaaaactgagataagcaagtacaggaagcactgctgaaaattattttggcaagcatatggtatggaagaaatttggtagaatggaaaatgtgttaggaaaagcaaaaatgaattctagccctagcttaatcgctaaggtactgttagggcaataggctcaacttctttcagttatgacaagaatgaaatgaaagttctgagctggataatctctaaggtgcctttcagttctgcaaagctaaggagattggaactagagtctagaagtaatttaattttaatactatattttatttaacccaatatgctccaaatattatttcaacatgtaattaacataaacatattactttttataccaggtgtttgaaatctatatgtattttacacttacacacctcaattcagactagccacaaattgctcaacagctgtgtggctactggctactatattggacagtgcagctctaaagggtttagaattaggagttactcacaggcaatggtaatatactacttctttaatttctcttgaatattataaatcaacatatgtttactggacacctaccatgtgcctgccttcccctttgcctataaagatgtttatggtttcccattctaaatgggtccttttcttttcaaccctttaagtagctgcttattgtcacccctcttttcccacccagatttctggagataaaatgccatttttataacttttctcctgttaactctaatttacctctcaagctgttacactggattctataatcatatcaagaccatttttattcaagttaccaatgacaaaattgccaaatctaaagacttatttcagtgtgagctgaaaaggttgttttacctttctatgtcaggtactacggattttttttttttttttttttttttgaggcagggtcttgcgctgtcacccaggctggaatgcagtggcaccatcttggctcactgcaacctccacctcccgggttcaagcgattctcccacctcagcctctcaagtagctgggaccacaggcacgcaccaccatgcccagctaattttgcattgtttgtagagacagggttttgccatgttacccaggctggtctcgaactcctgggctcaagtgatcggcccacctgagcctctcaaagtgctggaattagaggcgtgagccaccacgcctggccaaggatctcttacttcttgaaattttctattggcttctacagcttcatttatttatctacttcagggtcacaaagctctggctgtttttttcttgaccttttatagccttcttctctgcctgctcctcaaatactgtgtatttctggccttgttagacttgtttctatcttaacacattttccctgagtgttctcatctacttctaaggtttaatttaccacgtactgtatatctcgagagctctcatatgattatttgggctcaatttttctcctatgtcagtaattttttctcctagactagtacagatatctttattggaattccttttcacaggtatttttaacttaatatggcattcaatgcaaaactcatctttttaaaaaattcggtccaacttttatactttcatcttaattaacagtaccactcgtgctgaagccagaaacctaagacttttcttagaactaactctctccctcatccttctcagggcataagccactaaatcctaacttgtttctcaaaatgttttgtgagtcagaactatgcctatcaccatttcttctttggattgtttcaactgcctcctccctggcctgtcagccaccagcgtttctggagaatactccaatttatcctcagcgcatgccaccattaacttttctttacaaagacgtgaattctctgcttaaaaacatttgctaactttccatggtctataaaaaataaatccaaattctttgtcttgcaaggttcttaactatttttctggcttcatgtttctatgacatcatctcccacctattctatacttaggccatactgaatttcccaatttagtacctttacccacgtataggtctgagattctgagtcctaagtctgctattaacaagcactgccctgatactactgcaaatgggtctccacaccacactttgagaaacaccgctgtggagcccatcacagggacagtgccttatttatccttgctgagctaatgagctcttgcccgagtccacaactaataagcatgtaaaaggcggcagagcgccgtggcaaaggagcacaagagagcccacaggagaggatgggatcacagcacgtaatgatgtcctgacctctgatccaaaataaaaacggctgcaagtgagtaaagagtttcaaactcgggtagtgtgggcagtggaaaagtcaaacgaagagtcaagaatgtgctctgacgcctctcccccgggcccgacccttaccgtgcagcaagtgctcagtctcccgcagctcccgctccttctcgttcagcagtttgatcaccgccagcaactcgggcctcctgaccttcaaatgggcttcagaccccgcctggcgctcgaggaaggtccgcaagggcccgccccgggtgaacagctcctccagcggcgggctaccggagctcaggggccggcgggctgggccaacggcccggcggggccagagccaccgggcagcgccccacagaacccgggaccgcatccttagtccgagatcgcggaccctgaccggaaccggaagttccggacacagcagccctcgcgacaacacccagaatttggagataagggtgagagcgcaccaagccccgcccagcgcaagcgttgctttttaaaggattttccggaagccttggcgggaacttcctgccaagcgtgagaacgctgcgaacttcccggaggccaaaagttgagggggctgagcggagcgtgattggggaggggcgggcctgggagaccttgggcgcctcctctgaaagcctcttggtaggtatccggttgatgggtgacgtgtttggccggaaagggagagcagcagattgcccctctgttttctgatagtgaggatttctttcccatgcactgagtcggggcctccagagccgcagtgcagggcagtcgagggtccgctgcagggcggaggtcacagccgcgcaagtcgtcagtctccggtgcagggctgccgctgagtcttcaagagcgagttttattatggacaggcgtgtgtttattcctcctccttttttcctgcttatgtttctcttgtccacggtgggtgaggttcgtggtaataaggacttgataagtgtattatgagataaccactgaatgaatttgcacaatagacgtgcgtgcccttcatctgccgcgtcatttacttgctttcaaaggactttattattcacctgcccattcattttcacttagtcccacttatcgtcagctttttaaagaggtggagtgattccgtgttacagcaacctacagcccaacaaagccttcagatatctgcctccaggagtccaaccctcatccctttccaaagaactggtagcggataggtgccagcaataccgacatttattggcacaatgctttgcacttttcaaaagacctgttcacagctcaacggagaaataaatatgagggaataaacacaaccaagacagtcctgggaatgcaagggctaaacgctcaatctgagaactgccactacctaactggtttgggcagcgtctactaagtggtatttcactgttgagagaggtgatatattagaagtacgaaacttctaatttattcataaaaaataaaatggtaaaaaatgggaacccttatcaaggttaaaatatccttaggtcatctaatcgaaactgttaagtataaacattcttagaaaataacgtttgcattgcctctctcttttcatctcttagcacgataacaaatgcagagtgagtggaagaatgaaatgactcttcaaacatcaggaagcaaaaatagttttttgctacttaaaggctccacctaattatctcagttcttttcactttgtgtattcaagctacacaactttatacaatcgttctgctgttgaaacccattttattttaatcctgatctgaggatagaacaggactgatcaggatgtttttatctctattagaacaattgtttcccaagtctgaacttaactttgaatttatcttaaccatggaaatggtgagaatcacttgaactcaacatggtatatctctcagttgagttctcagaacataagtcatttcaacaatatattttattatttataaaaggtgaaacattttaataattaaaaccttatagaacaatgtaaagaatctagccagaattttattttcccccaagtgcataagcaatttaagtaacacatagaagtgtaccttttattcctatagtgttatataccaatgaggaaacagtaactttctaaggatacattgttgaattctttattaattcaaaacattttaagaaagtcagtgtaatgcatatgcattttacaataacatccataggtttccacaatctagtaaaatgaaaacagctgtattttgatttactttgaaaactcaaacctatagttcgagacttctgaatatttttacattactgtcatgctcaaattctgttacatggtgaaaattctagcattttccagaagtatattattgtacataggtaaaatgataaaattgattctaggaagggggaaaaaaaaacccagaaaaacttaaattggaggaaacataatctggattatctattcaatttgtgaatacccaccgttattctggcattgcaaaataaccaagtgtggtgcctcttaagttgcattcatgcattcaaaacttctttattgtccactgataaatattggtggagtacaatatatggatatagattaagtgtgatgaacatggtagtaaaaaattatacacattcgatatgtaattttacaaaaccaaacacattgaattctttttaatatttagcaaacatttaaaaatcatatacaagaaaggtgtttatgacaaatcggttaaagctagcgggaaataggtcttttacattatttcaatattcagtgttcattgattagtggagggcaatataaaaatgcaataagcaaaatggttagtttaaatttaaattacctcttatgacaattagtaagataagatctttaatatccaaagtatgtggaggattattgtaaattgcgcagacagttcaagggaaaaattcactttcacctctattaggtgaatattcaggctaagacttctggagttttatttttccacttcactgtattttctttatagcatttattagtaatcacttagtggaacctaatattagtgtttagaatttgtttagctcagtgtaaatgtccagaaaatttaccttcaatataatctctttaaaaacgcattactttacagtggagaaatataatagatgctacctcagctaagtgatcaaggttaacatcaacagctaagagtagcctaaagtttgagaaactgtcacagctaagacgagtcccggtgatggcatatacctttgataccatgtgatgagcatggcactttaccgttgtgttctttcaaaaaccaaaaacctgtgtctagtcacgagaaaaacatcagacgaatccccatagaaggacattctacaaaataccagtttatttctcaaaactgtcatcaaaaacaaggaaagttgcagaaactgtcacagccaagggaagcctaaggaaacatgacaactaaatgtaatgtggtatcctgaatgggatcctgggacagaaaaaggacattaggttataaactaaggaaatctgaatgaagtatgaatgtaatgatcaatattggctcattaatgcccatagatgtatatgggacctctctatttggagtttttctgtaaatctaaaactactctaaaataaaaggtttaatggacacattactattttaaattttatacattttatttttttcttagagtcagggtctcactttgttgcatagacatgtctggaactcctgggctcaagtgatcctcacgccttagtctcccaaagtgctgggattgtatgcgtgagccaccgtgcctggcccattaccaccttttattaagtttttattttcattgtaaaattgttaaagaaaatcataccaccttaatattaaaaagagtgttttctaattgtcaatctcttataacttagtcttagccctataactcatttatatatttagcaagtaatttgatattatttctgtccttgggaatgttgttttatttcctttggaaataaaactttcaaatgattgatcttatttaaactttaattttaacctataattgtatatccatttatcatctatctatcatctatctatcaatcatctatctatctatgtcattgaaagaaacatttctatagatttgaggtgatggtgaactgaaagtactgatttgggatcacattattgagaaaagcagtaacactgatatagtgttccatcttaaaacatgattgtatgttttgatgagtagctaaatcagatgtttaacgtatgttttggaaaaaaataggggaaagtgcattaaagtgacatttaatacaagtatacaataacaattattgacgtgatgcactttgataaaataataatgtatgccacactttattctttccacgtttgttttatttaatgctcatagttatcctgataattacgtattttatttgtcatttgcagatgaggaaatgaactcagagaagataaatgatttgcccaaagtcacatgagacagaaatataacttgaaatcaaatttgtaattttaagttcctgatgtttttacactatgctccctaagtgaatctgtggacatacatttccattagtaaccttactcatcttatagcttttgtcataggaagaaaatcagttcccaaactgggaccttctatcacctagggcaacattttgccttttgtagtgttttcagtagagtcaaagtcttgaacagcctcttgaattcatctgaaaagatgttacttggggctggagaggactacacctgtaagagtaataatttcaaaaatacctataaataaatcaaatctgggtattcagaaataatacttgtcattgtgcaccatcttgtgttgcaaggatattttaagcactgcagggaaaatctgaagcaagttttgggttatcagttttattgataaatatttgcagttgtagcaagtgaagaattaaaaatttttgcagattggatattgtttttgcaggagaacaaacccattggtcagaaatttgaagatggaaaacacaaaaatacatgtttgaaaaatatacttagaaaattatggttgtaaactgtcaatgtaaacagataggcgaaaatattttttggaaatatctttaccatctttcaaaataattaggcaatgtgtcaagatcaaagtattcaaaatacatgtttgataggcttctatctataggcattttctgtctaagacttaaaaatattattattataattattattattattttgagatggagtcactctgttgccaaggctggagtgcagtggcatgatatcagctcactgcgacctctgcctcctgggttcaagcgattctcctgcctcagcctctcaagtagccgggattaaaggcacccaccaccatgcccggctaattttgtatttttactagagtcggggtttcaccatgttggccagtctggtctcaaactcctgagctcaagtgatccgccctctttggcttcccaaagtgctgggattacaggcttgagccactgtgcctggccaagaaattttaggtggttttcaaatacgttttatttttgacttttttgattgtattttaaattccttctcttttacatttcaacaccaaagcatctaataattggtattttttgagatataatttgtcacaattacaatatgattttttaaagtataaataagttaaaggtatagaaaaatggataaactcaaaagtaaaaatcaggcattattttaaattagcttaatgggatgaaaatgtatttttgctcctaataaataaatattattcacttatccctatagtcctttggcaaaactgaactatcaggtagataaacaacacgtatttcattctgtaagtcagaacctaggcagcattaaaggatactaataaacatccatgcactaagacggcatatcagaactggtcattctatgtacatattttaagatttcaaaaaaaaaaaacatcacattatggtcttgacttctgcatttcgtaactttagtatcaaagttgtgttttgctcttgttgttcatgtgcacactccaacactgtcagagcatctctactacctttggataacatcataacagcccgagtaaagaagtgccatccatccattactggtgtgattaatgtacaagatcaatctctgaagaaatctggctctccaatttatttatatatacataatctgtatcctctactttcttttatagatacatctaaagttaggcactatagaaagtgcattaatctctttctgtgtgcatcagcaaattctaatagtatacaaagataccttggcaattgaaaacacaaagtgtccattttaaagtgctaatttttccccagggaggaatttactcactaggaaaactcaaattctaagaaaacaaatattgtgctcttggaatggtagcatagacaccagttgaaggctcttttgtttatttataatagctctgtaacttaaacagaaggaattatatcatacttagaaaattagtagagttgcaaatatacagacatactcttaaatgagaaaccctcccctcacccaaaaatacgagtttagcacagaaatgctcacatagcatggttatcaacatctgatgtgtaaatctgctctcgaatcttttttaactcaacttcctcatcaggtttcaaaaggatataccaactttaaaatctgtgttctacaaatgcccaggttagagattaggactctttataacggcccttatcttttacatttggtaaaatattaaagatattgtcaaacagacaattcatctaatagtccaaagtatcttataaagataacttatgactagcaggtcaccatcatatatagtaacaacgagaatataaagtctacatttaaaaagatggatgcatgcagtgtatcacagtatattacatattttctagtcatgtgcaccaatttgttgagcctcacacacagaaacaaatatgatactacaccatacatgtgtatatatcatagtagcataataaactcaattctaagcaagaaaaaaattaaataatttaggaacaatagaacttcacaatagaagtgatgattcttttaggtttttctttactctttaggaaaaaatatgactttttgtaaacatcttcatagctatctttttttcaacatattactgaaaacttattcaaatagtatttaaatgacatgaataaaatatgtcttaacacactaacactttcagaaaacacaggcatttgttaaaagaaatgattattataaatattttctatcttgcattttaactgcattttcataaataacgtatttaaaagtgctgaatatggtaggatagtcagcaacgccagtgtaaacagaatattttgttttctactctgcaatttttaaaaaatcccattttgtcaaacactgcaacagttaaaatatttgcatagggaatagataatagcccttttattcatgtctcctgaattctatataaattagaaaatcatacttgcttaaaaaaaccatttttgaaatgttttaagtttatggaaaaagaaacttgtgatgccaacctttcaagtaaaataaatttaaaaagaaacccccaaacttgtttttttaaaaaatatgtttaataaattaaaaaatgagaggtagttaaaaaaatgacaaagaaaacctgtaactgtaatatcatccttaatataaggccagtgttctcagtggatataaatctttttaaaactttcattttaggttactcagtattatattcattcagtttaatattaaaaaaatagtcttcaggggatattaatattcaaatgtaacactttgatataaatatgacactgattattttaattatcacttttatgcatgacagaatattgtttccttgaaggtcagaagtacatgacaatgtcaggcaagtgttttgtcgtaaagatttagtgtacttataaaaaataatatggcagctggaagatttgagcactgtactgccttttaatgatggatgaaaactaatagtttggtttaaacatctttaaaatgtcatccttaagatattatgtgaaaacagttaaggtctgaagtagaggattattttcttcataacccttataaaacttttcctggtaaaaacttagcttttcattggatttcactttcaaggaaaatatgccacaggacagatgctattcatcaaaatgttttacagtgctacatgtaggcattcctttattaagtccttttctttatattccaaaactaagttatcaagcttattattatttttttcttgctgaagtacataactttacacaaccattttaaaactggagagccagtctttaataaattaattacagtattggacatctgatatatacataaattcattttcttctattacagttaaaagcaatatcactcttttgatttgtcattgagataggatatcttcaaattgttttgtgcttttttccttcttccctttttttttttttttgttttttgcttttagcatagtaaactctcctgtaatgaaaatgccacagttttggcagtgaacaaccagaggaatccccattaggattttccaacaaacagagataaatagctctttttcatgtacagaaatattggcttcaaaattagtgtactaaacacagtatatagaatgttgaataccattgttacatagtaaaaattgctttttttctgtcttagattatgttaaaaaatgcaaaccatggccgatttttttggcaattatttcttaagaccatattgcacaaaagtccttaaatacagatataagttatgctactggattaaatattacaacaactatgtggcaaatgaagcattttactttgcacatgcagtctctggagatacacgaggagactgttcataggactacaaatacactttgcttgcaagtagaatgagtcttgaataaaacaaacaatttggcaattcattgttttgtgtggtattttctccaaacttaaccatggaaaaccttgataaaaatggagacaaagaccataacggttgtgttttcacagtagcctgaggaatgctaaactgtagttctccaggaactcagtttctgatgttatttaactacttttatttcccatctcagccctccaaaatgattgtttttaaatgaacattaagattcagaagaagagccagcagtactttcaacaaatgacttataaatttgagagttcaaaaaccttggaaaagaatctctgtgcattaaagtatatatctgaagttgggcatcttcatacatgtgaggattgggatccaacagatttctattgatcacctctctaactcgagaatcaagactgacctaaaaagaaacaagagcaaatacattaaataatatttttttcaaaagacctcaattaagtaactgtaggtttgtgacattttagagaaactttaaagagcaaatccaactaccaaaagtcttgggttcatcttttgagactacacaaccttatgtacttttctccttcaaaatttgcactaaataaaaaaatccaattaagtcttttaaaccagaaatttagtttacagatgtctttgcttacttggttttatggtttctatgcattcattcaggagtttttgacaatttctaatcatggttgagataccagaaatttcctagccagaatgtgaattcacctcctgctattctgtgactgggggaggttggcaatattgataagaagataaaaatctactggcagaaaagagttccctggcaaaaattaacatgcatataaaatgccaactccccacagttttgtatcctaacaagtcctactgtgtcaaaagtaggaaaccaagagtgtggcagggcatgcaatgagcaggtatgcttcaggtctcacatctacctggcaaggactagcaaacatccttatatatccaaagacctcttactaacgatgaagcagatcagttgcttggagtgagatctttgagaggagaaataggaataggaatgcagaatgaccattaagataatcaatacagtgttatttgaaaagtgtacaaaaattaaattctgcaatgatttaggatcttcccccttcctcactaaatgcaaatcctcttggaactggtaaaacatgttggaaagggaaatggggaaaaatacttggcaataagggcatggttggaggaacagaactaaagccctgcgctgaaacaccatgttagaacaaccctacaagtggtaaacaaccactcaaagtccagattgttttcctcgatcctcactgtttagcaaggaataggacctgtgaaccatagttatttcatgacatattcacataaaaccttccatatttatatttaaacatgttgtcataagcattctgcaaatgccttttagttctggcttcttttcccaccactgttcagactaagtctgggaactaatacagtctcttattgaagcctctcctattccatccagtgtccccaggttcctgacctcaacagaccacgtggatttgggttgattgctacaccccagggatggctactagatttgttgggagatggcaatccagactacatttctgtggcttagccagaccaactcatacagggacacctcattttactgcacttccctttatttagtttttcgcagatactgcgtttgttacaaattgaaggcttgtggcgatcctgtgtcaaggaagtcgactggcaccatttttccaatagcgtgtgctcactctgtgtctctgtgtcacattttggtagttcccataatatttcacaattttcatcattattatatattttaaggtgatctgtgatcagtgaccttcgatgttactcttgcaattgttttaggaggccatgaaccatgcccatataagacttaattaattcttaattgatgactatagtgtgtatactgactgttccactgacctgctattcccatatctttgtccctctcctcaggcctccctatttcccacagagaaaacaatattgaaattaggccagttaataacccgccagtggcctctaagtgtttaagtgaaaggaagattcacacatctgtcacattaaataaaaagctaagaaatggttagttaaacttaatgaggaaggcatgtcgaaagctgagactggtcaaaagctgggcctcttttgaaagttagccaagttgtgtaggcaaaggaaatgttctcaaaggaaattaaaagtgttactccagtgaacatgtgaataagaaagcaaaacaacctgttgctgaaatgtaaaaagtctgagtggtctggatagaagatcaaacaagccacaacattcccttaagccaaaccctaatccagagcaaggtcctaactctcttcaattctgtggagactgagagaggtaaggaagctgtgtaagaaaagtttgaagctcacagatgttggttcatgaggtgtagggaaagaagttatctccataacataaaagttcaaggtgaagcagcaaatggctgatgtagaaactgcagtaatttattcagaagatctagctaagataattgatggaggtggctacactaaacagcaggttttcagtatagacaaaacagccttatattggaagaagatgctatctaggactttcagagccagagagaagtcaatgcctgatttcaaagattcaaggacaggctgactctgctgttaagggctaatactaactggtaactttaaacagatacgaatgcttatttaccattctgtaaatcctagagcccttaagaattatgctaaatctactctgcctgtgaactataaatggaacaacaaagcctagatgacagcacatctgtttatagcatgtcttactgggtgttttaagcccactgtcgagccctactgctcaaagaaaaaaaagattccttttaaagttctactgctcattgacaatgctcctggtcatccgagagctttgatgaagatgcacgaggaaattagtattgttttcatgcctgctaacacagcatccattctgcagcccatggatcaagaagtaatttcaactcacaagtattatttaagaaatacatttcagaggccaggcgcggtggctcacgcctgtaatcccagcactttgggaggctgaagtgggtggatcacgaggttaggagatcgagaccatcctggctaacacggtgaaaacccgtctctactaaaaatacgaaaaattagccaggtgtggtggtgggtgcctgtagtcccagctacttgggaggctgaggcaggagaatggcgtgaacctgggaggcagagcttgcagtgagtcttgatcgcgttgctgcactccagactgggctacagagtgagactccgtctcaaaaaaaaaaaaaaaagaaacccatttcataaagctatcgccgccatagtgattcctctgatagatctaggcaaagcaaatgaaaaaccttctggaaagaattcaccattctagtcattaagaacatttgtgattcatcgaaggaggtcaaaatatcaacattaacaggaatttagaaaaagttgattccaaccctcctggatgattttgaggagttcaagacttcagtggaggaactaactgcagatgtggtggaaatggtaatagaactagaattagaagtggagcctgaggataggactgattgctccgatttcataataaaactctaaagaataggggcttgcttcttatagatgagcaaagaaagtggtttcttgagatggaatctattcctggtgaagatgctgtgaacattgttgaaatgacaacaaaggatttagattacataaacttagttgataaagcagcagcagggtttgagaggattgactcctattttgaaagaagctctactgtgggtaaaatgctaccaaacagcattacatgctatagagaaatcttttatgaaaggaagtcaatcgatgtggcaaacttcattgttttcttatttgaataaattgccacagccaccccaaccttcagcaataccagcctgatgagtcagcagccatcaatgtcgaagcaagaccctctctccaccagcaaaaagattatgactttctaaaagctcagatgactgttagcggtttttatcaataaggtattttaaaattaaggtatccacatttttaagacataatgctgttgctatgctattgccaagtattgtttatactatgactacagtatagtatatcttttttttgttttttttttttagtctcgctctgtcgcccaggctggagtgcagtggcgcgatctcggctcactgcaagctccgcctcccgggttcacgccattgtcctgcctcagcctcctgagtagcggggactacaggcgcccgccaccacgcccggctaattttttgtatttttagtagagacggggtttctccgtgttagccaggatgttctcaatctcctgacctcgtgatctgcctgcctcggcctcccaaagtgctgggattacaggtgtgagccaccgcgcccagccaagcatatcttttatgtgcattgggaagccaaaatatttgtgcgacttgttttgtggtatttgctttattgtggttgtctgtaactgaacctgcagtattgctgaagcaagcctaaaaaacattacttggctgaactacacatttgtctttattgggaattctttaaaaataaaaatgttctggaaatgaattgttcagtttttattttctgttattaccacatgaggtcactatcaagtacaaagtaattttaaaaagcacagaatatttttccccaacgtttttattttacctgaaaatgtatttttgcatttatatgccagagggaaatgctgacactggagtttaaactgagataaactgatttatcttattctggaacatcatgttatggtaaggtaaattcttaccaaacacactcctctgttttctttcaaacttgagaaaactttttgtttcaatagagcaggaaaccttacattagagattaaaaaagggggggtcatttacttcttaaaaagtagtatcattaaatatagtgtaaaagtttcttctcagtagaaggaatcattattatcttaagacaaataaaataaactattaaatggcttatgtcctcattgtttaatttttaatttttttgcaagctaaaaacagtagtgaaatattgtaaagtcatacagttcaatatttagtaatctataacaaaaatgcatttgttatttctatttaaagaataaaatatttaccttaatatcaggttgtttgtctgaaaaggctgtcgatcagtcaaaagaagtgtagcgaggtcaaataataaggataaaccccatggggataacaatctattgtttcatcttgtgccatctttgtgcttcagaatgtggatcatctataatacaaggtattggtggtggatcccagttgggcctgggccacagtcaccctaggattcaggtgtgtctggatggcttctaaagccatcttatctgggctccattgcatgagggactgaggaatttcctgtaaagaactcatcctaagggaagagaaagttgagtagcacaagataagagctatcctcgggcaatgcatgtctcctcttatctcaggccacaaagacccataccaaggtggtgtggagaaaagagtgcattccagcaataacagaatttatagcacaaaagcactacccttgtgagacagggcacaagacagcatgataggtttgaccgcatttaactggcagttttagcagtgctgaaaagtccggcaatgttgagacatagcaactgaagttttaaaaagacacaagtgactttgcaataggtctcggtgaacttggaagcattcattcccacagggagcaggagacagggaggcagaaaagcaagggacttgcaagcaaaaagtcatgagagcgaagtggtcaacaaaagtatggaggtaaagcgaggagaatgaagacagagaaatcttgttagtgtggcttgggaaaatctgggctaaacggagtcatataccctggttaatcttactagatttcctattcattgaaggaggacatgaaggtgggttagcattgctgaaagggggtacaccaacttttcaccctgcctttttattccagtcatcaagatgcaagggaaaatttgatcctatggacatttttggcataattatacgagaatattgaatttttactgaaagtctttttctctgtagagaacctttctttatgttatttaattccctgaacaatgtttttcacgtatcacatccaagtgttttctccatttttctctcttatttttactgttactgaagttgctttatttagaattcctttccaagtaaaattctgattaattttttccctttataagtccatatcaaattttaccaatggtaacatctgccactggaaattttcttttctgcttttaatttgaactaaatttggtattcctatgttaaattttataaatctaaagaatacatgatcctcctatcaattttcatttttactttgtgtacatttagtcacattttattttgtgcttgttatttctcctgaaaataatggcacattgcaaataagaccagttgtttgaatttctctcttagaacaaagattattggtagggtaaactgtaatgtaatactcttggtggtgtctggatgataggaaagtatatcctgctggtctaggggagggttcaggcctgtggttaaggttgctatttctcatcatgtgtgaagttctacggttgggtttatagaaatctaaggtaacatcaggaagaaaatattaggcaatggaagaattaatcagcatggtatatttggaaaagcaccacatttggaatcagaagatcttgggcttgaattctatctctaccagatatatttataatttcctcaaacattcatttcacctctttgagtatcagtttcttttgctgtaaagtggtaccatcggtcctcgtggctgaaagattgttgtgagactcagactgtaataatataggcaagatcactgtgccaataatgaagccaatgtaaagtaattaataataattgatcataattatgacatcatcttgatcaaacccaatgtgtttggcttttgcatcaatttgaattttaccttctcagaatgaccttacctgactacttctattccatctaattcaatctccagcccatcacaatttttagttacttatttcaacaagatttgtctgtcttcctaaaatgtaagctccattaagggatcggccagtgtctcttgtttatcatcatatccccaacatctagtccagtgcttggctcataggaaatagtcaatattttttgaatgataatatgcgtgcataaaaatacatttaggaaaatacagtcaagtgagttctgtttagaaaaactgacttaaatcattgaatgtgctaaattcacataatttcacttaaagacatatctacatggacacacagaatctgcatgtctatcacataagcattattttgtagataattctggtgttcaaataggtctattacttttttctctcagatggtaactgggaagttagaaaaatcagaaaaagcaaactcctactacgattacaattaccattccccagagcttgaacatcacagatatcacgggtttttgggctttccccatgccttcattcataacactaggacgtggaggttccagcgcactaaagcgagctgctaagtggctcacagatggtaagtgacagatgcagtttatagtcctggtaacgacaacgccatcactaggcagatttctacctaactggaccatggttttcttcaattcagatacatatcttatatttattgaaggatttatagttatttctttgttcagtagcttaatgctgtttacagttgataagagcctctaagtagattttttattcaagttatttattttgctaggtttgtcttttgatatcgtttggatgtttgttcccaccctaatcacaggttgaaatgtaatccccagtgttggagatggggtctggtgggagatgactggttcatgggggcagatttctcatgaatgctttagcaccatcttcttggttctgtccttgatatagtgagtgaattcttgcgagatctggttatttaaaagtgagtggcacctccccaccccttgctcctgctttgcccatgtgatgtacttgatctcccttcatcttatgccatgattataagcttcctgaggcctccctagaagctgagctgatgccagcaccttgcttcctgtgaagcctgcagaactgtgagccaattaaaccacttttctttataaattacccagtttcaggtatttctttatagcaatgcaagattggcctaacacatcttttcaataataaatataagctgccaccaaaatctgcaatgtggagcaagtctactattaggcttaaaggcctctttattatcttcatttgttttcccttgaagacatcacttttaaaaaatttactttttaaaacaaatgtgtaaatttctagttttttttttagtttggccttttccttcataaaatgtacactataccaagaacagaagttatgtcacctcctaattgcaaatatcttaaaaaaaaaaaatatatatatatatatatatatatatatttttttttttttttttttttttttttttttttgagacagagtctcgcacttttgcccaggctggagtgcagtggcacgatcttggctcactgcaacctccgcctcccaggttcaagtgattctcttgcctgggcctcccaggtagctgggattacaggtgcccgccaccacgcccggctaattttttgtatttttagtagagatggggtttcactatgttggccaggctggtctcgaatgcccgaccttgtaatccacccatcttggcctcccaaagtgctgggattacaggtgtgagccaccgcgcccggtgatatctcttattttataacacaatgctcaaattattacaaatgcataaaacatattcttaaaataaggtaatgtaatttttagcacattgacttcaatagtttcattaggggaaaaagttatctatatataaatgatttttaaaatgtagttgtttttctatatttaacaaagaggaacacaaatacgcaatcaaattaaggtaaaatgaaagtctagtgaagaaaaatggccttctgtttaacagtaaaatcatgacaatttttaggcattaccattttataatgagtcaaatgttcatgttctttaaaaatattctgaataagtagaaacatgcatagaatttcagaggtagaaagccaagattgtctagccccaaaatgagaaacagataggaactcagattggtattaactgccttgagtactgtgtttaagtagattctgaggttcagtgtggggacagcagtaaggaggaccatgatggataagctatgccattaggtagagaggatgaagtagtagcacaaatactctgaataaatagaaacatgtatagaatttcagagatagaaagcccagaacggcctaacagaccttttcaatagcttcatagccttacagttgccattatgcatttggtttattagtttctgtgcttatttttattgttatttttgtaaacaaatgaactgaatgttgagactcagaggggtaaagtgatttatcccaggccacacaactgggatgtagcaaaggcaggattaaaatcctgtgcacctgaatattagtccagtgctctaattccggtataatcaggactctctcaatctgacatgtgctctctccaatgttagaaaacaaaatctgaagagtggtaacttgatgtaagtcagtaatgtattgtggctgattagaaatggatgactttttgcacaggaagttcagtgaggtacataatagattgaactggcttcggaatagccggaaagtgcatgccatgcgctgagtatatcaatgagtcgagtcaatgaacaggataccttggtttaaaacatagctttttaacaattatcttttataactgaaaatatctacttttgcttgtttgtttttgccattaaacaatgattaaatttaattactctgttgacaggatagaaatcagctggctaaacaatggcacttcaatggtctattaatttctataccaagagttaattacaagtcggcaaaattagaacaagttgaatttcacctctgtctctgtttctttgtgatattttgaggatattaaagaacgggtaatggccaaaatatgggtattaggaaacataaaggagagagtaaatatggttacgacactaaacattagtgtatgtcattctggaaaggtcatgttcttgatcaggaaatgagattttagtgactttctggtgaaacttgtgttcaaaagaaagaaattaggtgaaaacggccaggcgcagtggctcacacccgtaatcccagcactttgggaggctgaggcaggcaggtcacttgaggtcaggacttcgagggcagcctggccaacatggtgaaaccctgtcaccactaaaaatacagtaattagcccggcgtgttggcgggtgcctgtaatcccagctacttgggcggctgaggcaggagattcgcttgaacccaggaggtggaggttgcagtgagctaagatcgtgccactgcactacagcctgggtggcacagtgagactccgtctcaaaaaaaattagatgaaaacaaacctctattactttagcaaaaagaatggaaactcactagtttatatttaaataatcactattgtaactctaaacatgcctcaaaaagaaaaaattaagtattctacaaagctccatcaatcagtgacatcagaaaatcaggggctgtgtggataataagaaaatgttttacataaaaaactaaacattaaagaacagaaactgtaaaaataagggacatagtatggagaatattttttctcctaacactgaaaaagaatggaacagtcatcattttaagatgctacaaatatagcacaaaggaatggactaagtaatctagacaactatcactttaagatgtcacatcttacatactttgggggcagaaatgggcttgataatcttcccaaggactctcattttgtataattacaggcaaaagaagcacatatttgggcacatttggatcatctggtttatttgctatgtgcaataactttaaaataataaaaattagcataaaattattatactgataaaatacaagtagagttgtttagatactaaaattcgaggcaggctaaaagcctgaagaatgcagttttaagatgcagaattataccggtgttagaaatacagtgtgacatcagtaacaaatgtgttgaggctacatatttattactgatgtcacactgtattacatttattaaattctccccaccttgcttttatgaatacatttttcatgttcatgtaggaaataaaaaaataaatcaatcctttgtgcgtctaattctagaaggtttctcattttgtagagacaatagtcctggagcactctggaataccaatggcattttaacctaactaattaaaaaaaactatataacttaggtactgtatatcttattagaagtgaaatcgtttatgtagcattccaaacttagaggttaataaaatagacactaattccttttatagatctcaaagcaaggagtgtaaggcagcctgggaccatgccaggtattggaggaggaacagatgactgtagcccataaatgttcaggtgcacaagagaggggcatgccatttaaatgcaaaggtaaaaatcacagttgtttaggagaaacaaaaaagacaaaaagaggctgggatggaaaagagaagacattctaggaacctctatgttctctaagtgctttgaagccctctggagctccatcacacagggctccaagggcctggccacattattaaccactctttcaccaaatgcttttaactctgttagctggaacatttctcaagaacaaattaagttttaaacagtcaatggaaaagtgctatttggttgctagaagtattgcttattgattaggtacattttggcaatgggaaagacacttgcactttcaataacagaaaacctagaataagtaatataatttccatttcccacctaagaatattagtggtcaaggatcatttttcatttctgtaaagagtcaatcataaacatcaacaaacatgtcagatttcttttttttgagtacctataccagaggttttccaactagtatgtatgtggaaaacttgttaaaagtgcagatttctgggtcctatttccaaaaattcagattcagaagtcctggttaggccttaagaatttgttttttaaacaaatgctccaggtgattctcattcacatgatctaggggtcatgctttgcgaaataccaccctaaaatacattctctctttccattttcgtttgtcacagcaaattgtgtttaagcaggctccttagtgttagttctgaaaagcaagtgaactaccacacaagtcagctagagataaacagtcaaagcatagtagggaaacctagccttcaaacatgtgttcaaggaaattctcccaacagaagctgaattatctacccagtgaaatcttctaccctctccacaccccatgccctacccaatgtggacagccatcccttgacggttatccttggtcttaggaagcccacctcaatgttttccagatttttacctcttttggtgatagtatagaaatgtaatcttcatatatcatcctagccttttcttcaattacttttttgttctgctccttctttaagtcttcacaagcaagccagaaaagtaggttctcttcactgtattctgttcggaggaactctctgaaaaggtttcttcctgctggggccttcatcatcttgtcaaaattttgagaccaggacaagacttcctctgcagtggggttttggctgcagagacagaacggggccgtgatcaaagggaactttgtgaccagtgaatgctagaccaggtaaggagaggagcagatagaaattctatcaatttgctgccatctagtggtcagtattttgccactcagtccagcctgatgtgccaaataagtatctgtcaggactacgtcagttatttcagggttttgacaaaaattcacacaggcataagagacatgtagggagacaagcattcaaacagcaaggggcctaaacataatatgcatgcagtcatcgtacattcctaatgaagcttggaaatgttcaaactttaacaatgtgttgcaagttgatagaaactgtctgtaagtgactaaggacaacatgaattttttctttgcctctaatcaggatttcaattttccagccataagatacagtttttttttctcatctctggtggccatttttttcatctgtcacttgatttaaaataagaatacactgtgtgcacttgtcacatattttcctaaactttaataatttttctgttgggcatggtggttcatgcctataatcccagtgctttgggaggctgaggtgggaggatctcttgagtccaggagtttgaggtcagcctgggaaacatagcaagatcctgtctctgcaaaaaaaaaattaaaaaattagctgggtgtgctggcatgtgcctgtagtcccagctatttgggagttgaggcaggagaatcacttgagacaggagcttcaggttacagtgagctattaccatcccattgcactcctggctaggcaacaaaatgagatcctgcctctaaaaaaaaaaaaggtttttttcctacgaaaagttaatgtacgaattgttagtcatgaatggagttatcataattggaagcagagtgcttctataatgacactgacattggggaatttaaaactatatacagatcttttagtgactaggtgactgcaaaaaccactagtaattaatccacttgcttatacattaaagaagtagaagacagaaacttggagagtcttatggttaaaatgattctgatcttcctttcctattcaatgatttacttaataattttccaatctaaaagacatttggccaaagaagtatgtttatatatatatataaacatatatatataaaaacatatatatataaacatatatataaacatatatataaaaacatatatatataaacatatatataaacatatatatggtaaatacatatacacataaaaaggtaaatacatatataaaggtaaatatatatgtatttacctttttaaccaggtatttcaaatagattgttactattccataatctctgcacttcctcattcacttaaaacaatttttaattttaaaaagcttaaaaatgaccatgaagcatcattaaaaccttctcataaaaagcagaaaaagaaagcacttacaattatatgactggactatttgtattttgattttagtccataggtacctctcgtttgggaggcagcacgtggggagagtctgctctggtagaaaaggaaccaggagtcgctgggtgcccttcctcactcacttggacattccatatcatttgtgtgtgtgtttagacacttctcttataaagagaaaaacttgaattctcagaaatgagaagtaatgaattagggcaattttgggtgctaattcataagacaatctttattttttttaaagagaaaagtaaatttagatcatgttttagccaataacttaacatagctaatagaaaaattgctgaaaagcaacagcaatgacaaaataagatcttccagattgaatttgcattcacttcccaaaatcattttgaagagtaccatgaagcaaggggtaatactgaggcacgcagttgatgtaaatggcatataaatgcaagaaacaatagctatgtggttctcacactcaccattcctctaggacctggatactctccatttttgtagtgtgtgtgggtcttcccgcattttcccctctttcttcattcctcacagtgaggctgtaatgtaacagaacatttaattttgtcaagggaaattcaatcagttgaagaaaagaataaatttttctggggaaacatttcacaggagatcttatattcaactatgtgagaatatttaaagtataaaagagcaataccatttttaaatgatgggcaagcccatgtcaaagggaagagaataatttttaaataaaattatatagtaaatcagactcccaaaagtggatattgttaaatattctgacttcatccttacataatctgaattactgaatatttctgagatatatgattaaatgccttaatattatatatatatgtatatacacacacacacatatgattaccttactctttaaacaaaatgtcattttgatttttggttaattctattcatagtctgttttccattaattttccccgattgagagctaataagatacaatgtgtcagaatctaatacagattttgctaaatttacattgttaccgataatatcattccttcaattgctaaaatcaagctaccggatttatatttgactttgtttttgccctttcaccccagtaaatcaatgtccaaggtcttgaaagggacagaccagtaactgagcatttggaacaggtgagcattgggtgggaggggtgtgtgtctgtgtagcataggtttgggaattctacagcatcatagaggacagaggataatgccgaaggttttagtagcccagaacaagaataagaataagaattgtccaatgacaattgctccctaaagctgagcagtgctttagggcaaaacaccgaaaactctcggtgtggactagaaacaacaggtgaggtcatgggagatactaagaagcagggtagggagaataactcagtggctcgggaaaatttgagctcccaaattagccaactgatccctctgtctagaagccgaggagcttaagagcctggcagagagcacaagaagttcagataacatctctcatttgttccttctttcacttacttactcaaaataagaagcaatggaaatgatgattttctagtgcctgttatgtgctgggcaccattcttttaccattaatattattatccccattttacagatgagcaaagtgaggtgcagacccgtctgggaggctggcccaaaaccgaacactaaataggtgctatagttggaattggaagcctaccctgttcaacaaccctgtatttctgagtgcctgctatgaaccatggctgctgatagacactgaggtcatagaccacttactatgtgaatgcaaagaagggtcactaaacatcgttggtatggaaagaaagtgtttaggaagaggtgcccaacaagcagttattctcaatctggaaagtctgataagagaaaccaagacaatgtctccttaattccttctttcattctcaagtgcaagcgtgaggacggagagaatggagcaaagggaaatattaatttctgacaagcgggcccatctacaatggaaagtgaggctagataggaaaactgacctgagagagcagactcactggaaaaaggagaacccaataggaattgaaaaggattctgtagtcaggaaaaggacatagaaaacataggatttcatagtgaaatacattgagtttgcctctacccatttctagggacaggggcaggtttattggtgtcgaaccatggagggaaaggtaatgtagcccagaaggattctggggagcagaaactagagtggatggtcccttggacctgctgcacattgactagacccctgctggaggcagcagtcccagggttagagacagcaaagcctttagcgtagtgtaattttggggaggaattcagagacagtgcataattttggaggtatttgcgtgtgagtgctgtgaatgtgtctgaggtttgagatagcctgggaaacctcagtcctctatgtcactatacaaataggccagataagtattttagaggagattcatgaatgagtaagaaagttcttctctggaatttgatgtatttccagtcatgatgggaaaagtggatggggggggatacactgctgacaatattctgtaaaacttcctgtatatataaaatgtacaattttttggtaaattctattcagctctttttaaaataggaaattgatactcattctgtcaacctttattgagcttctatgtgtgtgtgcaaacacatattaaggcactataacacaactagcaaaagagctttcatcccctgcttaaataataaactccttgagtttatttttattacatttccacacagtgttctacagaaggcagtacacatgacgcaggtatacttcatttcattaaacatctttgagaaatttttttctccgttgtgcctttgccgtagagtgacaaatctggagtctacaggcatgaatcacgagtttctgaacatgaattctggctcttctatctgtttctgtgatatttacaaacatcccaaatgctaccatattagagcgatcattacgaaatattaggttgagtttacatctttcttttctacaggtggtaaaatatggacacacatttggactaaaactacttacaacagacattcagtaaatgtttaactattcactgtgcagctcttgatctactattggccacagtcttgccctgtagaaattgaactttggcaacagacaaattgtcctttttattaactgtcctttactaccggtcttaaaaaatgggtttcaaggtttcagttatcaagaactgctgaaaataccattttaagttaaagagaaatggagaaaatagacaagggattaatacttaacagtttgtctgtcttgatattgactaatgtctgtcctacctggtcctgctccaagtagtgcattgttgttgttgtttttattaattcactggaaatatttgctctagaccaacttatatatgttatatgtgtttgaggaaagccctaaaaggaaaataccagatcaacagttttgagggtcccatagagacacttttttttttctttttctttttctttttttttttaagacggagtgttgctctgttgcccaggctggagtgcaatggcatgatctcagctcactgcaagctccgcctcccgggttcaagtgattctcctgcctcagcttcctgagtagctgggattacaggcacccgccaccatgcccagctaatttttgtatttttagtagagacagggtttcaccatgttggtcaggctggtcttgaactcctgaccttgtgatccacccactttggcctcccaaaatgctgggattacatgtcttgttttttctttttagcccatatctctccaagaagagacactcccccactgacttttatgtatgtaacatttaaaactaacatttctactttttaagcaataaaagccacaaagagaactaaacacatacacagtgctcactgtgagggtcttgatcaaaccttaaatactttatggaagaaaagtgccaatatccttggccaaatatactaaaataagcatttaaaatcccattagagattttctaaatagtgactttgaaaagggaggaaaaatacttgtgacatttgagaacttaagaaaatgtgccccctctctatgggggtggattgtttgtttacaggggagtgtggacagtggagtgagaaaaaacattacctgctgccaattatacagtttatctactgatctgtcatcatggatatgcgcagggtctattttggaagacactcttctattgtaaggaaaacaattggttcttaagaaaaactgttaaaatggttgcaaagaagataaaacttaccagtagccatggtaactctgggatagaggctggtcaggaaagcacatatatttacagaaaaattaaactgaagaatcaataagatgcctaaatttaatacagtgtgacatcaaggctccaagagagaactactgtcactggtaaaagcagtctattcaatattgaaatagtctcacattgtgatatcaatcttttctttttatttaacagcttctacctcaaagttcctggtgcaaaaatgaaatcaacatccttcaggctctgaaaatgaattggtagattattctttaaatacttcattttcagcattcaagatatcacagtaaatactagaggagttagcaatactttagtaatgtgtatgaaacactggttcatgcaacattccctggttggacataaaaggtgaataagacaaaggctctgctactgaggagctcagacgggtaaataaacatcacatggcattgtgataagaactcggacagaactgtgcatatggggtttcttagacacccttgatggtacctgtgcttttgcataagagaattgagaaaggcttcacagaagacgtaaagattaaattgggttgaaaatgggcagttgtttgccagatggagacctggaaaaaggggatctcattcagagtggggataaaatcatgcaggggcacaatacaaatgtagaacagaatggacatatcagatgttgcagggctggagcaggagaataaaacaggcagcaaagtatgtgttatccaagaaaatgatgaggtggactccaaatgtagaatatacctcctttaggatggtttaagctttccatgctttgttttcaccattcataatggggataatggcaatgaactacttcacaaggatgtaaaacaaaaaataaaagcttgtgacaaaaaggcccattattacagatgcttagttgaatggaagggcaagttggttgcatattaaaattccaattccaagtttaccaaagagctttttatttccacctgagtaaatagagacttctcctttgtcattattacacaacacttcctcatccattaccttgtcacttcctcctcacaatagtccttgaaggtaagcagcagagttgttattagtcattcttgttttatttacaaggaaacagttattggggttgacttacacaatacccacaactcaaaattattagaactaggattggaattcccatcttctgacttcctgtctcaggctcattttcactctgcaatgccatttctctttacatagaagagttaattgtggtattgcaagtgtttacacaagtgatttttcttaaggtttggaaaaataaacctcctagtacaatccagtacattgagtataaatgccctctctaagtatcatcccacagctatcactccataggagctgttgcccagaggtctgagtttgcagtagaatttgatgaagagtaacttctcaattccctggaatttgagatgaacaaaaaggagttgttatagaaggttttgacagcaaagtgtgaaagaggaaggacaaaagtaacaccgttaatgactgcagacggtgttgctatggctgaggagggccatcctgggaagtatgactttcttccattagcaaagataacttcaggacagggcaacaaggaaaggagaatagaactgatgtttcacttacaaaagactacccaccccccaaaaaaactaaaaccccaaaccaaaaagacaccagaagatgggctggtaaccacataatatacaacatttcagacacatagaaactcaatgttaaacctatgatttgaacttcacctctttcatttctacatttttataatagagtatggttttgagtggggtgtgtggggatgggaacagtggttagaaatttgtgtctggaaatgttataaaacacctgcctaaaaataccccatgttgcccctctaaaggctcactccacattttgtaatcatgtgccgtgtgtcatgaaacaagtatttcatttggcttaagcttttgtttcatgaacttaaactcaagtaaaataatcagctatcaaatatctgtccactagatggctgtgttacctttataaatacaatattttaaccaagtcagaataaaggaaaaactgaaaaaaagtttctgcgggtaaatacccttatttgaaaaaaaaaaaaaaagtctattcattctcttaaggagttttgataattatatctttctaaggaatctaaaaggagtcattcagtttttcggtgagtgtaataatcaaactcgaagaggataaacttaatcttgggaggtttgcataactgcaaccatttttcctttttggtatttacaaaatattctgaatagatcccggcccaaagtcatttgatttgggaatactttagtcttaaaaacaggcaggcatactgttattaacattgtcattatcgtttccgataagaagtcgttttgcattccaccgtctcatgctgggataatacagaacttaggtcatacattcttagaacaaataaattagaaaagggttttaactaccaataggtaggaaatatttttaatttacaatattttaaaagagccatcctgagaatggattctccacactatttcaatttctgtttgggtggtacgtgaacattcatttcttcttttgacccatggaaactgaagacaaatttcttcattctctgattctctctctcagttgccaatttctttctatatacgcatctgtttgaaaagatgggtatcaaaaattccatctttttatctatattcaattttcatttgaaaccccaaggcctggatttccttcatggacatattgatttgatttggaatgccaacttcatttaccaagtaattacatggtgaaaatagaaatctacacggtacgtttatgttcagttagatgaccaaagcttcttatttagcataaacagagtttatttttccttaaaattaagagaattacaggtctgaatacaaagatatactttacataatacacgccaggccaagcatggtggctcatgcttgtaatcccagcactttgggaggccaaggtgggcagatcgcctgagctcaggagttcgagaccaccctgggtaacatggtgaaaccctgtctctactaaaatacaaaaaattagtcaggcatagtggcgtgcgcctgtagccccagctactcaggaggctgaggcacagaaatcgcttgagccccagaggtggaggttgcagtgagctgagatggcaccactgcactccagcttgggctacagagtgagacttcatctcaaaataaataaataaataaataaaaataaaataaaaataaaaaatacatgccaatcatcagaatcttctatacctcagttctcacgttgattaaaatcctattttaagctattccttcaacccactgtaattttacctataatttataactaagtgaatgccttaatgggaaagcaaatatcttagatgtgaaaaggccaaatggacttctatttagttaggagcaataatagtgtgactgttattaaaatggcatgcgatcatttgtgtcaagtgcattaattcaattggagctccagtttctgactttagaaggctgggtccctatcataaaaaggagagtgaaaaagttaaaaccctgttagtgaatattcagaaatatatctgatagctggcaggactgctcattcatctacccattcatcctttccctcgcattttccagttagtgtgtgtgtgtgaatacgtatgggatgaatgtgcggggcttccttgagaacagacaccatggaagacaacaatcttgatctgtagagaaacaaaaccctgctatataaaagttacaacactctgggaatcctgcagctgtgcagtgcatgctccagggctgctctgacgtatacctgtgccgattaatgtgagggctgggaagcgcgaagtgatacagactgaagaaacagcatccgctaccttaactgacaacatgcaaacagaaccttgccaagcctgcaatagccagatcctacacagtctggtaaattcctctgggcctgagacttgtaaagggacagaaataatacctatcaataaaggattacgcagggatttgtgtacatgactaatcgcattttactgaggaagaaaccgaggctcagaggtagtaagtaacttgccaaaggtttcatagttacatgtgataaaactggaatgtactcaggtctgtaaaattccagtgccatgggtctttccttatcccatacagcctcttgaaagtcagctttccgaggaagacatgccattagaatttgcgtgtaattgtcaaatatggcaagactacctctagaacgaaacacatgaagttactgttccactattacgatggaattggcagttaaatggctctgtacttttaaataatctatattgctttggctgcgagcggcggctgatgcctataatcccaacaatttgggaggctgaggcaggcagatcacttgaggtcaggagtttgagactagcctggccaacatggtgaaaccctgtctccactaaaaatacaaaaaaaaattagccaggtgtggtggtgcatgcctgcagtcccagctactcgggaggctgaggcaagagaattgcttgaacctggcaggcagaggttgcagtgggccaagatcgcaccactgcactgcagcctgggtgacagagcaagactctctcacaaaaaaaaaaaagtatattgctttatacacaaagtgtcagtgacagaaatttgtgtttcacttaggaacagatattcccatgcaaaaagatgtacattaatatgtaacatattaatgtctgaaacaaagatatggactttatagcatttatacatgctatattttatagcacccagtccagcatgattattataaaatcaatttcattttcacaaaaagtgaatttgattgtcttatctgacaaaaacagaacaagtaattcttgaatcatgtcctaaaagagcaggcagattgtaataggtctaccacacctagaccatgaaagacagtaggttaggcccataagaaataatgaagacttttaatgagagaagcaaaagtagggttaatacttaatttaatcaggtgtaacacaactatgaaattttataaataagggtagcaaagaagtcagcctcatttttgcattattgattggaattttctggaggaatttgttaaatattgtccaggtagctaataaagttgacctggatttggaatggttgaatttcatattgccttggaaaatgaataatttgctttgaatgagtcaggaaggaaaatccaacttctctcaaagcaaaccttcaccctgaaggaggagcatatggggtcttagagtcttcaaagaggggctcactcattttctctgtcagtagcttttctttctccaagttcttcctcgttgtacatcttacagagaagcttggttctcttaaagttcaccaagaagccctcctggctggtcaaatcacaaaatgttttatgattcttattgtattggacttctctggtgtatctgcaacctcagacttccctttgtgaaactctcaattctcttggcttctgtaacagtcccttgctgtgttttattttatttttctgagacagggtctcactcaggcttgagtgcagtcatgtgatcatggctcactgcagcctcaactcttgggctcaagccatcctcctacaacactctcctgagtagctgggactacaggtgtgtattaccacactcggctaattttaaaattttttgtagagatggggactcactatgttgcctaggctggtctcgaactcctggattcaagctttcctcctgccatgtcctcccaaagtgctaggattacagttgtgggccactgtgcccggcccccttgctgcgttttgcatgtcatttctcacatcacttcttctccactgtgtttgcaactctctcactcctccattgttctttaaatgtggtgtgtcctgaggtttctgtctgtagctccctgcttttcaccctggaatactcaccagggcgaatcattctcatctcttgcaactgatgagtcccagattgtcatatttcatccacgcttgtcttgcaagcttcaaattcatttatacaactaactcttggatacctcaatcagagcaagttgaactcatctttgtatccttggcctaaataacttcctattgcagtgtcctctcatttgatgggatcaccagcaacccagctactcatgcaagcaatatggagtcatccttctctttcttgtctatcattaattcttggcagtatatcctaattttttcttgaatatgcacttctctccatcccttttattgtctctttctgttgtgccccaccatctctcaccaaggctattataaaagtctcttaacatcccccttactttttgtattttcttccatacattttccattccctcaggagaatacttaaaatataaaatggactttgtcctctccttacttaaaacccttcaattgcttcccatctctaaaaaggtgtaaactccttaataaggtggaaaagatatttgattatttgtcattgcctatctccctagtcttctattttgttcttcttgactttatatcccagaaatgctaaacagatttagtgctccctccccaaattcattccctctgtactactaattggtagtactacctttaaaacacacacacacacacacacacacacacagacacacacacacacacacacaggagcatgaagaaaaatggtgcataaaaaaaaatctggtggcctgggagaatgtgcctgtaatttttgaaaagaatttctgtgacacaagtttttatatttcataaagtaggctcaattggcaaatccaaatccatcacccattcaacaaatgttaaacacctactaatactggccaaataatgtaagccaaaatatgcattttttactttttttttttttttgagacagagtctctctgttgcccaggctggagtgcagtggcgcaatcttggctcactgcaacctcagccccccaggttcaagcgattctcctgcctccgcctcctgagtagctgggattacaggcgcatgccaccacacccggctaatttttgtatttttagtacagacggggtttcaccatgttggtcaggctggtctcaaactcctgacctcgtgatccacccacctcggcctcccaaagggctgggattacaggcataagccaccacacccggcctattttttgctattttaatgcatgaaacttcagttatctgtttacaaaaatgcctggcagcaatgaccaatatggagttttgtgaattcaaatacaagatctatgtaatataatttttaccaaaggtattaacctaaaaaacaacaacatggggcagacaggagtatcactcgtataaaaaatggttcagtgggttggtgagtcaaactctgacctttcatgtgttcagccttctctagggcagagggagccatggccatgggtatgaacagcaccagtctattaccaaggtcatccccaaagctccggtacatcctggcccatccagacatagatagtcctcactgcattgccatgtagagtgagtcagctttggctgaaatttgagttttttgtccgggtctgaaccttgaagctgactggggtatctggggtcagcagacctcaccgtgcagagccctgtcaccaaatgcacctgccacctctttatctacaatttcttcctcctggcttcttgggactctggacttcttcaccagagtgaggctccttctaccattaactctcattcagtccatagtcctattgtccactctggttttgtgtatatggcctgagaaacttgggttcattttgatagatgtcttttgattgtgtaaagttgatataactgataaaaacattgaggaaatttacccatgccatggcaagatggagtttcccaactggagacttccgtattgctactttgtaagtgatatgtatgatggtctgtttacaagtactctggaaatcttgtgcagtgtgagttattctgcaggaataacgtattctgccatgtgagatgaatcagctctctgagggtgacaggcacagaggaaaccatgtatgctctggtgcctcagatgaaatgattcaccttgcctgtgtgaggagttttatttccagggagtggtttctttaccatggtgcaggcatggatttttgtttttcctttcaaaaaatatcctttgacttttaaagcatgcatcttagtatttcctttggcagagagcgaaagtgtgacagcatcagaggataaaacaggacattatttttgcactgttttgaattacagaggccatggtacttgttagaaacggagggaggggcagcccaaagcatatttatgaagcacttaacatttactcagtgagatccatcccatggtctggaaactctgggaactaatgtatccaaaaaagagacaattttagctttcaaaaggctagttaatttactaaattcagtctgtgaccaatttctcttgagaagagtccagtgcagtgggccaaatctcgtgggcaataccgggagagcatgagattgtgaattcaactgagaaagttgtgtttggaaatggctcatatcaaacctggaaatgaaaagcttggaagtgtcacattaaagtggaccgaacaacgggactagacattcagaggcttgcatctcagttccacctcgatccctaatgggtctactgacatcagcaagccatcagtttccttacctgtaaaaatagacacaacattttccaaacgttgctgttgttgttgttttttcaaatgaaagcttttacctaagtctaatttataaagtagctaaagacagaaccattctcttggaaactgcaagctggagccagggctgtggccagtgatacttcattcttctcctctccatagccgtcatctcaccaccatgatgtgccaagcagagggcaacgtaaacattttggagagatggtagctgaggtctctgaagttctaatttttacacacagggaaccctgttttgcttgatgggacacccacagaagcgtcagtattaaaagaggaattagtacctgaagattttatgtgaaaaagtagcatgggttattttaatgcaacctctgaatgatgttgcaagagagttcgtaggacaatttgaaaatgagctttaagctcataataaactttgaaagctctgcctttcctatggccattttgatgcccctcctttttgtaagcacacagcagtttctagtctgctctgcacttttatatgtgttatctcacatgtgagcatctgaacaacctcactgcttcacgctgtcctgactgaaggcagtttgagaggagccttcagtatctttcaaagttttctttcttataaagaaaagggaagaaggttactatctgaagaaacgagacattccacttgccagtgtcaaccttgaacctgtagacaaatggtcttgacaaaatggtctcttcaccctagcttggtcccatgaatagaaggtcttgcatgtttatagagtgtccattttatgtgtatttaaggatgttaatggttctaaaccacatcctcctgttttctcttctttaattgcaagggctatgaggagaaaagggagataaggagagagactgacgtggggggagaaagtgcctctatgacagagatagagaatggaccagcttaaatcactatgaagcctgtctaaacagtttagaattttgaaagaaactgtggaaacattcagcagttatgtactcactctctgtatcctccccgcaaaaaatgtggtggtaatgttataaagacaggaatctatttaaaaatgagagaagagctgacaatgaaatatgaatgagaagtgcaaatttgagggaaatattacactgttaaaaaacccataacatgaagcttagggtgaggtatttatatttattactagatacagaaatttattttcttaccactctatttccttaaaaggaagtaaattcagccacatgacaactggtcccattcacgaatgacagttacttcatattttgatttctaactttttttttttactccctaaattacatttttagtgtttctttttgttctgctcctttgacctagcctggaaaatctgaagaacatttatttctttttctttttacttcagaaagcctgtacaattttcttttataaacttgaagtataaaaataataatattttaaaaacatatgggtaaaggacattttcatttgcaataagacaatatagtcataattaaaatccatagttcaaggaactttaacttttatccttttaaaaaaattaagtggccaggcacagtggctcatggctgtaaatctcagcacttttgagaggctgaggcattttaggattgcttgagcccaggagttcaagagcagcccaagcaacatagcaagatgctgactccactaaaaaaaaaaaaaaaaaaaattagccaggtgtggtggcatgcacctgtagtcccagctactggggaggctgaggagggaggatcacttgagcccaggagttggagcttacagtgagctgtgactgtgccactgcaatcaagcctgcatgacagagcagattttgtctcaaatacaaataaataaataaataataatcaagtggtttataataattagaaattttctatcatttatcatatatagaaggacttgtaaatttacagactgtatattttatggcctagactcaggcatccaatgttcattgacaagaaatgcagttcctgacaagggcattgctagtctagagctaacagagcatgcagccaatgtacccaatgtttggggatctactctagaggtgtagagagttgatgcagcttccgaaagctgttttgttctccatctattgcctgtgtactgcaataatctcttgctcatgtgctaatgttaaatgttttgttatttaatgtgtcctttaaaaattgataaaagcaaatctcactaaatatttatatggcagctaatacatatagcacaaagaaacttcagtattctatctgttctggtgttttaatcccaaagcaattcagagataagttttggcagctaaggaaaatcatataccgattacaggaacctggtatagtgcaaatgagcactagaagtctattcctcaaccctgtgtaacaatatattggtgatgttttatacagaatttaaaataaaatagcttttccaagataatttttgtgttatagccacaaactgatctttttttaaaacagtatttcaagccagttcctctttaaagtgatctttattttccaatatgaagtgttccatagcccagagagctaactcttattaaatgcttactgtgtgtcagacactgctcttggcttgttatgtattttatctcatttaattttacaatggccttacgaggcagggatttttattactggcatttaactaacttgctgaaggtcacacagatagagatgggtgaggataagatttgaaccccggcagtctgacttcagaaccactatagtaagtcattacatggtacttcacagattaagaccagagctagataatctctttaggcatgacacagaaaaagattacacaactatgattgaaatatttacttcatctcaaactctgtttcctccatcttaaattattaaggcttaataatgaaaggaaacaaattatgtatatgatatggtttggccgtgtccccacccaaatctcatttgaattgtagctctcataatccccatgtgtcatgggaaggacgcggtggcaggtaattgaatcatggggatggtttttttcccacgctgtcctcatgacagtgaataaatctgacgagatctgatggttttataaagggcagttcccctgcacatgcactcttgcctgccacaatgtaagacatgcctttgctcctcctttaccttctgccatgattgtgaggcctccccagccctgtggaactgtgagtccattaaacctctttttctttataaattacccagtctcaggtacttctttatagcagcataaaaatggactaatacagtatgactttctgtaacaaagaatcatcatctgggaagcaatattgatatctataaaaactacttaagctttccagattactacaatgactatgtttttctgaaactggagttttctagagtggatggaacttgttcgtcaccaaggttaccactctagtacagccctctttaccttcttttggccacaatgatacaacattttgtcatatcaaaaaagaaacctcaatatatgttgggaaactgtagagataatacacagagagatgactccaacatatgggcctttctctaggttctgaattagtctggggagacccagaagaccactgctgggctagaagatccacttgtaaactgtatgttaaaagaccccaaaatgtatggttcaaaggaaagttccatgaagtctagcatccccttgaggaatctcatctgcataaatgttaggcactttacgaatccggaactcgagcaggttctctgagctccctggatcatggatgttcagcactagatggcaccttgggaattagcttgtctaactcttcatcattttgccaatgaggaaatcaaaggacaaagagattatgagtttgcatgatgtcccagagcctgccagtgataacaccacaatgggaagcaggttctctggctctaatttcaggatttttcaatgaactgagttggacttcattccaagcacagccactgaccttttagataggtagttgtgagtcaatgactcttctctctgtccttattggcaggaattctgggcagaggttgttaccctgacttacagttatctggtcatacagctgaatgctcaacaccctatcaagtagcagcagagaactaaaaaaaaaaaaaaacacatgcaatactacatgcaatattactagatgttattttaatgttcttgcctgtaacattggagaatattgcttattgataaatacaaatgtaactaaaatcttatttttacccatatctttaagaagcatggatggagaaaaacatgatataaaacacctcttcattttttttaccttattatcaatttaaatgtagattttggggaaatattatatattttgtttgtgaaagtatttgcattaaaccaatgatagtcttcaataagtcctacttgcaaagaaagaacaaaaaaagacatgttgagcagtttctacagttctgagatttggcatgcatgttcacactagtgcctgccaagcctgggtgtggcatcctacaggtaacatgacataccaggagcagctgcaacaacagcaccaacaaaagcaacaggtgttgttgggcctctggtttccaggagcttgagacacggcaggtgttccttcattttgggactgctgcctttttcgcatttcagctacttcaggacccagttggctgaaagagataaaacaaaaaattgggtatgaaaaaagcaataaggataagttgcgtatgctgaaggaaggctcatttcactaaggaaggagggaggtaatttaagaaaaggtaaaataaggaaacttgagaggccaaactaaaaattctcaggaaaactttttagaaggatatactaaaaactttggggaggaacgtctacctttatctgctgcataaaattatagcaacaaagttgccacgtaatcaagattgttggtaaagtaaatatgataaggtttgaaaatttatttttaacttccttctttactcaagaatgattaaatctgccttttttatggacaccattcggtgattatagagggtgtatgtaactcgtttttccactaatgtttacagtaaggtaaattgagctttataaatgattgttgcatggtttctaactatataagagtatgaggaagatcaagtttattcttggcgccctctcacttcctttgaaacacaatatcctttttggcacttttgactcatcctccagaggcctaaccttaataacattaccaaaaggccttattttctgttaggtgtcagtgttgcaaaggcattagcttctcttcttccatcccccaaatttatctttatttaacggagagttgggggaaaataaaagtcatcaaattcaggggaattactctggtggaatttatatatcatggcagataaaataaatattgggatacagaatgtcctatctgtgatcttacaaataaggccaaatgagttgctacctatttataggaccaatcctgatctaagactgtactgaggattaaaataaaaagttttgtctttgagtaatatcaaatttagcatgaactcttagaaaaagtaatgcaatctactgaatgatgtttttcataaataggcaatgtatgtaaatcatacacatatattgtcaaatgtgtggctgagagcagtacttattaaaactataaagtgcttcaggttattttggcattatgagctattattttaaaatgatattttcagttctgaatacaatgataaacactttaaaaaatactgcattcttgaaaaccagataaacatatttttcgaccagaaacagagcagaaaaccacagttgtaggtgaatggggtctaaagccacagtaattctgcaattcagatattgaaacagaagcgggcaaaggtccacactccagtgaggtgttagatgctcccctaggaggagtgggagtctgattccaggttgcctgcaaaaaatcaggggctgtgattgtgcccttcataaaaaggtactgaaaaaataatttctactattcagtaatgcctagctgcagaaagggtaggatgcagagaaagccatccagatcagacttcagccaatcagcttatttgttcagtgactgggtcagggaattttccaaaatcactggcagatggcagggaatcctgagatactgataaaagagctgcttcaagactaagggtcttaagggattagtggaaacaaatgaaaagcattacattatgaagagtaagtgacagtaagaaatacatctctcactcaatgtgttacctgaaagcaaaaatccatattaacaccagaaaacagacaaccaactcaacaattaggagattaatatattcctgatcaaatgctaataacagaatcacctaaaattagtttaacaaacatatatttaagataaacaatgtgataaatgaaagaatacaatttaaatgggagaacaataaattataaaacttatctgacttccccttttccaatttggatgccttttggatacgtgcacctccatgttgactgcagcactattcacaatagccaagatatggaatcaaccaaggtgtccaaaaccagattaatgaataaagaaaatgcggtatatatacatcatggaatactaatttagccattaaaaataatgaaaccctgtcattcacagcaacatggatggaactggaagatattatattaagtgaaataagcaaggaacagaagttaaataccacatattctcactcatatgtagaagtttaaaaaacattgatttcatagaagtaaaaagaaggacatagcataccagaggctgggaagggtaggagtaagggagggatatggatacattttttaagggatataaaatggcagctagataggaggaataagttatagtgttccacatcgctgtaggatgactaaagttaacaataatatatagttttaaatagctggaaggaggatattgaaaattcccaacacagagtaatgataaatgtttaagacgatgaatatggtaatgatcctttattaccatagagtgataagtgaccttatcactctacattttatgtactggaacaacattatgtaccccatgaatatgtacaattattatttgtcaattaaaaataaataataaaataaaataaattataaaacaaaaattggcaaatatgaaataagaaaagacataacgggaatgtaaaaacaaacacaaatagctattaaaagatttacacataatcatttctttcccaaacaatcccgaagatggtgccaaggaatatactcagaattcagcaaagagtgaagaaaagctacaacatgaaaagagaattgagataagcagaccagtaacattgaaaggccccaatatatacccaacaagattttcttcataaggggaaaaataatggattgtcaggaaagtcataatattttaaggaaaattggccaagaactccctagaactggaagaaaacaaaacagaacaaagcctcacataaaggagtataccacatgctgagtaggatgaataaaaataaaaagaaatctacacttataaacaaaatagtaaaaacacatctagatgataaagacaaaagctgaattacccacacacaagtaatgctttgattgacagtggactttccatgagcaatattagatgctgaagatggtgggcaatggagttatgtgttccaagtgctgagggataataatcatcctacaattttatatgcacctaagtaaaaattcaagagtgaagattatttctgataaactcactgagttgattactcaaatatttgctggaacctacttcagtcagaagaaaacaaaattagagggaaggggtagaatataagaaacagaactgaaattggtaaaataggatgctgaacttaatgacctggctaaaataaaagtctatgtttctctgtttagatacactcaagaattaaatttaagactacatcaattacgaaaatgggtgggctgccctaaccctctaatgaaacagattttgtagacatctcaatgtccgcatattattaagtccaagagttattttgccatctccttctgggccaacagcattttacactacaatggacagaatttgcccttgcaaaatatatttgttgaagtccaaaccccaattgtgatggtaataaaagctggggcctttgggaggtaattagctcatgatagctgagctctcatgaatgggattagtgcccttataagaagaggccagggaactggattgcttttccccaccatgtgaggatacagaatgacaatcttctacaaccaggaagcaggccctcaccagacaccaaataggccaccatcttgatcttatacttcccagccaacaaaactgtgaaaaacaaatttacgttgtttttaagctacccaactatgatactttgtctacagtagtccaaactgactattttaactccaccctctttgaaatactttcttctcttgcctcctgggcaccatactcacctgtctgctttctcatcacttctttgcagtctactttcttgtttccttttcatcttcctcgctttcaaattttgaatggccacagtgttctgtctttcttctctatcacttctttgatgaactcattgagacttttttgggtctaccagctttctgcacaaaatcctcaaatttacatgcccagtgaagataattttcctgaattcaggatgcaaatatccaactacctactcaatatcttcacttggctttctcaaacttaacatgctctaatctgccctcattatcttttcccaaaaacatgttcttcccacagtttctccaattttactgaatgaaaagcctcatccttctcatttttcacaccaaaaaatcctggactcatccttgattcctctatttcatctggatgtcacatcagcagatcagcaaatgtgagacttcttaactggtatctgctacccatcttctgtttctaccacctcctatctccttctattacaattccattttattctattctcaagacagcagccaggatgagcctttcaaacctaagtcagataatttcagcaaagactcttccattcaaatccaatccaaaacttccagtggcttaccatcttattcagagtgaagttcttacagtctgcttttttgttactcccctgaatgtatctccttttctctgcctcttgttgtctgtttcaatcacaatggcctccttgctgctcctcagccatgctcggtacaattacgtgtcaagacctttgcacttgtttcacacttagggtttcactccttcaagtatttactgaaatgttacattctccttgaagccttcatgaccatcttatttaaaaatgaactccctcacctcatccccagtatgagctgttaccctttcctgtttaacttgtctccatataatgtatcatcactagtcatactacaagttttacctgtttgtttgtctaaccaaggagccaataaatttcatgaaggtaggcacttttgtctgttttgttcattgttgtaacaatgcttggcacatactaggtacacaaatatttgtagaatggtgaattttacagcattcctattaacgataagaagaaaacaataaagtctatatacccaacattcaaaattattaattttgcagccaatgcaacaaaattagaaaaaataaataaaaattggaaaagaaaatacaaactttactatttacaaatgatatggttatcaacataaaacttccaagagattcggcagataagttattagaggcagttcaagagggatgccagtttaagctttaaaatatcatatacttctaatacactagtaataatgaatttgaatatataagaaaaataaaggcatagttcaatagcaaaaccaaaacagtaactggtaatatttataacaaaaattgtataagaactctatagaaatattacgaaactttatcaaaaaacataaaataagacctgaatacagagttgggttatcttctcaagtgggaagaccaaaatcttaattgtcctaaattattttataaattcaaggccgggcatggtggctcacacctgtaatcccagcactttgggaggccgaggcgggtggatcacgaggtcaggagatcgagaccatcctggctaacatggtgaaaccccgtctctactaaaaatacaaaaaattagccaggtgtggtggcgggcgactgtagtcccaactacttgggaggctgaggcaggagaatggcatgaacctgggaggaggagcttgcagtgagccgagatcgcaccactgcactccagcctgggcaacagagtgagactccttctcaaaataaataaataaataaataaataaattcaatgtgatcacagtaaaaattctaattcaatcattcatggaacttaacaaatgaattctaaaacttacatggaagactgaagacatgtctgaaaataaaaataagtgggggtgtttgttctatcaataatatagaagtcataataattaggcaatggcatgggaacagatatgtagatcaaaataataaaactctcagagagctgagtaaccttcaggcatttatgcagtcctggcttaaattagagtatgcaactttatcattcaagaatgacagactactcaaaaatggtgttgagatatttgcacttacatataaaaaattacacctccaagtgataatacatgcaaaaataaactcaaaacatgaatacaaaaatagatgttacaaattctaaaactgtcataaaaacgtagactatagcttcagagcagaaaaggatttcttactataagatcaagctcaaaaggaaaagcttttttttatatagtttaatttattaaaaagttttgagcaaataaggaaacaataaaatagaaacaagaaaaatagagaatcatactggaagatacaaaggaatattatccgtaataataagtaacacattgcaatttaacaacataaaaacctaatagaaaaattggcaaacaaatttgcaggcgggtcataaaagaggaaaatataaatactccaaattaaatgaatagatgctcagaactattaatcagagaaatgtggataaaaaagtattccacattcaaattttccactgttaaaaagtcatacaatatcaattttggaagagtacttgggtaaattaaaaactcctcacactaatggtaggaatatacattgagaaatcactttgaagaacaatattgactacatgtagttcacaatacacataacctatgacaaattccatttttatgtttatacactggagaaactcaaacctttatttgaagacactaattacagtatatttaacaccttaaattggaaacaacctgttatggactgaatgtttatgtccccctcaaattcatatgttgaaatgtaatcccaaatgtaatgatatttggagatggggccaaatataatgatatttggaggtggggcctttcagaggtaattaggtcacaagagcagagccttcatgaatgggattagtgctcttataggaagaggacagagagttggttcttcttctctccatgtgaggacacggaaagaagatagtcatctacaaccaggcagcaggccctcaccagacaccaaataggcaatcaccttgatcttgaactttccagcccccagaactgtgagaaataaatgtctgttattgataagccaccctacatatggtattttattatagcagcccaaactaagagagaaattggtactgagaagtggagtgctgctataacaaatacctaaatatgtgaaagcagctttggaactaaccaagagttgtgaagtacatctagaagaagccaagattgtcatgaagggacttttaaaggtgatttggttagggctcagaaagggaagagaagagctgtagagaaagcttccatcttcttaaagaatacatatgtaatcatggactgaatgttagtagaaatatggatagtaaaggccattttgatgaattctcagactgaagtaaaaacatgttattatcttcattaacactaaatttcactgtccttttctccatcttgtgcaatggagaacaggcaatccttgttattaagcggccaacaacttgggtgaattgtgttcatattattagtgttttgtggaagttgggacttgtgagcaatgaagttggctatttagctgaggatatttctcagctaagtactgaaggcacggctttgttcctcctgactgtttagtaaaatgtgagaagagagaaatgatgtgaagagggacttatcaaacaacaagaaactagaacttatgagcttggaaaattctcagccaatccatattgcacaaaatgagaaagcatgtttaaaagagaacactaagagtattaccaagccaccatttgataaggagattagtatggtgtgaagcatggactgaattagctacctcagcaggaaaactgccagtttgaactgaatgggaaggaatgaagaaatgttgtcagattttttggattttacagggaagaccataaaacttttcagctgcaaacatgatctattcttaaagacaagggaagaatgactacaaaaaaatgattcagagatcatcagggcttcatcctatgttgcaaagggtggaggaagaattgcctgattttcaacaagttagattacctccaatcaaaggcatgggggtaggactgggaggagctgtggaggtttggtgcctgcccagcagaaccctgggattgagatcccaatttggcagaggtgcagagcaatatctcaactctactgggtctggaaaatgggacctctgcccccagtgggcctggagtgcacagcatcaagcaccagaggattattctccagccctgagatatggagtttgacttgctaggttctggacttacttaaaagctatcactcttttcttctttcctattcctttgcttctgaaatggggatatctattctacatctgtcccactactgtagtttggaagcacataacttattaggttggtgcaaaagtaattgtggttttttgccattaaaagtagcaaaaatcgcaattacttttgcaccaacctaatatttggttttacatgttcatagctggagaggagttctgtctctgaatgaatgataccttaagaatcactcatatctgatttagatgatagttagataagactttggacttcagacttgagaaccaatgctagaacaagttaagacttttgaggctactgggatggaaataatgtattctgcatgtgaagacatgaattgtggagggccaggagcagaatgttaaatactgaatgtgtgtgtcctcctcaaacacatatgttgaaatctaatctcagggtgatattaagaggtggggcctatggacggggtcattagacaatgacggtggaggcctcatgaatgagattagtgcccttaaaaaagggacccccagattactctcctgctctctttccatcctgtggggataaaacgagatatcagtagtctgcagcctaaaagagggccctcaccagaacccaaccatactggcaccttgatctcagacttcaactttcagagaaatactgtgagaaataaatttctgttgttaagttatccagcttatggcattttgttatagcagcctgagctaagacacaaccaatattctcatttttccaggaatgaattttaaaatggtgatattgttatatgttaatatataaaacagctcttaaaatgagtaacttagatctatatgaatcaacttgaggcaatcacaaaacaatgttgaataaaaaagctgcaaaatattaaatacagtatcaacataattttcataagcatacaaaacaaacaataatacatatcttttctggagaatatgtgtaacatacgcagttacagagcatggactggatccattactgggtgttcgggaagataacgatcaggctgtgattgcaaaagaaagaatttcaactttaatcatttctttaaaaaagatctgaagaaaaagcaaaatatttacagttacatgaatttggtattgaggcagagcacggtggctcatatctgtaattccagccctttgggaggaccacttgaggccaagagtttgagaccagcctggtaacacagtgagcctccatctttacagaaaataaaaaatttaaccaggcatggtggcatacatatgtagtcctaggtacttgctacttgggaagctgaggtaggaggattgcttcaacccaggtgttcgaggctgcagtgacctaggatcgcaccatgtactctagcctgggtgacaaagcaagagcctgtctcaaaaaagaaaagaaaaaagaaaaagaaagaaagaaaaatagagttttgggtatgggagtatttattttattatgttttatacttatctatattttctttttcacatacatacatacacacattatatatatatgtatatatatgtatatataatatatatacatatatattatatacatatatatgtatatatgtatataatatatatacatatatacgtatatatgtatataatatatatacatatatatgtatatatgtatataatatatatacatatatatatacacacaatattttttatatatatatatatatatatgtgtatatatatatatatacagctttataccaggcaggaatttcttatttatatcctgaaaatttgcagaaagactcaaaaactttcttgagaattgaataccttaattttctcactgttaaatactcaatattgaaacattcagaggtaaatgtcatcttggatatccatttattcacaaaatctctgagattgttgtggtttgaaatcactgtagaggggttcaaatattagttgttagatttgcaagaccgaggcagggcatggtggctcatgcctgaaatcccgcactttgggaggttgagatgagcagatcacttcaggtcaggagttcaagaccagcctgaccatacatggtgaaaccccatctctactaaaaatacaaaaattagccaggcatggtggcgggagcctgtgaccccagctacttgggaggctgaggcaggagaactgcttgaacacagagggtggaggttgcagtgagccgagatcgcgccactgcactccagcctgggcaacagtgcatgacttcatctcaaataaataaataaataaataaataaataaataaataaataaaaagatttgcatgactttcactctcttctatgtctttcaaccggcttaaaaaaaacatcataggcaaacgctttatttgcgctcttctgaagtaattgtgtatgttgtcccataatcatcttccttctggaaagaaattcctactcattgatttcctttgtgtagttcccataccatttggaacagatcactcctatttttctgactgatagagaattctctaagtccctgaataccagcagttcagcatcttatctgtgtttccagtctaaacttctggaccgcccagcaagcaatgaggtataatattttgctacatagctggggcgtctgaataattagacacacagagcaggcggaagatgcactatctcaaagagctgcttagtgacagtgcctaggaaggtccttcccaaatccctgaacgtggtaagtaagcacggaaaattgctgcatgccctcaggtgatcacatcctggaacccctatttgcttctacttcctgtgcaccactgcaaactggtgctgaggggattggtgtgggtttatcagtaaatacagaagggaaaaatctgtctgctgttttttttcccttgagttcaccaattctaattttttaagccaaacacattttcttaatgttataagttaaaaaatgaaaagttatgtaaaatgaagcataactatggactgaaactctcaaatatttttgaatatgtggaggtcaattcttttttgtcatccctacctccctatagaggaagagtgtcaaaaacccatttgacttcacatggtggagaagaacaaggcaggagaaactggtctctcctttgcaaagaaggacatacctgtgcacaaaactgggacttcagatttttttttgagctgagcaaggatggaaagtgttttacagctggcatcctacctgtaaaaacacttcatctagtccttacggtgaggtgcagggaaagttggtatggaagaaatactaacggacccaagcataatggttttcccctcaaagcttaggcaaatttattaataaggaacacacataaatcaggtgtactaatcagagaaggtttttcattgtcgtgcattagttatatcttccaagaaatgaggggaaattctgctctaacttctagctgtccacagttttactctgttacttctttcccttccccagggtcaggtgcaatgatcaaaaccatctcacaggttgaacaatgggccaaataaaacaaaatacaatgtaaaaaggataaatgtaaggatatgaacttgggtctaaaaacactgttaaggctaggatgggagaaacatggtttaacaggaacatatgaaaaattcgggacagtaaattcagcattaaccaacagtatgatgttaaaatagtcaatggcaatttagaatgcattaacagaaatacgttttctaaaacaagatgtaatagatattctctgggctggttaaacagttatgttcaattctgctcactacaatttaagaaataaattgaaatatgttcagaagactaaaaggaggagagttaacaaaaactcatgagcgtctcataagaacactacttttagaacaaaggtgtttcctctgaagaagagaaagataatcagaatcataattttctaatcactgagatcagtgacgccatgcacaggataagaggatatgcattcacttgtaagatcccaaaggttagaacatggattaacgaatagaagcaatagaaagactctttattccatatatggaaagtctgactgatactcagataagatcttaattcacctgtaagaagagcctcaagccaagcattcttgagtatttaagttactggtgaacaagtccttgaaagaggttgatttaaaggggcctcaagtttacatagatgattagacagaaaatctctcttggttctgaggttactattcctgaaatgggctgcctaacctaactgctgtcttcaaaatacagctgggagtgagatgatgaatccctatttctatcaatttgtacattcctatagattatattgtcaatctttgtgcactgactaatattattcttcatccttttgtttagatattgttttccaataggattgaaaaactcttaagaggaagggctgtgtgtgtgtgtgtgtgtgtgtgtgtgtgtgtgtgtgtgtgtgttttcctggaatcctagtgttctctattgtagatgcaaaataagtattaattattgaggatgatgaatatgacagatttctctgattattaaaaatatctattttcccaaggcagagatttggaagtttcacatacaattcttacagccctaaagcacagtgtcaagtctgaatggtgctcctcatcctttcccaaagtatccctcacagaggaagggaaaaattaagtctgaatgacctgctgcaatgtaaactcttatattttattttaaaatccacataacatctgggtattttgatatatattatatataaatataaaaataaaagcttcatattcttaacttgggaagaaaaagaatgctcctccatctttcttaatggtcaagatgccgttgcagtaagatcaattttggaaaattaggctgaattggaaaagaaatgagtctacacatcagaattagctctcatctcactcttgaagtcaccaaatttttaggacttaaacttacaaatataaacagggcagtctctcgtatcaccactcccaagctgtattacaatatggtgagtaaacaagctctagagtcaggctgcctctgtacaaatcttgcctctgttatcaactggatgacctttggttagttactccagcggtccccaacttttctggcaccagggaccagtttcatggaagacaatttttccacggatgggtgtgggggatggttttgggatgattcaagcacattacatttattgtgctctttatttctattattattacattgtaatatataatgaaataattatgcaactcaccataatgtagagtcagtgggagctttcagcttgttttcctgcaactagacactcccatctgggggtgttgggacacgacaacagatcatcaggcattacattctcataaagagtgtgcaacctagatccctcacatgtgcagttcacaacaggattcatgctcctatgggaatttaaagccactgctgatttgacgggaggcagagctcaggtagtaaagctcgctggcctgctgctcacctcctactatgtatcccagttcctaacaggccacagaccaatacctgtccatggaccaggggttggggacccctgactttacctattcttatccttgtttcctcattggcagataataattgataataatagaacacataagtacatccattctgctataagggctgaatgaatttgacacataaatacttggaacaaatctttgcaattacagtaagtgcgcagtatgtggtagctctttcaaggtaacactgaggagagttgttcataatgttgccaaaaagttagtgtggttcagtgttttagtgctacagatgttgaaggttttcatcattatcttcctgctgagagatcatttcacttatatggtgggatgtaaagtttttgtatccattggctgggatcttcctatctcagggttctacacaaaggcttagtcagtgaggaagaaagactaatggtttggtttattatttcaccattgacactgtactttttatcacatgtaaatgaactgagtctaaagtgactcatagtacccacaatcaactcgttatccaacaatcaaacttcattataaccgtcgctgtcttgtcatggttgttgaaagcatccggttttaccatgtagttgttgattcagtgtggggccccacaaagttatctgctaaataagccaaatttgtgaagcccacttcagcactggggtggacaaggaagcaattcaccaagtacagatagttattcttagttgtgacgaatttttcctgtgaggaaaagcaactcacttctcaatttaaaatttctgataactaccctgcttcagctaagccagcatatatctatgcaactgagcaagctttcaatgtcacttcttagttcatgacccatttacctaaaaagagttgtcctggagtaatactactactcctggaagggtatactcgttagcgcattttttttttttcaaaatcgccatttttatgattatattaaaatgatcagaaattcaagaaataaattctttgtgcattcagagtgaataattactaagaatatggttctggtccttactctgggtggtcacagtctggctccatcagtgaatatacccatgtaatttcttttcctacttgatatacagtcttcactgaaatgtcacttgatggtgagtcagcaattctctcttcatgttcataacatttatatatacttagttacagataaatatataaaaagactataaaatagttgctccggtgctttcccctattaaagtactgaatcagattagcaccagctgcctccttgttttggctcatgtatatctattggtcgcatttaaaagcattattcgacagagctgtttgacagaggcaccttgtgtagctcagctgctagttttcatccccagaaggttaagccatttctatgctaaaggtcatcacatttttcactcttattattctgcacttctatcaactttctatttgcttcttttgactatgccctttagggggtactggctctggagtaagagagatctggaattgaatcacaaagttctgccttgtactggctgtgtggcattgaattagtcacttaacctctgcctttgtttgcaaaataggaaaatatttacttcactcagtaattgtaaggaataaaagaaaccctatttattgctagtttttactaacaactgtaacaaggagccaagtgaaaagcacttgataatttgtaatcccaactgtaacaattgttcctaatgttattattactcctggaccaacttctgtttccatatttacaataaaaagctgatgatatttcttcagaatttcataatgggtttttaaatatcaatgcaagggtgatagatgtatttggtaattaccaaataacaattttaacataagtcaaaatttgggtctttgctattcaaaatgtagttcctggaccagcaggtggcattccaccatctgggaggttgttagaaatgaggatctcaagccccacttgaggcttcctgtgtctcaatctgcatgttaacagtatcaaccaatacagagttacaggtcaggtctcaggtcactgagacctaggaagcactggctcaggccacactgagttgtgaccctgaaggtctcacctactaggcattgtgattggtgtgcaggggaagtctgtttcccagagtcagaaggacacggagtgtcctagtgaagccccaagtgagagaaaagattaagggcttgttgaacttctattctgtgtttcaccctctctttctgctctttgggcagaaataggccctctcagtgttcacacatagtactgtgcacctgccactttgagttgtatttatgtacaagctggcttctctcactggactcggacatcctaaacagtctcaccctttttggtctcaccagcacctggcagaggcacttcccccagaaaatctttgcagaccctcctggcctttgggaaggtgcccagcactgctccatcttctttggcctgtaattccctgctgacttagagttttgccatttgtaggtttttcctacaaggctctgagctctttgagggcagaggctgggtcattcatcttagtactcttggtacacaagaaaaaataattataagtttcaattaagttccaacgaagcactgatattttgtgagctggagccattgttctattttgctcagagaggaaaaaaataatctaatcaggagaaatgtctctactaaggtttatcgcacttttttttttttcttaaaatgtcggtgcctactaatgtttgtgtattttggaattccaaatacacaataaatctatcacaataaatctatcttgcagtgatatttaaaaacccattatgaaattctgaacccagtatttcatctagaacaaccatttaaaaattattttgatgctagtattttgagaatgccatgtgataagaagcatcatgaataaccttgagaaccagtgagttcagtaaatgtatgttaaatgagtgaaaaaaggagaatgagaaggcatctttctagtgtaggtgagcacttaggttctctaacagaggccagatatgtacagttaaaatgaagtggaaagtcattcaattgcttagaaattttagaaagactggaagacaaatatggacaaagtaatgcttttaaaaatccaatttttacctgacttattcaggctttgttttattttagaacagcagcattagcttggggtgaacatcttaatggggacaaaaatgcattacagttagagcagcttttgtcagaaatactgcatggtgacaacaagaacctttagaatggccctattacattcactgtgccattctaaaataaaaactctctgtttaatatagagtcataatgtgtttacttaggaaaatactgacagcactttcatctatgtgacatgttcattttgagattcataaaactgtttttcagagagcagacatgctcaatatttcaatacacgtaaagaagataaggttaaaataaggaaagaagaaaaaccacttaaaatgtgaaaaaatatgcaaaacaaaaacaataacatttgaaaaagggtattccagagactgtttcccctaatagttattattcatataatgatttaagatacttatacaaacagggataacagctgtggaaattcaatacaagacaatgtttaaatatcttaaatgggaatgaagagattaatactatgtggaaatatccccagaaggagttaaaacacatgaaatgtatcccatttatgtttgtgtttaatgtaacatacctatatgttattttttttacaactaaaacaatgtaggttacctgtgattctctcttttgtacttcataatacctgtatattgaagaacagctttacttggccatctctccagatattaagcatatgagagcaaacattatgctttccaaagctacattctgtatattctgtcttaaacctagctgatatctatacgaaagatagaatcaaataatcagttaaccttttcaaaaaatctgtgttctactcaaggtaaaaatttgttggagagtgaataaagatggcattgagaaggtggagcaagatggcagatccccgtgcctcccgcccaccccacccttcacaaggacaccaattaacaactatctacacaagaagagcacgtcataagaactaaaaatcaggtgcatactcacaatacctggttttaatatcatgtcactgaaagaggtactgaagaggtagagagaaacagacttgaaccaccatgtaaactgccacctctcctccctacccccagcagtggccaggtgtgaagagcatctctaggctctaagggagggacaacacaacaattgtaaggctttgaactcagtggtgtactgttagagaagaagggaaaactggaccaaattcagctgatgccctcccacagagggtgtgtttatattagccctagctggaggggaatcactactcccagaggctggaacttgagttccctcaaaccttgccactgtgggctaaagtaccctagggccctaatgaacttgaaaggcagtctaagctacaaggactacaacttttacaggagtcctagtgctgaattgggtgcagagatagtagactcaggggcacgtgacctatcaagacaccagccagggtggctaccagctactggaatgctgttattcccctcttctaaccacaggctgcacagcttgtggttccaaaatagataccttctttccacttgaggagaggagagggaagagtggggaagactttgtcttgcatcttggataccagctcagccaaacaggatatggcactaatcggagtcatgaggtgctcttttaaggccctagcttctgtatgacattgctagacacaccctgggccagaagggaacatgctgccttgaagggaagcacccagtcctggcaggattcatcacctgctaactaaagagcccaggaccatcaaggcagtacctgtacaagtctgcaagaaccacagcattactgggctcggggtgccccctaaagcagacacagctaacatcacaacacccaagtcctatctgcaaagttatcctgagaaggatgggtacaaaggagcccaggcagtgacgactacaataaatacttaactctttaatgcccagacacagacaaacatctacaactatcaagacactgttgatagttgtaggaaaaaaaggacctcaccaaatgaactaaataagccaccaaggattaatcttgaagaaacagagatatatgacctttcggacagagaattcaaaatatcagttttgaggaaacccaaagaaattcaagagaacacagagaaggaattcagaattctatcagataaatttaacaaagataatgaaataattaaaaagaatcaagcagacattctggagctgaaaaatgcaattggcataatgaagaatgcatctgagtctcaaaagcagaattgatcaagctgaagaaagaattaatgaacttgaagacaggctgtttggaaatatgcagtcagaggagaaaaaagaaaaaagaataaaaaacaatgaagcatgcctacaggatctagaaaatagactcaacagggcaaatctaagagttgttggccttagagagaaggtagagaaagagaagggtagaaagtttattcaaagggataacagagaacttcccaaacctagagaaagatatcaatatccaattacaagaaggttatagaaggttacagaataccaagtagatttaacccaaagaagattatcgcaagggatttaataaataaattcccaaaggtcaaggatgaagaaaggatcctaaaagcagcaagagaaaagaaacaacatacaatggacttccaatatatctggtagcagacttttcagtggaaatgttacaggccaggagagagtggcataacatatgtaaagtgctgaaggaaaaaaaaacttttaccctagaataataaatatgacaaaaatatccttcaaacatgaaggagaaataaagactttcccaaacaaacaaaagctgaaggatttcatcaacactagacctatcttacaagaaatgctaacagagtacttcaatcagaaagaaaaggaagttaataagtaataagtaatcacctgaaggtacaaaactcactgaaagtacacagaaaaacacagagtactataacattgtaactgtggtatgtaaactactcttattctaagcagaaagactaaactatgaaccagtcaaaaataataacttcaacaacttttcaagacatagacagtacaataagatataaatagaaacaaaaagttaaaaagtggggggatgggcaaggcacggtggctcatgcctgtaatcccagcactttgggaggctgaggcaggtggatcatgaggtgaggagattgagaccatcctggctaacatggtgaaaccccgtctctactaaaaatacaaaaaattagccgggtgtggtggcggacgcctgtagtcccagctactcggcaggctgaggcaggagaatagtgtgaactcaggaggcagagcttgcagtgagctgagatcctgccactacagtccagcctggtcaacagagcaagactacatctcaaaaaaaaaaaactgggaggatgaagttaaggcctagagtgttcattaattttcattttgcttctttatttgtttatgcaaacagtgttaagttgttatcagtttaaaattaaggataataatatagtatttgcaagcctcatggtaacctcaaaccaaaatacatacaatgaatgcacaaaaaatacaaaaaacaagaaactaaatcatgtcaccagagaaaatcaccttcactaaaagaagacaagaaggaaagaaagaagaaagagaagaccacagtacaaccagaaaacaacaaaatggcaagagtaaatccttacttatcaataataacatcgaatgtaaagggactaaactctccaatcaaaacatacagagtgcctgaatggataaaaacataagaccccttgatctgttgcctataagaaacagacttctataaagacacacatagacttaaaataaagggatggaataaggtattccatgccaacagaaatcaaaaaagagcaggagtagctacacttatatcagtcaaaatgaatctcaatacaaaaactgtaagaagagacaaggtcactatataatgataaagagggtaattcaacaagaggatataacaattttaaatatatgtgcatccaaccagaaataaataaaacaaccagatatatacagcaaatatgattagatctaaagaaacaggccccagtacagtaatggctagagacttcaacactccactttcagcattggataagtcttccagacagaaagtcaataatcatcagacttaatctgcactatagaccaaacagacttaacagatatttacagaacatttcacacatactcttttcctcagcacatggatcattctcaaggatagatcacatgttaggtcataaaacaagtcttaaaacattaaaaaactgaaataatatcaaccatcttttctgatctcaatgaaataaaactagaaatcaataacaagaggaattttggaaactatgaaaatatatggaaatcaaacaacatgctcctgaatgaccagtgggtcaatgaagaaattaagaaggaaattgagaaatttctcaaaacaagtggttataataacacaaaacaccaaaacctataggatacagtaaaagcagtactaagagtgaactttatagatgtaagtgcctacatcaacaaagaagaaaaacttcaaatgaataacctaatgatgcatcttcaagaactagaaaagcaagataataccaaacctcaaattagtagaagaaaagaaataataaagatcagagagaaataaatgaatttgaaatgaggaaaacaataaaaaaagatcactgaaacaaaaatttggtttcttgaaaagttaaacaaaataggaaaacctttagctagactaagaaaaaaagagagaagatccaaataaacaaagtcaaaaatgaaaaaggagacattacagctgatgccgcaaacattcaaaggatcattagaggctactatgagtaaccgtgtactgataaattggaaaatctagaagaaacggacaaattcttagacacatacaacctaccacgattgaaccagaaagaaatccaaaatcagaacagatgaggagaaaagggggaaccattgtacactgttggtgggaacataagattataagaatgtaagttggtgggaacaataacaagtaacaagatcaaagtcataataaaaagtctccctgtaaaaaaaagcctgggacctgatggcttcactactgaattccatcaaacatttaaagaagaaccaataacaatcctactcaaactattctgaaaaatagaggaggagggaatacttccattccatgaggccagtattatcttgataccaaaaccagacaaagacacatcaaaaaaagaaaactacaggtcaatatatctgatgactattgatgcaaaagtcctcaacaaaatactagcaaaccaaattcaacaatacattaaaaagatcattcatcatgacccagtaggatttatccctagaatgcaaaaattaattcaatatatgcaaatcgatcaatgtgatatatcacatcaacagaatgaaggacaaaaaacatatgaacatgtcagctgggcgcggtggctcacacctgtaatcccagcactttgggaggccaaggagggtggattaagaggtcaggagatcgagaccatcctggctaacatggtgaaaccctgtctctactaaaaatacaaaaattagcggggcgtggtggtgggcacctgtagtcccagctactcgggaggctgaggcaggagaatggcgtgtacctgggaggcggagcttgcaatgagctgagatcgcaccaatgcactccagcctgggtgacagagtgagactctgtctcaaaaacaaaacaaacaaacaaagaacatgtcaattgatgctgaaaaatcatctgatattataaaattcaacattccttaatgattaaaaaccctcaaaaaaccgggtatagaagaaacatacttcaacataataaaagccatatatgacagaaacacagctagtatactgaatgggaaaaaaatggaaagcctttcctctaaaatctggaacatgacaaggatgcacattttaaccaccataattaaacatagtactggaagtcctgagtagagcaatcagattagagaaagaaataaagggcattcgaattggaaaggaagaagtcaaattttccttgtttgcagacgatatgatcttatatttggaaaaacctaaagattccacttaaaaaaaaattagaactgataaattcagtaaagttgcagtgtataaaatcaacatagaaaaatcagtagcatttctacatgccaacagcaaacaatctgaaaaagaaaccaaaaaaagtaatcccattacaacaaccacaaataaaattaaatacctaggaattaagttaaccaaagcagtgaaagatctttataaggaaaatcataaaacactgatgaaataaattgaagaggacaccaaaaaatggaaagttatttcttgtccatggattggaagaatcaatattgttaaaatgtccatactaccccaaacaatctaaagattctatgcaatctctatcaaagtaccaaacacatttctcagagaaatagtaaaagctatcttaaaatttatatggaaccacaaaagacccagaattgccacagctaccctgagcaaaaagaaaaactggaggaatcacattacctgatttcaaattattctacagagctatagtaaccaaaacagcatggtactggcataaaaacagacacacagatcaatagaacagaatagagaatccagaaataaatcaacacacctacaatgaactcatttttgacaaaggtaccaagaacatacacagaggaaaagacagtctcttcaataaatggtgctggaaaaactggatatccaaacgcagaagaatgaaactagatccctatctttcaccatatacaaaaaatcaaatcaaaatgaattaaaggtggctcatgcctgcaatcccagcactttgggaggccaaggcgggtagatcacctgaggtcaggaatttgagaccagcctgacaaacatggtgaaccccccattgctactaaaaatacaaaaaactagctgggcatggtggtgcatgcctgcagtcccagctacttgggaggctggggcaggagaatcacttgaacccaggaggcagaggttggagtgaaccgagatcgcgccactgcactccagcctgagtgacagagtgagactccatctcaaacaaacaaaatgaattaaagacttcatctaagacatcagactatgaaacttttacaagaaaacactagggaacatctctagtacactgggctggacaaaaattcctgagtagtatcccacaagcataggcaaccaacgcaaaaatagtcaagagggatcacatcaagttaaaaagcttctccacaacaaaggaaacaatcaacatagtgaaacgacaagtcacataatgggggacaatatttgcaaactgcctgtctgacaagggattgataaccagaatatataaaaagatcaaacaaattcataggacaaaatataataatctgatcaaaaaatgggcaaaacatctgaatagatatttctcaaaagaagacagagagacggcaaacaggcatgtgaaaatttgctcaacatcaaagatcatcatagaaatgcaaatcacagctacaatgagatatcatctcaccccacttagaagggcttatatccaaaagacaggccataacaaatgctggtaaagatgtggagaaaagggaaccattgtacactgttgctgagaacgtaaattactacaaccactatggagaagagtttggaggttcctccaaaaactaaaagtagagctaccatatgatccagcaaccccactgctgggtacatacccaaaagaaaggaaatcagcatattgaagagatatctgcactcccgtgtttgttgtggcactgtttacaatagccaagatttggaagcaacctaagtgtccagctacagaatgaataaagaaaatatggtacatatacacaatggagtaatattcagccataaaaagaatgagatcctgtaatttgcaacaacatgaatggaactggagttcattatgttaagtaaaataagccaggtacagaaagaaaaacattgcatgttctcacttatttgtgggatctgaaaatcaaaacaattgaattcatggacacagagagtagagggatggttaccagaggccaggaagggtattggggtgtggggtgggagataggtggggatggataatgggtggaaaaaaaatagttagaaggaatgaataagacctaccatttgatagcacaacagtgtgactgtagttaataataacttaattgtacattttaaaatcactaaaagagtataattggatagtttgtaacacaaaggataaatgcttgagaggatatgctgttctccatgatataattattatgaattgcatgcctgtatcataacatttcatgtaccccatacatatatacacctcgtgtgtgtgtgtgtgtgtgtgtgtgtgtgtgtatctactgtgtagccacaaaaattaaaaactaaaaaaaaattgttggagaggatttatggtcttctttcacttcagtacgttatttattatgtctgttgaatcaaaatcatgtcttcccattattctacctttaatataatgtattctcagcaaactggtcctgttacaaagctcatgctggttccatctttgtcctttttgtttttttaaaaaacacatcaacttccaggaagtatacaagtgatagaatcaattcactcagcactcctcacatagcaaaacatttttgctcattccaggaagagtgggcagcagctactagaaagactttgcatgatgatgaaggaataaaggctctactcagcagccctgacacagctattcccaacctcccactaaagtactctctgatatacagaagaaataataagtaaaatgacaagttgttttcttttttggtgggggtgtggggaagtatgatgattctctattctcacatatccatggaagagcactggtaatgaaagcagcccagttggttcagcttttagcaaagaataactcttgggagagaagtggatattggcagcaaaatatagaacataatcagataaaggaggcacaacaaatatctactttataaatttctaggatgttaaatagttatgtctatgtatacaagttggctctccataactttgggttccacatctgtgattaaattaacagtggatttgatctgatccctcaaaacctgagcatacaggacctgtggatatggaggaccaactgtaagggacttgaacatcaagagttttgatattcttgggggttctagaatcaatcttccatggatactggctgtatatatacagccatccctcagtaccacatggaagattgtgtgtgtgtgtgtgtgtgtgtgtgtgtatatacatatatatatacacatatacatatacacatacatagacgtatatgtgtgtatgtatatacatatacacatatacatatatacacatacatatacatatacacatatacatatacatatatacacatacatatacatatacacaatacatatataacatgcatatgcccatatacgcatatgtacatatgcgtatatgtacatatgtgtacatgtgtatctgtacatgcacatgtgtatatctacatgtgtatatacacgtgtatatgtacacacatgtgtgtatatatgtacatgtgtatatgcacgtatgtgtatatgtatatatacgtatatgtacatgtgtatacgcatatgtacatatacgtatatgtacacatgtatatatacacactcatatatatcttaatatataagtacatattgtatatgtacatatgtgtatatgtacatatacacacactcatatatatcttatatatatcaatatatatacacacagtctatagacatagatataaacacacatacacataaactataaggtactgagcatatatatataatatagtactataaacacacatacacataaactataaggtactaagcataacaatgggcacagagtaggtacttggctctcatcagctattcatattgtcatcataattcctacttcatccatgacactttccaacctcactaatcctcctggttagaagagtgactctatcaatggtgtaggaccaaggtggtttttatgttgttttgtttttaaatttccaatcagccatggagcactacttttgtcaaatacaataaaaatgaataataaagtgaaaaaaacttgcaaaacacaagccccaattagttttcactattagatttaatagacataaaactgctgtgtcaaattgctataaaggtttctaaatgcttgttctcaatttctgtctttgttattggtttagagaaataataaccaataacaactgttttgcaaatgagcacaggcccacagattacatattgagtagccatgttctaacacttcttgtctgtatcaaatatcagaactagcattgttagggataatctattttatagtagtagctgacagttaaaactgtacctctacctcttactctttgggcaagttatctaaactatttcgagcactaagtcatgcaattataaaattgagatattaattaatttaccaggttgttgtttggattgtgagtattaaataataagatctttgtagttagcacagcactgggcacatagtgagctgtcaattgatgttaagtctccttatttttatacttttgtactttctctacaagtcttttgaggctaagaatcctatcacattattacttgtattcccagcatctaagggagtgtccaactgcccaggctgctcagttaatgatgattatttgtcatgaagaagcagaaatattaagaaatatgaaaaaatataagcaattcaccacactgatggaaaacatataatagcattgctctattccaaataattcgtaagtaattaaagcattaacaaataacacacataggttatcataggtctcagcaaaagtcagtctcatgaagtaaaggtcttcagcaatgtgttacccagttgggtagaaataggtaatataattaaatagaaatgggatgcacgtagctcttcttttattgaggagtttttacatagattgtcatacaactctcgtaacaaacctatagggtagacattgccattttataaataaggaaactgaaatcagagagatcacttcgttactggatgtccagttaatatccctgcacatttaaatttaagactggtatctccagagtctctgatccttctttctctgtcaagaattcctaggcaacatgatctagcacaaacttccagggctaagccctcagagggctcaagaagttatcacagctagcagaagtagaggcctcatgccctgaaaggttggttggctgagtccatccatgatgcatgaattgtcaatcttcctccatggtctaggcttccatacttttctgtaataacttggaatcactagagttaaattattttattcagcaagggagcctataaattcagcacttaatacctgttcatggtttatcacacacataaacttacagtatttgatttccatttcatatgagttgtgaaatatttgatccaaagttaaaaaatatatgtcttatggcttataactaaagctttacaaactcagaaaatcagcaaacatgcatgtattaagttcctactacacacacatcaggccaaaggcagtgtcttgctttccatctcgatgacataacaattccattgagttagtttgtaatgaaagtttgtaggatgtaggtgtccccttcactgcaaatgcatctaccaatgggcttctaatatatttcagaaaacagtgtaaatgttatttcactagaattaccataaggaaatgcatctctcatcttctgtgcaatcatcctgctctgctccattgtctctttcaatccctcctccaccccagcccaggagatgcagtaactgtcttttcctccaaatgggcttgctccactttagagagtcttattagcatctacgactttttgattcagcttgaggtgccacagacatgcctttgaaaatctgaggatactctatcaaagaaggtttagcagtcagggtcccagaaagtaaccaagggtgcagtcaaacttagagtgtttagaaatgggttgtttaaaaacggtgttggcaaatgttgagaaaccccagggacagtgcagcaccctgggattaggtgataagcagtaggtgatactacccttctgaggcatgcaggcacaaggagagaaagtagttaacagaatctagtgacagagagggatgggtggagagtggtcttcccaccaaagctgtgaatataggtaggtcaagagaagccatcagcttaggtgactgtgcaggaaacaaatattcccagccactccatcctccctttcatctcctgtcagtgcttgctatgggtccaaccaattgatgtaaccattatagatcagtctcctgggacagaggaggaaagggagagaaggtaatattctgcaggggcaaatggtggatatccagccaggaggactgtcctgttggaccattttccctcaggttctgtgtactgattgcttgatgataaaatataatgagagagatttcaagcttactgtatgttgctaagtgtaatatccagacctaaaataagaaggaaatgaaactcagatctacctcaagttgtgtaacaattccgttgcattttagcactattaagacaagtatttcatgtcactcgatatataaaaacaagattgttttcagcgtttaaaacattcttgatgaggaaatgaaccccaacatcctccagaaaagagctacccctacttatgagacaaacttacacaatttttttacatttccaaaactgatcgtgttttctgtggcttgtttgtataacactgaatttacttctggctgttcatttatacacaatcagcacagccagcagtgcttgctctgttgattgcaagttagtgtttcagggttttaacaggtaggcaaaatcaattcaacatgagtaatctttctcttaatgcatcctcttcatttagtttgggtctgcattcttaactttaaccagtcacataaaaagttactaagaacactcttcatttccagcagcttcctcactacaaaactccctgttaaagcagaatggatgttggaaatcgctggaactctttaattaccatgttgatacaactgtggagcagatggaattaaaaaatgtttctttaattccgtaattgatgggggaaaaggctgccttcatagttgccaggtatatagatgttataaacaggatacggtttattagaaattccttcttagtttttgtaaattggatgttgtcagcaatcttcgctctcatcattaattgggctaatattttaaaaaggattttttggtatatacaacagtccatggttggtatcagagacagattatttactgactgactggtagtctgctttctatatggatatctcagtttgggaagaaaactaaaatccactctttaagctcttctttggaagcacacttttacgaaagacttggcaaggcagggaccatcatctgctcccggtttagtgcagttcagcatgaaaccctgcactgccctccccggatgctgattagtactaagagcaagattgggctgattatttcacttggatgaatttatgaaatgatgagtaagaaacaatatagataaatgagttcatacattttattttgtgttatatttaaaaagtatttgcaaagataaattaggtaatctagctttaagtaaactgaaacttttgtttaaacttttgtttaactgtccaacattaatcctagcaacttgataaaggtagaacaccaactacaccccagcaattttgcttctgataaaaatgagaccctgacttgtaagttgcatctgaactagggagaattgtaaataaattataagtaccttcacttttgtaactgggcatacgtctcatggagaccctgaaaactgtgtctattcaactgttccaagagatactggcttctgtgggaggctgggtgcctcccccatccctacctctaccctgtctgatgtggatctcacattcttgcacctgagatgtgtcacctagagaaaagagctcttgaactgcctagtgggctgtcactggcacggactgctgcatggaacaatagagagaaacaactgatgttgcccccagggttctcatcctttatccttctaagcagactgagagtcttctgagtctgaatggttagtagagcctaagaaaactccctggagggcactgcacatctataaaatggagaactgtgcatctgtcaaaaaaatgagaaagatctctataaactgatatcgagtaattttcagcatatgtgttaaatgagaaatgaaaaagaaaacaatgtattcatttgtgtatgtgtataaaaaagaaaagtttttgtgtgtgtatacacatacatacacattcatacatacctgcatacacatttgcttacttttacaaaacaatgacacataggggacaaaccgatggtaatagtgcttatttacagtaggcgggtgggaatacagtagtggaaatagggacagttagaagtcagatttcttagagtgtaactttttacagaactttgacttttgagctatgtatttaatgctcaaaattttttaattctaaaactgaatacaaacacaaataaaccttaatatatgctaaattgttaatataactatacatggaagaatccatttaggcaaattttaaacattacactctgtatatccttggttggatataaacaaggaaatcttaatttcacctggtaggattctgttggtagtgacactgttattgtcattatgaaactattatatacaatataataacaaaaatatataaaaatttaagtaaatggaatattcttatgaaccaatattatcaacataagagaaaagagaaatacagaagttaagaaaaactgtaatattgcaactgaattagaattattcacaggaccctgtgatttttaaaatgtatttccttgctctttccactggaaagtctcagaagcaatgatacggcagtagcgatgaacatatatagagtatctggatcccgggttctaaataccattccccacaaaaaggaaccagagctggatggagaaatagtgattcaaggtctgacacagaaaaatcctaaggtgagccaagggcatcttgtgccagacagtagagaaatgcttaaagaccaatgggttcacataaacagaaacagaagtcagtttgaagaggctcctggccaaagtcagagtaatttaagcatctaacaaataatatatgcaatagattttactagactgaataaatacaaattcatgtccatagtaacactaaataggggaatacaaggcttcgtcttacagaaaagtgcgagctaatgatagaatgaaaaaacatcatttttcaccaataaaataattgatttactcaatgattaccaatggattctgaaactgtaacatgagagactgagaacaaaacctttgtatggggcccaaatatcacatattctgcactagttataagggaaaaaaatgtactttcatcatgaagcaatgttttagtgaccacttttagaaaacatcactaatgagggaccacctgacattgtgtgcctcataactgatgcaacaggagatactcactcatctactagtcttcccacaaagtatttaacttgaatatcaccaaatttctagacctaattttcaagttacagaaacaaaaaagacaaaggaagaagttgaatgatattaagaagaaacaataagacatatcaaacatgggaatttctaaaatacagttctcttgggctccttgcaaaatcagtgctgtgtaggggaaaaatacagggagattgttctaggtgagtttggattagatcctgcatgggaaaaaaatagctgtatataatagttgggacaattggggaaactctggatattagatgagactatagaattattgctaatttgactagctgtgataatggtactgtgattaagtaggagatggcctttattctttgataatatatactgaagtagttcagcagtagttttatgacatctgtggccttttaaatggtatatctttctgtaggttttaaaatgtcattattagaaagtcggggcaaaaaataaaaggaagaaaattatcattgacaacaaaactaaattgtggtatatctttctgtatgttttaaaatttcataatgagaaagttggggcaaaaaagtaaaaggaagaaaattatcattgacaacaaaactaaattgtagctacttagaattatgatgaaattaaatttattaatttttttctctcatggcttatgctttttgtcttccaagacatactgaccatatatctgtgagtttatatttggagtctctaatgtgagcaaatgacttacagtatcttttttattttttttttttgagacagagactcgctccatcacccaagctggggtgcaatggcatgatctcagctcaacgcaacctctgcctcccaggttcaagcaattctcctgcctcagcctcccaagtagttgggattccaggcgcccaccaccacgtctggcttatttttgtatttttagtggagaaggcgattcacaatgtgggccaggctggtctcgaactcctgacctcaggtgatttgcctgccttggcctcccaaagtgctgggattactgagccactgcgcccagctgacttacactatctttataggaaatttatcatcagcttttgtaagcctctctactttgtgcttctatttcaaaattgttttggatagtctggatgctttgcatttctgtatacatttatagaatcactttgtcaatttctacaaaaaaccttttgggatcttcattgaggttgaattagattaactaggggaaattaaaggtcctaaaaatattaactctactggtccatgaacatggtatctcttcatatatttatatctttttaaatttctcagtgctgttttattgttttttcagagtttaggtcttgcacattttttccttttaaaaatattttattacttataaaatacaatagggtttataatgacacataagaaacaatataaacttacaaattgcttttaaaagttggtgtcataattttatatagtaaaataatactttattaatgtgatatattgagtaatcataaaactttctggctcacttttctataaattaatgaggttaacaaaatttatacttttagcaactttattttcaatcatataaatgaaaacaatgtcaggcgcttttggtaaatggcattacatactgtaaaaagatttatctatatatatttcagattttaagtaatattataaatggtatcatttagttccaatttctagtcattcattgccagcatacagaaatacagtaggctttggcatcttaattttgtatcctgactaaatttacatcttaactctagtagttaagaaaaaaaaaatcctcaggatatcctacaaaaaccatgtcttctataaataaaggcagcttttcttcttccttttctatctgtatttctttttctcaccttattacactggttagagtatctaaaacaatgttgaaaagaagtgataaattttttttttttttgagatagagtcttgctctgtcacccaggctggagtgcagtggtccaatgtggctcactgcaatctctgcctgccgggttcaagcaattctcctgcctcagcctcctgagtagctgggactacaggcatgtgacaccacatctggctaatctttgtatttttagcagagatgaggtttcaccatgttgtccaggctggtcttgaactcctgacctcaggtgatctgcccgcttctgcctcccaaaatgctaggattacaggtatgagccgcagcgcctggccaacattcttggtttgttcttaatcataataaaaaggaagcagatttcaccactgttgtggtgtttgctattgatttgtcataaatgctaacagattgtgggaattctatttctactttgctaatttctttttaatcacaaattaatgttgaattttgtaatttcttaaatatgtactgatgtgatcatatggctttcttttttatttcactaatacaagaaattctattaactgactttgaagtatcaaatcaaactcataatcctggaataaacctcagtttgttatgatctcttatcttttctatatattgctggatatgaatagctaatatattttaaaggttttttgtatctatcaatataaaggatattgatctgtaggtttttttaatttaatgttcatacaagggcagtgatggtctcattaaatgaattgagaagtgttcctccttttattttttgaaatactttgtgaagattcatattaattctttaaatatttgagataattaaccagttatttggaccttatttggggagaagttttaaagttttggattccaaacttaatagttatagagacatttagatttttctgttttttatttttatttatttttttagacggagtcttgctctgtcgccaggctggagggcagtggtgcgatctcagctcactgcaacctccgccttctgggttcaagtgattctcctgactcagcctcctgagtagctgggactacaggcacacaccaccatacccagctaatttttgtatttttagtagagacggggtttcaccatgttggccaggaaggtctccatctcttgacctcctgatcagcctgcctcggcctcccaaagtgctgggattacaggcgtgcgccaccatgcccagcctctgtttctcattttgatgtctttcaagaaatttatgtaagctgttcatcattggcataaagttgctgatagcatttctttattctttcaataattataagatttatcgcgctaccctcctctttttttcattcttgatattggtaatttctgttccctccccttcagtctcattagaggtttatcagttttattattattacagttaaccatcttttatcaataatctctattgtttgctggatttttatgacttctaatctaaaatcattatgattatcaatattgtattaattttatcaattctgtttgcctgattttcatgatttctgccttaaatcattatttcattctaattttgaactaaaatttctcttattattttagcttatttttttgaaattgtaggtaattgagttctttcttccttactaacataagaagcattgaatgctgtaaaaagcattgaatgctgtaaaatgtcacctaagcactactttagctgcattataaaaattgttattttcattcagttcaaaacattttctcatttctcctgttttttttttaatccatgatttatttggaaaggtgtagtttgactactatttgttgtatttttcagatatctttctcttgttaatttctaatttaattccattttggaataaatatactgtgtatatttaaaattttaccttaaatttagatttttttaaatttaagaataattggttaatggctcagcatctattgtgatatatatttatgtgtacttgaaaaggatgtatactctgctgcatttggatgcagtgttttataaatttcaattagattggctgacagtgctattcactcttctttatcctttctctagcctttctacttgttctaccaattattcggaaaggaatgttaaaatctccaattattattgtcaatttttctgtttctcctgtcagttctgttagtttcctttttggataccttgaagtcctcttattgtttacatgcacatttatcattgttatgtcttcttgattaaatgtcctctttttggctgtattctttattctgaactccaggtctctgatattcatatgttcttccagatttcttatggttactgacttggcagtatatctttgtttatccttttaatctttgcctacttgtaccttatattttaagtgagtatttttgtagatcatgtatatggttgggtcttgataatgtctagcttctaagtgaaacgtttagaccgtttgcatttaaagtgattacttatacggttggttttagtctaccaccttgccatttattttctatttgcctcatctccttctttttttccccctcttttttctttcttgagcatactttgattttacatgcccccagttccctgtgctattattgttttacatggtatttttacatgttattaatcctacaatacatgttactctttttgttttaaccaatcaagaaatatttaaggaaaaaaagaaaaggaaagaaagtatttcatgtttacccacattttccatttaagacagacttcactgctttgtgcagatctgtttctacatggtattacttactttgtggctgaataactttaatacttcttgcattacagttctgtttgacacatattttctcagttattgatgactggataaagcttttatttaggcttcaatcttgaacgatagattggggagaatataaagattcctggttgtttctttcagcactttaaaatgtcattccattatcttctggcttgcatagtgtttgggagaagtttgtagtcatacttacttttgtttctccatacactgtgcatgtatctggtttctggctctttttaagactgctgtttattactggcttttactaatagtgtatattggcgtggtttatcttgcttggagtttattgaactctttggaactgtgactttacagaattcatcaaatttggaaaactgttggctattagttcttcaaataaattttgtgcactgctcccttccaaattctggaagttcaattacatatatgttacacagcttgacacggaggctgtgtcaattttcatttcagtattttttttcctctctgtgtcttaagctggataaattctatcactaaatcttcaattatcactaaatcttccattttttccacaatctaatcttttgttaagcccatccaatggttttatttgaatttttacctatgagttttactttgtaatttttttatatctgccattttccttctcatcatgttcatgttttcatttaaattcctaaacattgttataactgctatgctatttatatactagttccatatctacattcttttaaaattctgtttctcttggatgatatttctcctggctaagaatcatattttactgtgtttttgcatctctagtaatctttcactggatactatgttaattttacatcattagatacaaaaattttgttctcatcttttaatggaagttagacttagtcctgacaggccattaatcataccaatcaaggcctatatttaagctttactgcatgagtctagagtagccatcattccagggccagtgcagtcctaccagcaggcctgaccccaccagagtccatattaaatgctccaggtgattactttggactctgtgtccattctggctggagtctgaatggctttctgcctactgtaagacctgggaatcttttggtttacagctcttctcctttttagcttggctttgtagaatttcacttttacattcatggcctagtactccggaaagactcaaaaagaccgtaggcagatttctgaagttctttatctgaaaagttccctcctctgaaactctcccctacaaattattgtcaccatcttctccaagataagattgtatctctaattaaatgtttatctgaattgcaatggtgagaaaacatttgtgtcttgtttacaaagaatacatcatgagactatgaaaattagttttcttcattaactttcaggaaatagagtaaagaaaatagttacagttgtcataatagattttttaaaattctcttttggaaaaaagccgaaacaaaccaaggtctatgccgttgccagatttatggagacaaacattttctaatttctttttaatttttaactaatggatcatttcctaacaggcaagcttgcagaagaaaaagctggcagagtggtaagtctgtttttatggaaataaggtaattagtactaatctttgatggacacaattcattaacttttggacaatatttataggggaggacagaaagggaaacaaacaagaaactgaatcagtaaataccactttatggcttggatcttggaattgaaatgcaagtaaagtattgctaccacatcaattacatttaaacagaggagccttattttaacaaagaaaaatctgaaatggcaaactgaacttgcttgaatttgttgatgccacaaattatataatggtattctcattttgcataaacaatgtcagttttgccacatgaaaaactgtaatacagctctcctgataaagggcttatttttgaagacatacacacacctataaaatatgcataaatattaaaaatcattgtaaatctcattttatgaaataggaatatttgcagtattgatgcataacattcaggtgtgacaggtggcctcaggctgtcagcatgtagtgatgaataactcactgaaattttgatgaatgactatttcctttatttagcagaaggaggagacagccacaatggggagaattggtcttctggcatacaaggtagtagaaggatttggttactcaaggatgagagtagcagagctactaccatccagcctggagctttatcaatgcagaacagaagtagcagtggtgttttctctacagttgctccatttgggtcttactcctagatgatcagttatagagcctgtcttcctggccctcttagagacctgggtgctacataaaatcccttaacaaatttgttttctattttattctagagtggattctaaaaccaactgacatagaaataaagagtcaatggatttaattacatgggggtcactgcaaccagagaaggtctgggctgttaacagagacataggatggtggactgattgaaggcgggtgagggacagagaagtgagcaaagggagccacttggcttaaatgactcattctaaaaggttgtgaaagggaaaggaatgatagagaacagctggaaaaggctgcagggttaagggaggaaattttatttttaaaaatggaagtgatttaaggttcctcagaagactggaatacagtctcaaggagaggtggacagacagctttagctaggaggagctgtgcctccattaatgtaataggacgttttgtaagcactgtccagcgaatggtgtctttgaccagagtggccaaaagtatacacacatttgctctggaaaagccttaagtggtgcaagaacaaggaactgagagatgccataggaaattccaaatagtgaaaatacggcagttccatccattaaagtacttagaaaaagacttaaaaattgtacggatattatttttgagtacgtttgtatgctatgtatttatatttgtaaataagataacgttacgaaaattcagataaagaaacaaaatgaatgtacaagtcatagtttcagaatgctttaaaactgtgttttaatttacgctcagtcttctctcttatatgtacttttccatggttgtagtaaggtatatatacaaatggcacaggacatactgtttgttttacttattataatcatgtttctatcttgtatagtatccatagtcaacactttgatactgatatttaatttccatgattgacttagccttttctctattgctagccatggctataactaacgtaaatgtaatcattgcataaatttgaattatagctcttcgagggacttcagagattatcaggtaccacatcctcctcacgcagagaagaccaagatacaaagcacttaagtgaattccatcaggataacactggaaatgagcagctgggtcaaaaccagacccttgtgccataacatgtacagagggcaggaaacagaagtgacgtcacctgcaatactccagctcagtactgctcaaagttccagtctgtaaaatgtttattaccggttcacactgagataaggggcttgcaaaagaataagggaagcagtgcattaatttatattctgttgctgatcagaagctatcagtcacataccaggattagtcccaaggataataacttttgagtagcacaactctgaaagaaaaatcacaaaatgtctgattctctccgtaacgatgaatggcattaataaatattactgaagtttcatagctacatttccttcattactcttacatttttttctttaacaaatccattaagtgtccaagagattaccctttaaaaaatagagcccatgtacccagtctgcaagtatgaaaatcatgagcttaccatgcagatttaaatgactttatttaaagagattcatacaagaaaaacaactgtagagggggcaggctgtccttctaacctggtcacttttattgtctgacaattcaggaaagttcttgggagttcatgggatcatatttatctgtgtatgtctgagagacagacttctgaaagataattacgtccctactaactcatgggtttcagctatcctgattactgctaaaataattgttttagaattattttataaatttaatcatcacatgaatcatgatcatctgattcttgtatttttctaaacagaaaaaatgaaaaaatactaaaaaaacacagaatgacatgatgccatgattcatcatactcaatatgaattgatttttggaactaatgataaattttgatgtagtggttttagaagtatgttttataactcataggctatctgaaagttcattctaagtatgaaaaaaattactattgtatcaccagggtaaaacaaaataccagtgatgactgatttcatttttcactttataaattggcctgcccgtaagttatgctgaaaagaaactgtgaacgatctctagaggaagaagtcatgccacaaacactttgatagataatacatttataaccaccttgaaggaaacgctaagtcctacaatgttgcttccagaacaggtatcttctttcgattccatgtgcttacacaccattattactattgctaatagcagcaggcaaaattctaagcacacagaatatattaaatcacttaactgtcacaaacacatcaagaggtaggcattattatttaactaactccatcatatagaggaagaaattaagatacagcgaggttaataacataacttgccctagactaaacatacacacacatgtcccatatgaacccaggagtttatcatgcaaccttctcattatgacttagctttcacattattattcatgcaggaaaagaatgctagcagtaatatttcttgacatgaattagtaagttggtagtataatttacactttttttggtcttgtgatctgatagtaaaaatcagttcattacatcatcattgggtatttgaattaagtaagttttctcccatccttaagaaaaatacaaaaggccgggcacaatggctcacacctataatcccagcactttgggaggctgaggcgggcagatcacctaaggtcaggagtttgagatcaacctggccaacatggcgaaaccccatctctactaaaaatacaaaaattagctgggcgtggtggtgcacgcttgtaatcccagctactcaggagggtgagacaggagaatcacttggaggcagaggttgcagtgagccaagatcgtgccactgcactccagcctgggcaacagagtgagactccgtctaaaacaaacaaacaaacaaacagctaaaaatgtgtactggagatgatgtagaaaacacagatatacataatgatgaaaaatatttcacaacctaggaataatgcttaatgtttgactatctatcgaaagctatctatcgaatctatatcctctaatcttctataaaaacaaatacacatactagtcagctgcaaacacatgctgctatcccaaagtaaagaaaagataactcaggcagatctgagagccatggaaaatcatttctaggctttgcaatctaatgaagaactttcaacatttgcccagttggatgtcaggatttctaagaatcagtggcttttttgagctttccatttcccctttctgaaatgtttataagcagttatcctttgtgtgtctcaccactgtatgttgggtgtgtaggaggcagataatgtctcatctcttcagtctgcagtgaagagagaggatacttaatgagctctaattaagaaactacccaagaagccttctccatccctggatctaatttccaggtgattatgtaaagggagaagacttctgaggaccttgagatcacccataatgatccctgccttcaagtattccacaccaatgtataatcctctccccttgaatgtgggttacatttactgactcacctctaaggaacagaataagaccaaagtgatgagatgttgcttccaaggttaggttattaaaagatcatggcttctgttttgggctccctctcccttccattcctcactttgtcatttcatgccagggcacaggtagcaaggaactgatacagtccttgctagaggaccaacaatcagggtggactaggggtctcctgctaacatccacgtaagtgagtttggaagtgaatttttccctagttgagccttgagattactgttgcccacagcgaacaccttaattacagctttgtgagatgttctaagccagaagcactcaggtaaactgtgcctcaattcctgacccataggaactgtgagatagtatttattggttttgctcctaaattttggggcaatttgttatataacagtaaataactaatacagatgttgagtttgatataagactgaacccttattttgttactctgattaaagatttcatatgcattgaacttggccaattattcataagtttacaaataaatgcctaaatttaaataaagcacatttttcttaaattgcttttttattcccaatatgtctaattgtttcctttttacatgtttattttataagcgagatatttggatcttataaactgaggaaatcattattcttatgttagagtcttttattttgttttctcaggtgtcagttcttcagcttgttggcatctctttcatggtactggtggtcttccttgtactcttcctggcatgagagattccttatttgcccaagtgcagatgcttttggtgactgtggggtgcagagtgtggcatactggaagtaactgtgcaggtagcttattttgggggtatatccaaaatagtttatccattcatatttcagattagacctccctgagatagtaccatgtatttttagctagattcagtactttggcctagggtaaacactgcagctgtccgcagattattgtaagggaaaaagaaacgagtaatatttcaactatttgaaattgctcacctaatgattttccctggaacacatcctactttgtgtattttgtgactatgtgtttgcagaatctcaagaactgctcccacctataaaaggatttttttcaaacactgtttggactgtgctttttttcttatagtgtgtcttttagggacgcttcaaagtctctgatcacaatggtacacttttttttttctttctgcattattggtatgcatgcattatgaaacacattttacaaatgtgcataggtatatatgtatatatgtatatatgtatatatatttatttcttattaagaggtttgagtagggggaagtagacatatgtggtttttgccaatagaatccaattaataaaaaacatttatatttttgaaattagaactctaagagttcatctagaaatagaaataagtccatttttgataaaaatgaaaataatggatctaacccaactgtaatgctggtgattaagcagtcaaaatgaacaattaggaagtggtccagtcatttagtgaatgttgcttctgccatcaacacattaaggagacatggtactttagtctgcgtgtaagaaaatgatatttagaaaatctaagtagatgtgttcaaaaagtgttattctgaagttgataaagacgacttggtgattttttttttcctaagggaaattaaccacattcatgatctgtttggacttagtttttctctgctatcactgcatattttataagctgttaaataaataaatctggtaatagtttaactgactgtagagaaaagataaagatgcattaagttttttaaaaaacacctatacctgtatatgtaatataagtatatataattttaaaaattattttgtaacttttatagcatgctggttaatatgtctagattaagtctaccaaatgtgttatgaatatttttttccacataaaagataaactgttaataaatcttttccaggcatcagtgtctagtccacataatcattagcagacaactcccttggcagcagcatcttactcttgattaactgcttctcttagattaactgaaggattgaacagtgtatgaataatcattttttattcccagtttaaattttccttttcataactgctatctgctgtatgatgttaaggaaaccgatcagtttagctaagataaaaattattatcaatttatgaaaaaggaaaagttgggaaactggtaacttcttggttactgaaggtgtttgcttctaaaacaggtagaggtaaaaatataatacccgactctcttaactgtggtttggctttctgtggttttagttactcaaggtcaactatggtccaaaaatattaaatcgaaaattccaggcccggcatggtggctcacatctgtaattcaaggacttcaggaggccgaggcagtaggatctgctgggcccaggagtttgacaacagcctgggcaatagtgaaacctcatctctactgaaaaaaaaaaaaaaaaaaaagtagccagccgtggtggcacacccctgtagttccagctactcaggagactgaggcaggaggatcacttgaacccaggaattggaggctgcagggctgcagtgagctatgattgagccactacactccagcctgggcaacgaaatgaggccttgtcacaaaaaaaaaggaaagaaaattgcagaaataaacaatgcataagattgaaattgtgcactgttctgagcagcatgattaagtctcacgctgtctccagcccaggatgtgaatcatccctttgtccagcgtgtccatgctgtatatgctaccttccatcagtcacagctgtttcagtaatcagattgaaaaaacacagcacatacagggttcagtaaaaaaacatagtatatatatatagggttctgtggtttcaggtgtccacaggggtcttggaactaatcccctgaggataaagggactactgtacacattttcctctggtggcttatgccctacaataagaacatttaacaaagtaagaccatttaacaaaacaatttaaaaataataaatcaatgatttaggcaaggatgaaaatattcataaataccaagtaatgtaaacatttatatatattttaaagaaaattttggaatttgcatttccttaattatatagccagaaagttacaagggaaaaagaatttggtttagaaatagcatgaacctgggatagattcccactcattaatcttacttcagaatgatattcacatgttgttgctgcctaggaaaacaatctaaaggcacaagtgattctaaaatacactcccctggtttcctgagatgttgcattccactcttgaacatgaagataatggctagtttggagaaccatctcaaatgattttgccaagtgtaaacacatgaatatttttaagaaaatgtcttcattaatggctgttgagctaaaatctccataactacatattatgcaaagatatgacacttaacatccatactttacagatttttttttttttttgagacggagtctcactctgtcacacaggctggagtacacaggctctgtcacacaggctctgtcacacaggattgcacacaggtgcaatcttggctcactgcaaactctgtctcctgggttcaagcaattctcctgcctcagcctcctgagcagctgaggttacagatgtgtgccactacacatggctaatttttgtatttttagtagagacggggtttctccatgttacccaggctggtctcggactcttgacctcaagtgatctgcccgccttggcctcccaaagtgctaggattacaggcaggagccaccatgcccagccggcatacttcaaagattgtaataaaagtacttgaccttaaaacattgtttccatttaatcatattctgtaaatctggggaaatgaaaaacaagaatctcaatttttaatcaatatttgaccagacacatctttagatcaagccacgagctttttagataaaacagaaaaaaattcccacctttgggaaaactagtagaaatgcgatgtccagattcagctggatatatctcaagatcgatatttaccactatatttattactacctgaaactcttaagccaatcattaaaaaaattccaaaagattactggacttactctttgaatttttgtcttttaaaaatatagacataattcagcttatttaaacccacctacacaagtcctgtgttcaaattttacggggcatagaaccgttcactttgggtacttctttgcctgtataaaatgctgtcatgttgatatatctaaacaccaaggtacaaatttaactatacgattttgaaggaagcagttgaagactcaggtaacactgctttaggacaagtcaaaagagagtttgctgtttggcttttgacactgaagtttcttaccaatatgtttcatgaagctctctctaggaaactacagtattttggtatcagttctctaaagcaactgcctgtgagttaatgtggttgttttgtcacagcgtgccttttgtctccacccgcctccagtcccatctttactcattctgccttttggataaaacatgtacaattatatatggcttggtgcggaatgggcttgggatgccacaaaactaaagtggcacacttaaaaaatacctctcagctacagagtcaaataagacttggaaatgctagaggtcagaacattgctcacaaattatcctggttcaatttagcctgtgaatgttttggaattatacaaacagtgtctgatgactcatataacttgtaacttaagtgcgttttgctgttgtgcatccttttagtccagctaccccctaaggaacaaagtgttacagaagcagttatggtttcaatttccctctatgattcgctttcatttgaaaaccagtgaaaggtggggggaaatggactgactaactcctgacactaccagggcttcagattactcaatttccacgcttcctctatcaggggagagagtcctaacaaagactaaaaataacttaaagaaaccaaaaaacataaagatgctacttaggaaatattattatcaagaattaattagtctgccaaccaagtattatgtacttgaaacattcttttattttttaagatatcatacatctagtgtctcatttgattctaattttgaatagtcattaatacaatagaggtttgcattaatagctatttaatggctatgaaaacagtggctattgtgtgaatggctataaaaacaatggctctttttatggtgcgttcatgctatctacaggcagatgaactgcattttagattatcaatctgatctgattttctctgtatctctgaaactcatggttctccaaggatgacttctcactggtacccagtgtggtgaacctttttgtaagtcaatgcaatatttgcgactatagtcttggtttggttcatctttcttttttccactaggaaaatgttcactttatcttccacaatcttccacaagcttcttcagtaccaggcaagggactcaactcctgattatgatcatttcttgccttactttaaggatgaggactaaacaagggaaaaagtggtgagaatactggaatacatttcgggcaaggttcctaagggggaggataaatcgtacacacactttacagaatccacgtagtcaaagagaacagaaaggcacccagaatggcacctactcaacacaatcttgacttggtagataaggggattaatatacaataaatttccttttgcagctttctggagactcaaagtgctctagtgaaaagatcattgatcttgcagtcaggggacttgaacttcagccctacctatactaaatccctgggtaatctttgacaagtcacttaaatttacttagccttagttttcccaactgtgaaaacaggaatgaaattctctagtaccccacaggattgttctcgggcccaaatgtcacaatgtatatgaaagtgcattatataaatacgattatgtaatatctggtatcatcaatggaggaggctttccatatgtactatgcctaaatatattacacacatctatactgaactttttttttttttgactgactctcattctgtcgcccaggctggagtgcagtggcatgatcttggctcactgcaatctctgcctcccgggttcaagcgattctcatgcctcagcctcctgggtagccgggaccacaggcacataccaccacgcccggctaatttttgtattttttttagcagagatggggttttgctatgttggccaggctggttttgaactcctgggctcaagcaatccactcgcttcagcctcccgaagtgcaaggattacaggcgtgagcattgtgctcagtggcctactgaactctttaaatgatatgcatttaaagttggtaattagataatatcataataatgttgataattagataatattatagataacttctcatccttgtacctttgcttttctctacctaatttccatggtttgattttgatactttttgaaaatcaaataagaaaattcagaacactgaacacttttaagaaggttgactcaggattactaggaaagagatcagcttcaacataataattttaattttttgtcaggcttttcttgtagtgttttgagatactctcgatatgtcagtaatttgaaaattacacaatcaatcaatgggagaaagaatggcaggtggtctcaaaataattttttggctctctttctttcttttcccttcctcatttacacatggcacatatcttcatggagggcttttataccttctttcaaagagtataaccagttttatcaatgaaagctctataaataatttctgaattagaatatttaatttttaaacattttaaatcactttttataattacattcacaatataattgtgaattgaattttgtgattaacataatcttcatacataaaagaagataaatacttgtctccaaaaacaaaaatattaataatgatgcataatctcagatatatccattaagagtttaatatggttggcttggtatgtgtttccgggaatttctgaaagagtcatgtttttaagaaaataatttgggaaaaatagaaatttaagtggctcattttttgtggttaggttagtatttatgaaatttggttttgtttatttctcagcgaatcattgagatcctgagtaacagaaagagaaaaccattatgtttcataatgaaatattcttggatattgaagatagtctattaaaacatttaagtgttatatcttggtcaccatgtaatagatatttttttaaaactgaagtggcaaaaagaacacaacatgaataaaataggaaaaacatttctgaaatagtattgttatgttcacaatttaaaatgtttctactttgtgctctggaaaaatgcacacttaaaaaaataaattttgaaattaaataccaggtgtatttactctaggaagatgtacccacttaataattgaatctgtaatatagcaggctttgggatattagatacattattttatagagatataaaattgaatttcgaaaactacttcatgggattctctaaagtaagtatttaaaaaggaaagatatcaaactggttaccagaatgctatatgtgcaattttattggcagattatgagaagtgatctaattatacatattattcatatttgttgaggaataaaaggacgcataaatctctgtatgggaaggcacttaattctttagggtctataatatatagcttgatttgcaaaacattacaaatgatacttaggatccaaattgttttcatctcttaaaattcaaagcagcttcagctttctaaaacacacagtttgtctgtagtgttataatacacaaccaattaacatggtaggcatcttctgtgttctagatatgtgttaggtctaagaaatgtaaggaaaaatgataagcaggagttttcaaggagcaaatagtcttgtgggaagaaagatctgggtagaaatcttataatctgggtagaaataatttccaagataaacagctttgacagagctttgaacaacgtgctactggaactcagaggaaggctggagtggcttctccaagtcatgatgtttcagctggctgctaagacgagggaaggagggtcagcaggcctgccagatggaagatacatcatcatctgcaagggcataatgttagccaagagtagcaagtgctgaggaaaagtggagttcaatgtggctgaggtctagctctgtcgttaacttgctgtgtaatatagaaatgttatttagcctctctgggctgtttcctcatttaagacaataaaacctatcctcactgagggttttgcaatgcatgtaaagtgcttggcaaagtgtttactcccgacttaaatgctcaataagcattagtggctgcagattggagattctgagtgtcagtttgtgttcatttctttatcacgtcaagctggccgtttaatctctttgggcttccttttcacttttctgtaacaggcaagcaatcaaactagatgttgatctcaagtcccttccaattcaaagactgtcacagctatatgatcgttgccacataagtaaaaattcacattaaaatgtaaaatgtatgtaaactttaggaaattttttctatgaggaatattttatattactccttttaacatatcaagttggatgaataatagggtcatagaactggcttttaggtcttcaggttggatgacttattcaaaactgaacacttctaactttaatttctatttcaggtaaatttactttttttgaaagacttcagaaagatgatagacagcatctgaaaaacatggcccaaagtggactctcccttcttcataccagggcctcttcctctaaatataacaacattgacaataggggaagcatcaagaacctgtttgttttctggctgtttcaacaagttgcaacttgttggcttgcaacttcagaacaaaacgtaatagcttaacaggcactttgatttatttgttccttaatcatggaaaaagtaaactagtcagctattctttgtggcttttaataaaatgtttgtaattgcatgaaacaattatcaaatatttcttatgagcaaaagcaaggaaaaatgacctatggatgtaaattttgatcccaaatgttttctctcctttaattcaatggttattgaacaaccattatgtgcttggtagggcttagacaatagcgtttttttgattttttttttttttttttttttttttttgggagacagaatctgagtcgcccaggctggagtgcagtggcaccatctcagctcactgcaacctccacctcctaggctcaagcaattctcctgccgcagcctcccacaatagtgatttataaatgattttttttaaaagaaaactttggcacccaggaatgataggacattaagggactaaagaacagtaagttcatgaattttaggtcctttgtgcagccaaaggatccttggaagcctgggagcagggcgtgcagtggagtcaaagacttgggcaacactgagaagaatctcagtgttgtagactgaattcatgcctcagtctaaggagatatgacatgggagtgaatgtctagtatagtgtggaggacaagatcactaggaaagagaaggtcaagaaactctaggagggatctctgaagtgattagaaagaggaggaaggttgtgagagcgacagtatgcctggagtgaagattggtgaaaattagggtgagtgacacaggagtaagaaaatgatggcaataatgagtggtacagggtgatctaatctgatgatgtggggctcaaatttggagattttaagggagctcttgcaaatgacagtttttcacccctttctaccactgttcaataggtggaataagtaattcttctcactcctcattgcctcttttctgcctcttgggtagtggtagaaacgggtgaaaaactatcacttccaagagctgccaggaaagtaatgacttaatggaaaagtcaggtttcttagatcgagaaagtaaaaggagtatccagaaaagagggtggatgtacagtgattactgctgctgctgaaggcctatcagcaattaaagagaagtgggttacaggaataaaagagggaaatatagagtctttcaggtattggagtatggatgagggggtgaccttagtcaggaggagttcctgtagtggcttatataaggggagagaaagtaaacatttccatgatgaccaactaatatcttcaatgatgacatatcaggaaccactgcttttagatttctcacttaaatttgttttggaaaaatttattccagattttaacacttcccactcttaaaaccgaatatgcattcaacatatttattgattctaaaatgttataaaatacctgcttttgtttggcactttgcttgtctccttcttatatcattattgtatctttcatgcagtgatttctgtggtctcagccccccacatggtgatcagctacctcagggaagtcctgtgctactttgcttctctccatgaattataaacctaagggacaggcaattgagaggaaccacaaagagttcaaagtaaacagggtttaatcaatgtatcagatgccgggtggcaactctgttttaaaagtcaaagtcaagttaaagtgtggggttgtctgccacataaggggacctcaaaaatcagatttttaataaagttgcttccaataagaatactatcattctatgatcttaacagactaaacctgaatctgaaattgacattataaaccagaaaattagccagaactacacctggtgcattgatggagtaaaagagaaggaaccgacaaaaatactagagcagcagatttttggggtcaatgttaagtgatcatttattctgatttgcttggagatgttcatggttgtatctcttgtccccccgtccaaaaaaaatgtttccagtgccccttttcacgttctaaaatgaaattgacttggatgatgaattatctgatcacttgagatacagtggattgaaaaatgaaaatgaacacaccagtaagatacacagacactaaatacacatgatttagttgaaataaaagtgccatctactcactctgcacatacttttaaaatgaaagcatgactttcatgcttcaccttctctttttctcctagcaagagagaaaagcaactttgtctctttatttttaacatttactacttattgatttatgtttagatagctttaggacttttaattaatctttatttgaagacttagtggagaatatttgggctaaattttaaatatctctgtacagacaattaagttcaaataagtattaccctgacttaacttgaattattttttttaccctgctataattagagaagcataagtgagacaaacccttttctaaaatatattcggaaaaaaaattgctgtatctgtcctagaggaagtgtgcattttgtccataccaagtttctcccttgctggaatctgagtgattttgtatttcacaagtggctttgtgaagaacaatacaaaagcgtttgggtagaaaaaaaagatgtcaggatttgtaatcagaagtcctgtatttgtttctggttgcaccattcattagttcagtaactaagcgtaagcagattacctaaattctctacacttcagtttccttatctgtacaattattattccacaagcagaaaagcactttcagagtgggtgaagattaaataagaaaatatgtatgaaagggcttatcacagcacctggcacccagtccctcaaatgtcacatagcgactctacttccagtttctgtttcaatctatagcttgttatatgagaacagcttttaataacgatattttcaagatgctactagttcccaaatcaagggctatatttagtacattctccttgatagggcagaaagggaaattaatacactttcaatttggcaataatttttcctaagaaattaaagaagacttaataaataaagaagccttaattaacctggcagaccatttatctaaagactacataccctgggcattctgattaatccaaattttatatgaggctaatatcaggcaatttatgtagttaaagaccaaattaattttatttatgtgcacatactgccacgtttttcttgtctacatcatatattttttgtaagaggcaataataaactcctattcatcacatagtttatctgttctttcttccagaaacttgttatttctcccagatacttgtttatatcctgacataattctccgtatcaacctttgactagaatcaaatgttagaactggaattagaattcatacagcaaaaggctaattatcccaatttgatcattatacattgtatacacatattatcaaactatcactctatatcctatatgtatgtaaaattattacccatcacctaaaaagaaaaagaaaaaaaaggaaaggaaagaaaaaaaggaaatagtttaaatgccaatatatctaagaattattgctagaagtcttccttttatctaacttacttcttataggaacgttcctagaggaatgtctaccaggtaaatgttctctccattttagaagtcgttaaatcaagtttagcctaaagcagccccttaaatattttaaatttggcttaaagctttccccagacatcatgaactataacctaaatgaaggtgtaaacagaccgtaacctactcttgtgccaatctccaagttttggccaaaggtggtcaactgttcaaaacacgttcaaaaaaggcaaatgccaagctgtacccaatctggctgtttctgccctcagttctgttttctgagcatcactttcctttttctgtccataaatcttctaacatgtggctgtactggagtctctctgagcctattcaggctcagaggctaccagattcacaaatcaatctttgctcaaactcggttaaacttaatttggctatcgtattgcttttaacaaaatgaaatctgagttttgaaaaatttaagtaatttgtccatgttccaagcaacggaataaaaatttgaacctagtgtgttagatttcaaagactatgaatactctatacagttgacccttgaacaacacggatttgaactgcggagtccacttatacacagttttatttttttcaaccaaaagtgacctgcaagtacagtattcacaggatgcaaaactgcatagtataagaagcactgacttttcccatatgtgggttttgcagggccaactgggcacttgagtgtacatggatgtggttatcctcgggtggtcatggaaccaatccgccatggaggccaagggaagactgcatctattagtgatcatattgtatgctaccgatttaaaagtgatggcagatgtcatttctatatacggaagaattccttcataaaatggaactggagactggtagggttggccttagcagttaacagtatatgctactgttggtgactacatatgttatgtggtgatatggtttggctctgcgtccccacccaagtctcatcttgaacagtaatccccacatgttgagggaggggtctggtgggaggtgactgaatcatgggggcagacttcctccttgctgttcttgtgatagtgagtgagttctcgtaagatctggttgtttgaaagtatgtggtacttcccccttcactctctctctctctctcctgccaccaaaagaagacatgccttgtttccccgtcaccttctgccatgattataagttttcctgagacccccaagtcatgcttcctgttaagtctgcagaactgtgagtcaactaaacatttccttgataaattacctaatctcaggtagttctttatagcagtgtgaaaatggactaatacaggtggttatgaattggtacctaccaacaaggtatcaaatccattgtttggcatttctgccatcaatgcaacgatctgcctttgtacttgaaggcattttgcttctgcacagtcttctattaaggaaaatgataagccttatcacttaactcagtgctaacagttggaccccagctgatgctctgagagagtctgatgggacaccagcaaggaggacaggaaatggaacatgacagagacacactttgtctctagtttttctctaggggtaaaacaggcaaaattaacacatcttacctgtcaagtaaaattacaagaataacatgtatgtatgtaagtgaacctgtgtgaaaattcagacagactagttctagagttgtcacattcttaccaatgtgatttggactatgcaggaacaaaccaatcaattatactggaactctatatattgatacatatctttactagtaaaacaaacagggtctgatatggtttggctctgtgtcccactcaaatctcatctcgtgttgagggagggacctggtgagaggtgattggatcatgggggcagcttcccccatgccgttctcatgatagtgagtgagtaacgctgtcaatgtcacagagatggttccttagagtttctccaggcccctctctacatgtggaggaatctaatcacagttgtcaactgaggcctggcctatgtgggcagatcctcgaatgttttttcttttctgaatattactttctttcaaatgctaataagggttaggcccaaagcattttgttgtgcccttcaaataaagaaaaactacaatgcaaacattaggcattccatgttcattgtgtatgtgtcttgttttatgcattctatcttaaaatatttatttttagtcactgccctgatactcagtggctggcagttggtagactctcagccataactgctgaatgaataaaatgaattctacaacaagcttttgctattgaaaagcattatggtggtatattacatccatctcagaatttttatagctcagtgaataaagaatatggctaatgggtgtagaatttcttacaataacccagacagcactcttcagttattcttttccaatttcgttagctgaaaaccagggacaatacaataaatcacaagatatacaggaggatctaacatttgagtaatgacctgctgctggactgtaacacagcattaggagtttcagtttaatcaaacagtggttaaggaataatgggctgagatgtttcatatctttatgatgacatctctagaagtaactttttattccctttgtgttcataatttatttaatatatgccataattattaccactgatacgatagttatatttccgtgaccttcagcagaaggcggggtggaggatgctgttgtgagctgttggcttctgtcaccggctcctccaggacagcagagccacacttcctctcaagtgctgctaccacccttttctcctagcaaccatattatgttaaagtgcagttgctgaggttgccaggatattcgtctattcttgtcctccatgatcaaaccaaaggcaagagaaagtgtaaaccaaactgaggcaaacacacaggtagagagaccccgaaaaaccaaatgccagcctattcttgagaagaaataaattgagcaaattattctgttgttaatgctttaaaaatgtatcttatcttttcttttcttttgggtaaaatcaggaaacaaattttaaagacaatccacaaaagaatggctattaaacgttttaagacaaaaccacattatcattagtcagtagaagctactttttcccaatagaggaagagaggtaaacatcttaaaattgtcagagtgacctggaagattctaaaccataattaccatccagcttcacatataaaagctttgaagaggataccacatcttattgaaccaaagatatcattgattgtaaaatgtgtactgatttctggaatgtgaaaaatatgtatcttagaattattgaaacatgacacattactcatttgatatttcaatcagttgtgagataaaatatcctatgtatttacagaaaaagagcagaacccaggttttcagagtcacatagctaataaggggtagagacataattcaaatccatatctgtttgacgattatgttcaaactcatcttaattcaatgttgtttcttcaattcattgcacagatagtagataaaaagtgttattgaataacatgcttatagaactcgatagctgttgacatgtttgttatactcctagtaattcactaggtatcactaggcctgtttttataaatgggaataaccgggcctaaaaaaattgaatgactcactcaaggtcatataattagaaagtaacagagccaggagtgaaacccaagataaatgactctgaatccagaacatgtttgactaaagtcagacattaaccagctcccagatctgaaattagaacatggacgtaaagataattcaaagagaaatgtatctgttggatacataggaaaagctgttgcacatgtcagacggattcattaatttattcaataaacatttactgaatggttactgtgagttaggctctattttagtacctaggatacagtagtgaataaaatacctaaaatcacatggaacatttaagagttatagagagaaacaggttggaaggaggaggatgggggaatttatattttaaatagtggctaaggaaggtgcttgcagtgagcagagatcacgccactgcactccagcctgggctacagagcgagactcttgtctcaaaaaaaaaaaaaagaaaagaaaaggaaggcacccctgaaaaggttacatctgagaaagaaaaaggagataagaaagtgagctacatggatatctgggggaggaacatttcaggcaggaggaaggaaaatggcctggttgtgaatgtcctggctcattattgcatgaacagctgagaggctggatggccagagcagaatcagaaaggaagagcctggaaggtgatcagtaccaaaggcatgggggtggacagacagatcacactgggccttgagggccaatgtaaggactttgggatttacacagaactaaatgatgaccttagggacagcagcctcatggaattcagaacccagtcaggttcaataactctgtcctaggcatcccaaatacgtctacttcatcgtccaatttaatctcaggctacctgccatgtagttgttgttctgtctaccttgttgctgtgctataaactgtggcttattctagagagggttgacagctccatggacagctaacaaataaatatttattaaggacctattatctgtgctgggcatttagaaaagcgcctaccgcatcctgctgccaccccgggctcagcctcctaccaaaaataaaataaaataaaaaataaaaagatgatttagttgccactcacaatgagcttataacttagctgtgaaatcatgaaggtctataccaagtgttcgctgctggagaggcaagctcagaattatgatcatgccaggagtagccagagacagtttaatttaaaaaaatgcttgaggtgaggtctggcagcagtatgtaaggtgaagtcttccaagtggatgaaggcaggtaaaacatctcatccagaggtgacagcatggacaaaaacaaggaggcctaaatagcatggcttactttttaaagattcattcattcatcagtgtggctgaggcataaggtgtctgagaggtggtggcagccaaggacagacaggcagaaggaatcaggggaggagccatgcaaaaatctctagatttcattctgtaggtaatggggaggcactgaatgctttcagactgtagtgtggcatcaggagtctcatgtgaacactttggcacctgcatggaagagaagtggagcgaaatggcaatggaggcagggaggctgccacaacagtccaggcaagaggatgatgggaactgggagagcagaaacggagaaacagaacagaggtaaggagtcctgaagaggtagactgagccctggttatggatagtttacatatgggtgtaactgagaagggggtcaaggtcgactcctggggactgtgtagaagccaccctttggtaagagtatgagaaggaaaggggttactcatagagaagacaggaatgcacatgtcacgttctgatgcaggcagtttcaatggaagcggacgtcactatgaggtggccaggcaaggaatcataaaggcctcaggactttaccttagaccttaaaggatggttgggacttagaaaagtgaagggaagcatgcacagcatttcaggctgaaaacagctgaggaaaggcacacagaagtggcaaaagagaaacaattttctggggtaagtatatgggattttgcaagcaggagagggtagaagaaaagggatgaagaggctggcccttgaatggtttggggtttacattcaggactttttttttttcaggaagggagaattcactaagttcactgttttgtaaggcaactgctttcactgttgatcaacaatcctggagagtaatggtagccatcataaacatgccaatgacattaattcatagtaattatatatacatagacatggagtttccctcttgttgcccaagctggagtgcaatggtgcgatttcagctcattacaacctccacctcccggtttcaagcaattctcctgcctcagcctcctgagtagctgagaatacaggcacacccagctaattttttgtatttttagtagaaatgcggtttcaccatgttagccaggctggtcttgaactcttgacctcaggtgatctgcccacctcggcctcccaaagtactgggattataggcgtcagccaccgtgcctggctgtatgtataattctctgtcatactaggattcacagagttctacagccagagctagaactcatttctcttgatggcatctctggattaaaataatattttagtagtttggtattcataagccgggcatggtggctcacgcctgtaatcccagcactttgggaggccgaagagggttaatcacctgaggtcagaagttcaagaccagcctggtcaacatggtgaaaccccatctctactcaataaacaaaaattagccgggcatggtggtgggcgcctgtaatcctagctactcgggaggctgaggcaggagaatcgcttgaacccgggaggtggagcttgcagtgagccgagatcgcgccattgcactccagcctgggcaataacagtgaaaattttgtctcaaaagaaaagtagtttggtattcataatcactggcaccatgttctctccaaacacctaatattgtagttatgtctgaaatgtcaaaaacaagtttaatacaaatttaacaatactttatttaaatattttatttcatcttgaagcctttagctgtttttataagttaaaccaaataaattctgtaatgaatgttttatgctgtttgtaaaaaaaaaattcaagtacaaaatcaacttcttaaagcctatattatattatctattatattggggactatggtaatgaaattttaactccacccaaacacacaacttaaaaaaaataatatttaaaagtcttagctgtaaaaatatcacttgctctgtttcacctgaaatcgttgcaagtgttggttgggtacctgctacgtcttctccacatctatcatttcaaaacaaataaaacaccaacaggtgcattagctatcattacatattttcctggaatacattcagattcttttctttcattttcccttagcagcaatcaaatccctaacagctcttgataatttctcatttcttgcttcagtgccattcttgaaaacaaagccatccgttattgtgtatatgtcatttaaaaaaatcacaggtaaaaggggagctcagattgctccaaatgagtgctttcaggaaatagtgcttctcctatgatatgattggaaaccctgagttcatgtcagttatggggcaatctccaaaatatccatcctctcccgtcccccaaaaagtgccacctccttttttgttatttgaggctgcttctgctcttcattcatttcattcccattctggctgagcacattatacagcctccgtacataattttcccaaaagtttagacaaaataaaattgctgcattccatcttatcacctaatatgcatctgaggaacatattcctttaggttttctatctccattaaatgtgatctaaatgttctggtatatctcaaaattcttctgcttcagttaattatgctctaaattctcagaaatgtacctcagaatactaggaaacaagtttggcaggcaaatggcagaaatggcacagggatgaagatgaaacaggcattcattcctgggaaattcctggagggaagtcagatttccagcctgagaaaaaataagctcacttctcccccttgtgcccagaacttcagatgctatgagccatatatttccttgaatgagagaaggcaagagggtggaatctccttcttttgacctctcattccaacatttctatactgcaattaatacatttgtagtagtacaatatattggtttgaaacagactgatgtcagtttttaaaacaattaaggtgtagaaaattcccctacattccaatctgatacagccactacgcctctggtaccccttcacttagccttatgtatttgtacctaattaatgtatgaatgcaagagtgtgcatgtgtgtgtttgcgtgtagacagacagatcaatctttatagccttgctctacaaaggagtccaaatggagctctatgaaccaattaaaaaaacctcaaagaccaagtatagccatctcatgggggcaggcatttttgtctgttttgttccctagtcaatctgcatctctcagaacagtgctagcacatagtgggtgctcagtaagtaatttgtttaatcaaaatcacttactcctctttcccagactatttctataaaagccaaatgcaatcaaacattagaaacaagcaaataaacgataatacaggaagtaaatgtagtttcttactccatggtttgaaaaatctgcagctaaacgccatttttttttcatttttattatttcaacttcaatttcctgtttatccccttcttttgaatgacagttcactgttctgccttcacataagagacgagtgtatattaaaatctaccttatttcacatttgcattccaaagggtactttgccaatgagtttatgaggcaattatttttcctttaaatgttcatttccattttttaagagtatcttcttacttggtcaattgcacacaggcaacattcactagattggacatcctcttgtggaacaatctaacaaattatagtcaggaaagtctttgcttacttgtgtgtttgttttagcagccgcacatttggttaatggactaagtaatacagacaatatcacgatcaaacctcctctttcagcatggaaggaaaattagattgtattttaatctgtcctttgcaaagctgtaaatactttttatcatttcagatgcttcaagtaaagccattagaaaaaaacaatttgtaacatttgtctcacaacatctttcttctggttaggagttaaaatattagagataaggagatgaggaaaaaaaggacccatggacttggagagtgtcagggtgccatttaaacttatcatgctatatgagtctaaaaccttttgcttgtccggaaccttggggaaattccactatctctaaactgcaaacttgccccctggggccctgaggcaaagcccaacatggtgcctgaataatcaaaatttcttccaaacatgagatctaacctaaaaaacatacaaatagataaacaaatgaatccataaaaatgatatactgtttcctaatatttgtttttactttgatatggaaacattttaaatttctcaagaatgaatacaattgatattctaggaaataccatggtatttttcctgacccttctccattgataattttgcttttcacggccaagaagctccatagacccaaaatcagtgtcaagagagttttgtttggttctactacccacctcaggctgctgttaagtttcctctagttactcttctcctctccgtagttcttttaaacaacgagtccacattcaaagagatgtttggctcacttcctagtctatctccagtctttcctttcctggttctagtttcctcttcaattctgatgagcttctctctaccagcacctctgcttttacatttgtatgtcagcaacttgctttatactttaggcaattttgatggactctttactgccaacatacacacacacacacacacacacacacacacacttcaatataataagggttttgtttttagctaccaggaagggtcataaaaggatgcattgactaatgactcttagaaagaaccctgcgacattattaatgcaataatagcacagatagtctccaaaatttaaatgggcactatattagtctgttttcacactgctataaagaaatacctggtggctggcaagatggccaaataggaacagctccagtctgcaggtcacagtgagatcaacgcagaaggcaggtgatttctgcatttccaactgaggtacccagctcatctcattgcgactgcttagacagtgggtgcagcccacagagggcgagccgaagcaggatagggcatcgtctcaccagggaagcgcaagcggttggggaactccctcccctagccaagggaaaccatgaggaaatgtgctgtgaggaatggtgcactccggcctaggtactacacttttcccacggtcttcacaacccgcagaccaggagattccctcaggtgcctacaccaccagggccctgggtttcgagcacaaaactgggcagccatttgggcagacaccaagctagctgcaggagtgtttttttttttcataccccagcagtgcctggaatgccagtgagacagaactgttcactcccctggaaagggggctgaagccagggagccaagtggtctagctcagcggatcccacccccacggagcccagcaagctaagctccactggcttgaaattcttgctgccggcacagcagtctgaacttgctgggatgctcgagcttagtcgggggaggggcgtccgccattactgaggcttgagtaggcagttttcccctcacagtctaaacaaagccgccaggaagttcaaactgggctgaccccaccacagctctgccaggccgctgtagccagactgcctctctagattcctccactctgggcagggcatctctgaaagaaaggcagcagccccagtcaggggcttatagataaagctcccatgtccctgggacagagcacctgggggaaggggtggctgtgggtgcagcttcagcagatttaaatgttcctgcctgccagctctgaagagagcagcagatcttccagcacagcacttgagctctgctaagggaccgactgcctcctcaagtgggtccctgacccccatgcctcctgactgggagacacctcccagcaggggttgacagacacctcatacaggagagctacagctggcatctggtgggtgcccctctgggacaaagcttccagaggaaggaacaggcagcaatctttgctgttctgcagcctctgctggtgatacccaggcaaacagggtctggagtggacctcctgtaaactccagcagcaggggggcctgactgttagaagcaaaactagcaaacagaaaggaatagcatcaacatcaacaaaaaggacgtccacacaaaccccatccgaaggtcaccaacatcaaagaccaaaggtagataaatccacaaagatgaggaaaagccagtgcaaaaaggctgaaaattccaaaaaccagaaagcctcttctcctccaaaggatcacaactcctcaccagcaagggaacaaaactggacggagaatgagtttgacgaattgacagaagtaggcttcagaaggtgtgtaataacaaactcctctcagctaaagaagcatgttctaacccaatataagaaccttgaaaaaaggttacaggaattgctaactagaataaccattttagagaagaacgaaagtgacctgatggcactgaaaaacaacatgagaacattgtgaagcatacacaagaatcaatagccatattgatcaagcgaagaaaggatatcagagattgaagatcaacttaatgaaataaaacctgaagacaagattagagaaaaaagaatgaaaatgaatgaataacgcctccacgaaatatgggactatggaaaagaccaaatctacgtttgattggtgtacctgaaagtgacagggagaatagaaccaagttggaaaacactcttcaggatattatccaggagaacttccccaacctatcaagacaagccaacattccaattcaggaaatacagagaacaccacaaagatactcctcgagaagagcaaccccaagacacctaatcgtcagattcaccaaggttgaaatgaaggaaaaaatgttaagggcagccagagaaaaaggtcgggttacccacaaagggaagcccatcagactaatagcagatgtctctgcagaaaccctacaagccagaagagagtgggtgccaatattcaacattcttaaagaaagcaattttcaaaccagaatttcatatccagcaaaactaagcttcataagcaaaggagaatgacatcctttacagacaagcaaatgctgagagattttgtcaccaccagacctgccttacaagagtccctgaaggaagcactaaatatgggaaggaaaaaccagtaccagccactgcaaaacataccaaattgtaaagcccatcaacactatgaagaaactgcatcaactaacaggcaaaataaccatctagcatcataatgacagaatcaaattcacatatatcaatattaatcttaaaggtaaatgggctaaatgctccatccaattagaagacacagactggtaaattggatgaagaatcacgacccaacagtgtgctgtatccaggagacccatctcatgtgcaaagacacacataagctgaaaataaaggaatggaagaatatttaccaagcaaagggaaagaaaaagaaaaaaaagcagggttggccatccttgtctctgataaaacagactttaaaccaacaaaaataaaaaaagacaaagaagggcattacataatggtaaagggatcaatgccgcaagaagagctaactatcctaaatacatatgcacccaatacaggagcacccagattgataaagtaagttcttagaggcctattagggacttacactcccaaacgataatagtgggagactttaacaccccactgtcaatattagacagatcaacgagacagaaaattaacaaggatattcaggacttcaactcagctctggaccaagtggacctaatagacatctacagaactctccaccccaaatcaacagaatatatattcttcttagcaccacattgcacttattctaaaattgaccacataattggaagtaaaacactcctcagcaaatgcaaaagaatggaaatcataacaaacagtctctagaccacagtccagtcaaattagaactcgggattaagaaactcactccaaaccgctcaactacatggaaactgaacaacctgctcctgaaagactaccgcgtaaataatgaaattaaggcagaaataaataagttctttgaaaccaatgagaacaaagacacaaagtaccagaatctctgagacacaggtaaagcagtgtttagagggaaatttatagcactaaaatgcccacaggagaaagcaggaaagatctaaaatcaaaaccctaacatcataatcaaaagaactagagaggcaagagcaaacaaattcaaaagctagcaaaagataagaaagaattaagatcagagcaaaactgaaggagacagagacacaaaaaccccttcaaaaaaatcaatgaatccaggaactggtttttttaaaagattagcaaaatagatagactgctagccagattaatcaagaagaagagagggaagaatcaaatagacacaatacaaaatgattaaggggatatcaccactgatcccacagaaatacaaactacatcagagaatactataaacacctctacacaaataagctagaaaatgtagaagaaatggataaattcctggacacataaaccctcccaagactaaaccagaaagaagtctcatcccagaatagaccaatagtaagttctgaaactgaggcagtaattaatagcctaccaaccaaaaaaagcccaggaccagatggattcacagctgaattctaccagagatacaaagaggagctgatatcatttcttccgaaactattccaaaccacagaaaaagaaggaatcttccctaactcatcctatgaggctggcatcatcctgataccaaaacctggcagagacacaacaaaaagaaaatttcaggccaatatccctgatgaacatcgacgcgaaaatcctcaataagatactggcaaactgaatccagcagcacattaacaagcttatccaccatgatcaagacagcttcatccctgggatgcaaggctagttcaacatatggaaatcaatatatgcaatccatcacataaacagaaccaatgaccaaaaacacatgattatctcaattgatgcagaaaaggccttcaataaaattcaacaccccttcatgctaaaaactctcaattaactaggtattgatggaacgtatctcaaaataataagagctatttatgacaaacccacagccaatatcatactgaatgggcaaaagctggaagcattccctttgaaaactggcacaagacaaggatgccctctctcaccactcctattcaacatagtattggaagttctggccagggcaaccaggcaagagaaaaaaaataaaggatattcatatagggagagaggaagtcaaattgtctctgtttgcagataacgtgattgtatatttagaaaaccccatcatttcagcccaatatctccttaagctgataagcaacttcagcaaagtctcaggatacaaaatcaatgtgcaaaaatcacaaacattcctatacaccaataatagacaaacagaaagccaaatcatgagtgtactcccattcacaattgctacaaggagaataaaatacctaggaatacaacttacaagggatgtgaaggacctcttcaagaactacaaaccactgctcaaggaaataagagaggacacaaatggtaaaacattccatgatcatggataggaaaaatcaatatcgtgaaaacagccatactgcccaaagtaatttatagattcaatgctatccccatctagctgccattgactttcttcacagaattaggaaaaactactttaaatttcatatggaaccaaaaaagagcccgtatagccaagacaatcctaagcaaaaagaacaaagctggaggcatcacactacctgacttcaaactatactacaaggctacagtaacaaaaacagcattgtactgctaccaaagaagatatatagagcaatggaacagaacagaggcctcagaaataatgccacatctacaatcatctgatctttgacaaacctgagaaaaacaagcaatggggaaaggattccctgtttaataaatggtgttgggaaaactggctagccatatgcagaaaactgaaactggacaccttccttacaccttatacaaaaattaactaaagatagattaaagacttaaacgtaaaacctaaatctgtagaaaccttagaagaaaacctaggcaataccattcaggatatgggcatgggcaaaaacttcatgagtaaaacaccaaaagcaatggcaatgaaagccaaaattgacaaatgggatctaattaaactaaagagcttctgcacagcaaaaaaactatcatcagagtgaacaggcaacctacagaatgggggaaaatttttacaatctgtctgtctgacaaagggctaatattcagaatctacaaggaacttaaacaaatttacaagaaaaaagcaaacaaccccatcaaaaagtgggtgaaggatatgaacagacacttctcaaaagaagacatttacacagccaacaaacacatgaaaaaaagctcatcatcactggtcattagagaaatgcaaatcaaaaccacaaggagataccatttcacgccagttagaatggtgatcattaaaaagtcaggaaacaacagatgctggagaggatgtggagaaataggaacgcttttacactgttggtgggagtgtaaattagttcaaccattgtggaagacagtgtggccaattcctcaaggaactaggaccagaaataccatttgacccagcaatcccattactgggtatataccaaaaggagtataaatcattttactataaagacacatgcacatgtatgtttactgcagcactttccacaatagcaaagacttggaaccaacccaaaggcccatgaatgacagactggataaagaaaatgtggcatatatacaccatggaatactaagccaccataaaaaaggatgagttcatgtcctttgcagggacatggatgaagctagaaaccatcattctcagcaaactaacacaggaacagaaaaccaaacaccacatgttctcattcataagtgggagttgaacaatgagaacacatggacacaggaagtggaacatcacacaccaaggcctgtcaggaggtgggggactaggggaggggtagcattaggagaaatacctaatgtagataaggggttgatgggtgccacaaaccaccatggcacgtgcatacctatgtaacaaacctgcatgttctgcacatgtatcccaggacttgaagtataataatttaaaaaaagaaaaaatataaatacccgagactgggtaatttataaaggaaagggatttaattgactcacagttctgcatggctggggaggcctcaagaaacttacaatcatggcggaaggtgaaggggaagcaagcttggactttctcacatggcagcaggagagagaagaatgagagtgaaaggggaagagcctcttataaaaccattagctcttgtgagaactcattcactatcatgaaaacagcatggggaaaaccgcccccatgatccaatcagcacccaccaggtctctccctaaacacgtggggattatgggaattacaaatcaagatgaaatttgggtggggacacaaagcctaaccatatcaggcactatcaaacaatctcatccaatatgagaggaaaaggggtttgccatgatataggactctttgtactcttcccacttaggctccgccccttataatcatgatcaattcatattagtaccattaatattagtactcctgcaccttgtgagtggacagaaaagtatacagagaatatgtgctcttcctccaaaccccagtgttcttgatattctcaggacaaaattatgtccttatcataattatcatcttcttctcagctaacattttaggaagcatttactccatgcccaatactaccatcctatttattatcacatcagtactgagctgagttctttcccattcataaaacattcattccttcaacatatcaatcactggcactgcttggtgtactagcttacattctagtttctggaatgagggagactaataataaatacaataatttaacagagcagtaaatactgttaaataaaatggattattgttagagagtgagagatatgaggagggatgaagaagggaccacattaggaagacagttcttagagtctctttgaagtggtgacatttgaatggaaacttgaatgatgagaaagactgggggacagcttgttaggcagagggagtggcaagtgccaaggaaaggaggttgcagggcacttggtgctgtctctcctcacgttcatggaactatccttgcatctcctctcttggatgtcctcttccctaatgctctcttatgctgatttttcacacccaggagtattcagatgcccatctggtctatgcccacaagaaatattactgccttattggcttttaccaacctcatcttaatattgcacacttgaccttcaaggccttaaagaaacagcaacttaaagcaaacctgcatcttcagcagaaccactgttcatcacattgtctaacatgtcactgtctcttatctaagaatgtatgggatatactcctcatagaatttagtgccaggaaacaaaaattcttctgaagatctgttttccttcgttaaccaatgaattataggtaatctttcctgttatccttttattttggctgccaggaaccacatagctaaaacgtagtgctcctattacaaaaatgatcttacccaggttttgtggtacattcactatttcccccatttatttctcttgatggtttctcatctttattttgtttttactgccttgtgtgaaagtgcttttatttaagctgccccaaactttttggaaatagatgatgtataaatcattaatcaccaagtgcttttaacaatcacaagtaacttcctcattgcaaaatctgatgtgtcatcctggtcttgatcttactcaccctttctgccacatgacataactcactgatcttctttctaatctttggtgtaggattattatacatatgaataaaactggtaaaaaaaatctccacatcctcggttttatggcatattacagtgtcttcattctctttataacacatttttatcctatcttatgtatgaatgtgtacatatatgaatatatgcatgtatacatgtatgtatgcatgtgtatatatttagtttccttctttttccacatgcccattcatgcagatatgctccaggattctattctaagctcacctgctctctgctctctctcctttgacacttttctactattgttacctgtatgtaaaagactttcaagttttatttctagctctagtcattctcttgggtttgcagtccaaattctctggtaccatctggacctcagagttagaatgaggccttgtagttcattcaccctcccagtcattgagtttcctccatgacatctctgccaagtatttgtccaccctacattttttcagtgacattaaacttgctacctttcaaggcagcttacctaaccagctggctatgactcttaaaagttatttcaagccgggcgcagtggctcatgcctgtaatcccagcactttgggaggctgaggcgggtggatcgcctgaggtcggagtttgagacaagcctgaccaacctggtgaaaccctgtctctactaaaaatacaaaaaaaattagctggctgtggtggtgggcacctgtaatcacagctactttggaggctggggcaggagaattgcttgaacccgggaggtggaggttgcagtgagccgagatcacgccattgcactccagcctgggcaacaagagcaagactccatctcaaaaaagaaaaaacggttatttccaataggatggcaacatctttgtgatacatgtccgctgattctaatgctattcctaaggtaacaataagagctaagacacattgaatatgaaatgtgttccaggggcactgcacatattatctctccacaactctgcaaggtggttttattattttcatcatatcattgggacaatttagaatgtataatctttttccacggcttttctccaaatggtgaaacacacatatcttccagggaaaccactgtcttccaggttaagaaagtacaaattcctccaaccatgtctcacacaaattattttgttttgtaagtgaatttcaccacctatattcttgacctctaaccatggtgtcaaaaataagttcaaaataacattgcaattgtgacttggatatgcagaatagaacgtaacgattgccaacttcattctggacgctatatggctctactgacatagcctaagatcatacttgttacttcctacttaatcaaataatatccctgaggctttttaatcaatggcgtgctaaacatctgcaagaattctgatggctatgtcaaactactgaactcaacttatttcctcactaacctcttcatgagtttgacttgtccatgtcttatgacatccttatttcccagactcataggctaaaatgctccctgacagctttatagctcctcttacatcttctagatctttttgttcaccaagtcttgaaggctctgactcaaacattttctcacatcatcatcttcccatggaccctgccttttgctgtttctcagtttaggcctcttctctcacctggacagctgaaattgtggtgttcctacttcccttgaccgcccccctgcatggactgatgaagcgcctgtcccatagcacagctcccgcccggtaatcctccgcttagagagcttcagcagcactctgcctagcaaggaaaattccacctttttactctgatattagcagctgccagtatatgtcttcttttttagccttatcatctagtgatttcctgcgagtactgtatgcttttgaaatattgtgcacaaaatggttttaattttcctgattctgcatctatctttatttacattgtttttgagcctggagacacctttctttgtctgtcaaaattctatctttcaataatccgagaaaatgtcacaacctctatgacacttttgccagatcctggtctagccatttaaaattaatctcatgctgctgagttctcacagcattttagttctctcctagaatataataataacagaaatttacatataggtcttatctctttattctttaggctccctcagacttgttcatgtttttttttttaattttgctattctttggtacagagtaaggattgaattacacagcacattaattaagaaaaaggaggcagaaaacagaagaggtaaaactgatgagtagcagaaactaaagaaaacttggaaatctaatgcaaacacttggaaattcagacccacacaggctgtatttaccaatgcaccgaaagacttttctctctttcctttgttgctgcctctctctaacataacattttagactgtatcctctgaactctactttcaggaacataacctatttctttttccctaaaatctaaccagactagaactctcttgggggcaacagtcagaggccagcacaccaagtgccaaagttgattttggttgcaatcagccacctcactgagtaactacattcagtgatcctactaagccataaatccacattctcttaaaaataatctcagtggcaatgagcagacaagcttttccaagctcacttgttactcccccaaagtcttaataaatattttagatattaagtcattgcaatgtcctgttgctcaataaaaataaaaagcttatcatacacatttattcactgctgttattttgaaacaagacataaaggtctttacatcacaaagatacagttgattttatataagatgtactcgaaatagttgcatttagaaagaaaacttgggaatagattctttatcaatgtgattgaatttcagtatcacctacgagaattttaaactatttaacataacctatgttaggtcaagaaaagggcttcacattttttccttcctggaattaacatttatttaatggaattctaccttacgaaaccccacttgcattacccagatgttcagtcaatgaaattactgaattaatgggaaaaaattaccttcttaagattaggtcacatgaattcacaaaactggaagtggttacataatatagcagagttacataataacgtattgaatgatattatactttaagatataatgagtttttaactaatagtcttgttttctgagcccagccttcctgctttttacttgactctccttctcatctcatttgtgcctccccctctattctcaagtatgtatcctttcttcctgaatatttggctatgattacgtaggcaccatatcagttgtttcccataaataaaaggggaaacatacatatatgcatacattgacacataaaatcatcttttcaaaatattacattttggagacaattccagtgtgggaaggatttctctattgtttggttttgagtactcaaaatgataaataaatgtaactttcaactaaatccatcatttatataaacataggtgggtcattagacattgaatttactgaaagtaatttagtttaaaatgtttcttcatcagtgaaaattgaagttactggacttgagtagatgaagaaaacatggactccaatagcttgagtcaaaattgccaatattatttactgataaactagcatagaaattacaatcagggcagtttattcctaccagaagaaaataagacagtagggttttttgtttgtttgttttttcctggcagatagaacatttgagctcttgatatgttttaaatttcaggcaacaaaattatgtaaatatcctaaaattacataaaatatgagtaaacacctatttttctatgaactattagatgtatgaaaagcaaagatgctcctttctcctcaatttatctatttagaaatactaataacaataataatcataagagagtgtggggaaaatcaaatgtcaagcctcacccaaacagtaggtagggaaaatgttagtattccaattcacaatgaagccttttactccaatgtacattggagtaaattggagtatttaatactccaatgtacattggagtacattggagtacatcagagtacattggagtatttaatactccaatgtacactggagtaaattggagtatttaatactccaattcacaacacggcattcagttaatcataatagtttgtaaattatataggtcattgtattgctttatagcatgtctatgccttagtgccctaataaaagacactagttttcctttgcttttatctagtgaattttgatcatactaaactcataggtcacaggtaaattactgtatggtagtgctgagtggcaataaattgagaaagaaataggttcaaatcttacattagcatacatttttacttattaagagcccggtcaaagatttaatgacaagaatgttaaatgtagtggctgacaggagtgctgagcttaccttcaagttaattcattcctaatgtcaatgtctttcatttccatacttagatatattaactatctattcatcacatatttctagaacgggtttgaagtcttcactctgatcttataaatcatacaaaatctttccagatcggagcaaatctaactgctagatttagaaattgccctagtgattttaacaagttgatattggagatggttttctttctcaaacttaaatgtatttattcttcatccaaactgaggattctggggttttggtcaaggtactatattataaacagattgtaatcaaagatggaactgcagcagtatcaggaaaaaattctaaaatattgctagtgcatgggaaatgtggacccggaagaagggcagggatctcactctccttcccttttgttcatcccctacaccagcgttttagaatatcttacattacaatgattacgcagggtagcctacaagtgagaggggaaaaggcatagtacagatgtatgtacacattttctttatttcaatgagaaggaattgggtgttgaggtcggttcacaaagagggttaagcctccagtctgttgttgttctgatactatggtggaggttgttaaatcatccaccaacagagccacttcctgcttttcttccccttatctctgagtctctgcttagcagcttgcttgaacattagttgtagaggctcctaaattttgagatcaattggtctattgctaaaccctaaggaaatcattgcctattactcccatgttgtatttagctatgacttcaaagcttagaatgaccagtactcactagataaaagaaaaataacttgaagaagcttatatgtgaactccttgtggaaaggggccacgtttaattaatctttgtatccaaaaatatcacacagcctagcacatagtgggtgctcaaatatgtttgtaagcaggttggtgaaacaaactagtcaggaaaggataacacacgaaatacatggagaacaacctaaacattaataaggaccaattagttaagacaaatactggcacgaaattaaaaccccttcaagcccttattgtttacatgatgtttcttgtacctattttgatttattaagtctaatacaatacctaacacttccatactgagtaccaatatatgaaagattttatagacataatttcttttaatcctttaacatttttaaattgtcttcagttttacagataatgatactaaggctcaaagaagtgaaggctaaatccctggttatttgaatctaaaacctgggctctttccaccaaattacattctctgcttttaaagtctccttcttttaagggcaattttccataagcttttttacttcatgtgaattaaataatatggattgctgtgtttcaaatagcaaactttcaaatatttgttgagtttgattaatcaaatcctgaaaaaataggagagtttagggtaataggacgtggacatagggtcgtctaccaagagccaaaactgactcataaaatctgtagattacatgacttatcataaatacaccaaaataacaggctcccacctttcatagagactggaaaatagagaaagtgacaactttcacaagagacttcactggatttaactcactatattattgggaagattcaagaaaatttttaaaatgaaataaacactcacctgctcattccatttatgtcataatttcccccaggttgtgtctgttttactgtaatgccatggctcttgaattataacctgtgtatttcaacagccaatcagcagtactgtactgtgaaaagcctgtgacccaagataaggaagtaaatatttgctttgtgaaccacaatcattgactacaatagaattatatttactgacacagggaatttttaaaaatctcacatacaaagcttaagaaattcagtgattttagatatttattaatcatgctagaatactaagtataaaatacttctataatttcatgaaaaagcctgcatatctaataaatagtagagtaaaaattcaaatccatttctatttgaaatagattttattttccaccataggtcattgcttctcctatagggacctcccatcattataaattctgaattactcaggttttactgtatttgataaactggtaccactgatgattataaaattttacactttcagctgggcgcagtggctcacgcctgtaatccagcactttgggaggctgaggtgggtggattgcttgagcccaggagttcaagacaagcaaaaccccgactctacaaataatacaaaaattagctgggcgtcgtggtacacacctgtagtcccagctcctgaggtggcaagatcacctgagcccagggaggttgaggctacagtgagccatgactgagccactgcactccagcctgggtgacagagtgagaccctgcctcaaaaaacaaaacaaaaacatttatactttctagatagtttaatacctaaggactttatagattttccaagctagataattaaacttttgaaaccaaatttgtcaaaagttatagaacttaaaaagtcaaaaacaggagcttacaagaccactgaatcatgtgaaacattgcagatacagagctcgttaaggtaacacattaaattcttacttttaacatgtgtaaatttcacctagagcttagtagttgaagtaaggtatgattctaacctgacatggttttataatttagcttaactgactcattctgatgagaaatcaaatgaatgtccctatgatctctatgtactcccatctttcctttcaacccctttatctcagaaaaactcagaagttcttccataacattggcaactggcagaaacaatccacgactatctgggaactcttcagacacaagcttctcatagtaaggtgtttgtgagcaaattgtttactgattccggacttctaaaaagaagtgtaaaggttggaaaactcaggggtgtagcagtatatgatgaaccccaatgccctggctgatccagcttttctggtttagccacagtgatctttgtcactgagcatttcctttccttgtttgcttctgccttttaaaaaattaatattagcactcaaacaaataagaaaaatgtaccagaacagcagtggaaacacaggctaaagacttgaacgagccatcctcaaagacaaaaactgcttatcagtatgtcaaaaagtaatcagtcttattggtagccaaagaaataaaagtttgaaaaatattattttcacctatcaagttagcaaagattttttaaagaatggcattatgttggcaagaactagctgttctaagcatcgtgcccaaaggagaaactgcaatagagatacgcatacaaaatttaggcatgaggatcaaaatccaaagataaaagaatggctaaataaagacattcataaggtgaactatatcactaaatcgcattaaaaatatcaattttaatttcttgagaaacagcaacaaaggaatgttaatttttttagaaatatgaagttctaaaacagccatcccaacctttttggcaccagggaccggtttcatggaagacaatttttccacggatggcagtgggggtgggggaatagttctggaatgaaactgttccacgtcagctcatcaggcattagattctcataaggagtgcacaacctcaattccttgcatgcgcagctcacaataggggtcacgctcctatgagaatctaatgccagccgctgatcagacaggaggaggagctcaggaggtaatgctcacttaccagccactcacctcctgctgtgctgctggcttcccaacaagtcatgggctggtacccgtctgcagctcaggggttggggacccctgttctagaatatgattcaaattcttaaaacaatggtacgtttatataaagcaaataaacttgtggtaaaccatgctgtgttttcaatagcagttctttaggtattgagataattataagcactcagtacatgccaagcactatgttcagtactttatatacattgcattgtatttatgcttgcatcctgccttcatccctcttgtatgtctgaggaaactgaggctcaggacagattagtaacttgcctacagcaataaagtttttaaagggaggagccacaatacaagctaaagccagcttgacccaaaattcatgctcttcacatccatatctgcctataggtaattttgtatcgtaggggatctaagataagcaaatatagagcttttataattgggaaacaaatcagtaatataaatgttgtattaaacacatatatattcccaaaacgacaattctgaaaattgcttcctccaaagatgtaggaccataaacacgagttttaggagcccaactagtgtacttggtaaacagtgtaagtgctgattttaaaaatgcaattcttaccttggaagacttttgcgagccatgtcgaccctgcaaaatttattaatttaggaaaaattattttacacctgcctttgccacatactgtgccaggtgctggcacaatagcaggaatgatcgtctaaatgaatttctttggaagttaggaaagtgtctttttttcagagataagtgtgggtagggagagaaggaaggtgggagtatccatcaatctcacactgaaagtcttggctacctattggctacctatagcaaaggattattttaaggttttccataaaaatatatttgtctgaggacccttgacactcccttggaaatgtcatataattttacgcctccacaatgcattcacacttacactctaactataccaatcaggtgaaataaaatgcttttaacatcacatagcattattctcaacctctgggtatatagcggtccttcgatttgccctctttggtagtgcagtattctcagtgttaagtaagcagagttggagagtatcagaaacaggattctcagcagaaatgtggttgaatggactcccagccctcttggcatcgtacctcatcatccatgcctaccttccttttccaggaaagcccatgtattttagcaaacggacttctgacacaaaggccattatctctacggctttagattaaaaggtaaaatctttcttagactttactctgcaagtcaaccagaattttgatcaattcagatttaaaattttcacttttacttggctgttacagtaagatcaaacgggtaagaatatatatttctccttttcttcaaagaccgtggccctcgtggtaggaaatgttaaggaaggtttattattattattatttattattatgcaaaagtataaaatggtcacaggaataaggaacttagaccttaaacatgatgaattcaaataaataagtacctcagaggaagagccctacaaccaaagagatacctatttgagaaggaaatgctgtttgccttagaatgaacaggatagtaaattaactctccttgttaattcccttccgtggggactaaacgccaaggagtagttgcggaactatagcaaaaagggtcgaaatcaatcagcataacagacaccttatgttatttgttctgtaaattcgacggttttcttaatcgttcagactaatttcaggaggaaggatgagtgcccctggctctgagatcacgtgtcattgccatggagatttatcttatttaataagtaataccactcaatctttttgtaataacgaacacttcttttcttgttacctcaaactaaataaactactctcctatggtggctctaagtgcgggtttcaaaagactataaaaactagtgaataaatccagtctcccatgagtgtgctaattactgttttagttcatgttaacagaagaaatggcttaacaacagtaacaactggaggaggtcaaacttctcattcatttgtattaaatcacccttccattagataggagtgctataatgcatatttcttggataatactctcactacagaagacttcggaaacaagtacaatgtactttaaatgtttcacggtttgcaaattatttcgtacacgcagcgtctggcagttgtgaatcgaggaggaaagcattattttccactacactaataaaaatcaattctcacgtcttcaattaaatgattttcagaagggttcatcacccggaaaaccagtatgtatgaacgccggaaatgcagatggcacccagcctcagaactgcttattctagatgggaaccaaactaagatttctctttattatttgtgaaagccatcccacgctggagagaatctcgccgtaaaacaatttaagaaaagaaagaaataactctgaagagtgtgaagttctccagacaaatcttatagtgaatcttttgaaagaagcatttatggaaaggtcaggggaggtcaggagagttatgccaggagccagggtcaatcgtccccgggcgacaggggttctcccacgtgaaccgacgtcccgggctccgggcgaggcgcagggctcagggcgcagggcgggtcccgtacgcagggcgggcgcgcgggcatctttgtggccaggcgaccccggctcgctctcccggagcccagggactcccgaggctggcgcgggctgcccgcgacaaggtgccagcagcctcgggctcgcgaggagcagctcccacccgcggcttccgagtccagctctgtccctccgccatcccctagtcctccggcatttattcagggagacagggaggcagagagaagaggagaaagcggccgtgtctgcacccagcctctgccgcagcactcgatgagggacagcagggaggctggcggggaggcagagattaaactatgattccatcgatcacggaaagaccaccatcacctacagcaaaggaggctccgatgcgcccacccgggcagcgactcgcggttggtgggcgttcctcgtcctcgccccctcggtggctgtggaatccaccccgcgccgcacacgccaggactccctttcctttgactaaggggaggggaaggaacaaaagagaccccccaccccctatacatacatacacatacacacacacacacacacacacacacccctccggtattttactgctggtcaaaggattcattttcgcaacctcttcttcgaacaccttccccacctgagcagtgcattttcccaaaggtaaagagagataagggaggaaacacagcacccaaggtgatcagtcgattggacactgttgatggcacattctcctcgttcccaaccaaccgcacaaaacccgcaacacctcgcgtccccgcggggtctcccgcgcccctggcccggccctcccggccgcccccagcaggcgccccgctctccgcgggaactctgggacctggccgagcgttccccggcgggcaggacactcgcccggttccctgcagcagctgagggcggcgagcggaccgcgtccaggcagcgacgcgggattcaacttcccggacccgcggcgcggcccccgctcccgctcagggcgccgcggccacagctgagaccccagcgccgcgcagccgcccccgccggggcatgggcggtcgcgctctccgccccctccttccttcacctcccccctaccttgaaaaaaatccatccattggtgcaaagcagacattttgatgtcatttacttagcaccgcttgttttggaggcagcgtcttacccggtcgcctggaggtgtgggcagcgcgccgatgggtccgggggagcggggctgggcggctcggtcctctagcggagccggtttgctgccatccgcccaacttcagcacccagcgggcgaggagagagggagagcggcgaggatgcagaggagggggagggggaggagggagcggtgggcggggagggagcgagagccgctcggcagcgcgcatgcgcctcgcgggccggcgcagcccctcgcccggcgcggccggaggggcagcttcccagcccctgcgcgcggccgcgagagtcccggccccgccccctccccgggcggcccccggccccgcccgacctcgcgcgctcgcctgggcgcggcgcccaccgtgcggaggggctcggccgggactctcggcttcggtgacgcccgtccggagcttcgcgggaggcccggagtcccgagagcttccctgggtgacagcggctctccgcccgggcccctgcaactccactcgcccgtagcccgcgcgctgctgtcctgggctgcgcgggagccttgcacccaggagccggcctgccaggcacagcagcctgcctgctccgggtcccggaggaagcattccctgcgtgggggttcaaggaagtgtgaagttaagcaagttttgcttcccgaaggactttatgaagcgtcctttactttattgacttcctcgcccagaaagaggaccttttctcctaagaatcagtgcaggtgctctctggcctagcccatgccagctgcctcaggcgcccggaccactcgctggagcagagttttgagtgagaaaagccgatgacaaggcaagagtggagaattattaacggaggtgctgatgcttggggcctagagcatccttaggggacagcttggtagttaccaggtctgataatcgttctgtgcccaagtggagcccagcttggtagggaaggagcttgggatacttaatgcaacccgagcgctagattgcatctccaatgattagactaaagtgtttgtgcggaggaagtggagaagcagtgtcttgctcttcagataccacatctgtgggaagaggagggagttcctgcaggagtgaatgggcttttttttcttacacctaattaaaacagattacttgtaaatctgtgtgagttccccttccttgtgtgttcatgtaagcaagcgttgtgttatttcagcctactgaactctcctgtgcctccatcctcatagactcacgggtacttgggttaaatatgtctcagggcctcctccagggcctcccatggctttgagtactagtgctcttcaaagtgtcttcatttttgttggatttcacagaagtatttgtctttgtcttccaggctgctataacaaaataccatagactggatggcttataaacaacagaaactgatttcttacagttctggagactgggaagtccaagatcaagatgtaggcagataccttatttggtgagggcccaattccgagctcatgaactgctgactccttgctgtgtcttcacgtggtggaagtgagcaagggagctctctggggtctcttttataaggacactagtcccattcatgagggctccaccctcatgacctaaccaccttccaagggttccacctctttatatcatcatcttgagggttagaatgcgaacatacgaattttggagagacaaacacggctagtccactgcagtattgattcgcggtggataaagataaaagttcttcaccaaaaatgatttgagcagcgttgaatcctatataactttcagatttatgtcttcagtcctgtcctggcctcacacagaactcttatgtccttcactacctttacatctccacttgaggaataattgtcgtagctggtatttattgaacaattactacatgctaggtacagatctaaattctcctcatatttcgtattcgttgttcacaacaaccctacaaggtagatactattattatcatggttaacaggcatctcagaagcggaactccggatatccaccccctccaaacctgttcctcctcaaattgttctactctgttgttcattccaaaaatttagaagtcatcctcgttttgttgctttctttcatccccgcactcaattaattagtcatgttttcttcacctccaaaatatatttccaaggtatctactttgctccctctctactgccataaccttagtccaagctattgtcatctctcacctgggcaaccacaaaagcccctattctgtctgctcatttctatcctccacaaccccgaacaacaccctcctaatgagaggtgacagcgtgccggcagtcctcacagccctcgctcgctctgggcgcctcctctgcctggactcccgctttggcggcacttgaggagcccttcagcccaccgctgcactgtgggagcccctttctgggctggccaaggccagagccggctccctcagcttgcaaggaggtgtggagggggaggcgcgagcgggaaccggggctgcgcgcggcgcttgcgggccagctggagttccgggtgggcgtgggcttggcgggccccgcactcggagcagccggcaggccctgccgaccccgggcaatgaggggtttagcacccgggccagcggctgcggagggtgtactgggtcacccagcagtgccagcccaccggcgctgcgctcgatttctcaccgggccttagctgccttcccgcggggcagggctcgggatctgcagcctgccatgcctgagcctcccaccccctccatgggctcccctgcggccggagcctccccgacgagcgccaccccctgctccacggcacccagtcccatcgaccacccaggggttgaggagtgtaggcgcagggcgcgggactggcaggcagctccacctgcagccccagtacgggatccactgggtgaagccagctgggctcctgagtctgctggggacgtggagaacctttatgtctagctcagggattgtaatacaccaatcggcgctctgtatctagctcaaggtttgtaaacacaccaatcagcaccctgtgtctagctcagggtttgtgaatgcaccaattgacactctgtatctagctactctggtggggccttggagaacctttgtgtctagctaagggattgtaaacgcaccaatcagcgccctgtcaaaacagaccactcggctctaccaatcagcaggatgagggtggggccagataagaggagaaaagcaggctgctggagccagcagtggtaatccactccggtctgcttccacactgtggaagctttgttcttttgctctttgcaataaatcttgctacttgctcactctttgggtccacgctgattttatgagctgtaacactcaccgcgaaggtctgcagcttcactcctgaaaccagcgagaccacgagcccacccggaggaacgaacaactccagacgcgctgacttaagagctgtaacactcaccgcgaaggtctgcagcttcactcctgagccagcaagaccacgaaccccccagaaggaagaaactccgaacacatccgaacatcagaaggaacaaactccagacgcgctaccttaagagctgtaacactcaccgtgagggtccgtggcttcattcttgaagtcagtgagaccaagaacccaccaattccggacacactaagagctgaaggatcttttaaaaacaatcagaggccgggcgcggtggctcacgcctgtaatcccagtactttgggaggccaaggcaggtggatcacgaggtcaggagatcgagaccatcctggctaatacagtgaaaccctgtctctactcatacaaaaaattaggcgggcatggtggcgggcgcctatagtcgcagctactcgggaggttgaggcaggaacatggcgtgaacccgggaggcggagtttgcagtgagccgagatggcgccacggcactccagcctgggcgactgagtgagactctgtctcaaaaaatataaaaataaaaaataaataaaaacaatcaggttgtgtcataccctttcttaacacgctcaaatgagttttttttttcattgcacttcaaacacaatttgtaattcttaagacagcctggaaggttctatatagtattgtccctaactagttatcttataccacgcttctgtagatcatagctagtgtgttttagccatgtagacctgcttatttgggtttcttgaagaaatctaacttgtaatatttgctgttctttctgttgggaatcctgtgcaccagatctttgcatagcagactccttaatatcacataagtgcctccggaaatatcacttttcagaaggcttcatctgaccacccaatctaatctgccccagcgagttcttttctgttggatccccttatttcattgtctttaaaacacttcactatctgaatcagcttggattcatttgtttgcttattcattctcctcagcccctgctaaagtaaagaatctcaagagctttgctttcacttttcagtgttttatctctagtgcccagaacaagatttgacacatagtatatgcttagtgaatgaaggatggattgaaaaaataacaaacttagaaaaagtgttctttattgtttgctgatgcttcttcttggatcctaattgccgcctttcagaatctgttgcttttcagaagtgaacagatagaccacgttgtttcctctgcccaacctatcacagatggtgccatgatagactacactgtttcctctgcctagctcaccacacatggctgcatgcaggggtgctcctttaaactagatgatagggtaaggttcccagaacccacttttaaaacaagcatattcaataaaaaagggacccttccataaattcttataatggctatttgggcaatttttatatgacaacttggctattctgctattcatttaattgcttaagccaaatgtaaccccttggtgactttctttcatggttgtagttttttgtgtaatcccttatgcatgagccagaatctgtaataatagtattctaggactgaaaatgttgcctaccatctgagagttgactagatgggtggaaacaaccacagctttaatgacattcaccttgtggagtctgatcacttgcagtccctgtgtatatcttggtggtatggtttgagtttgttccctccaaaactcgtattgaaatttgatccccaacttggtggtgttgggaagtggggcctagcaggaggtgtttgggtgctgacggtggatccctcatgaatggcttggtgcagttctccaggtagtgagtgaattctcacttggaggagactggaaaagttctcatgggaataaacaagttccctagaggggagattcttacaaaaccaggatgctcctcaggccttgtctctttgcatgtgtccacttcccctttgaccttctttgccctgttgtgatgcagcctagaagccctcagtggaaggcagggccaggcccttgaatttcccagcctgtggaactgtgacctaaataaacccgattactcagtctcaggtattctgttgcagcaacacgaaacagaccaggacacttggtctagggagttatctgcaaccccactgacatcaagtgatgaccagatcaataattcaattcagtaaacttcattaatatctactatatgcctagtattatgtcttcaaattttttgcaaaaaatgtaaatgttatataaaattatcctacaggactcagaaatggatttcagttcattttggcaatggggatgccttctctttatacagaatttcagagctcactgggccagtcatcattaaacagctatgtggtaattatgaaaaggagcatttgatcatgagcatttccctaccataatgaatgtgtttttttttcaagtagagaaattctggacacagcagcagtttaggtataatggctttacagtaaggcacgaaggagatttgcagagaagatatttgcagacagaaaatattgcaaaagtgcagactatcaacatcaaagtatttagtgtacatttatccataattaggaatatttgtcattattaggagagctggaaattacctcagtgagtttggtaccctacaaaagtatttccaggaagaaactatgtagcattttaaaatttcattctcttttcctacatgcttatttatttaaaagaagctgtttttcctttgaaaagcagagggaaaggaaattaattgtttgcttgaatctagaaaaccctgactgctccagccaggcaaacttctccagagtggaatgtggaaggataattagaacatgactgcttcagcagacttcttctatacttttagtaaatagagctaaacatgtttctccaactgattttaatcaaaccattgagacaggttcatcccagggaacttatttagatgggaaatacttgtgtttcttcatcagtattcaaagaagagaagagaaaagagaaaaaggaaagatagtctgttccccaaaagctaaaaaatgaaatatagaattttatattttctatgtaatgtacttaattatgtttttctgttttttcttttactttttttttttttttttgagaagtagtttcactcttgttgcccaggctggagtgcaatggcacgatcttggctcactgcaacgtctgcctcccgggttcaagcaattctgcctcagcctcccgagtagctgggattacaggagtgcaccaccacgcctggctaattttgtatttttgtggagacacggtttctccacgttggtcaggcaggtctcgaattcctgacttcaggtgttctgcccacctcagcctctgaaagtgctgggattatagatgtgagccactgtgcccggcctgtacttaattttgaataaatcattagctattaatgttcctttgtttaacttaccaactttgaagttaaaaggctcactattactctttcagaatagtgctagtaaatttatatctcaaggtaattgagtgagtccctagaaatagatataaacatctttatgggattttaaaaatcatttatgcccaattttgtatatcatatattcccacaatattcccacaatggcttgacaatgtagagttggtttggggtcaccctaaatacttcataaaagtattctttagatggaccctgcatattcccattcagcaaacctatcatatctatcatattgttggataacagtcttccttggaaaataaagcaaaattatcttatctagagaacatgacaatgtttaattgttgtagtcagatttgcctagtatttcaaatatctgttttagtcaagagagtcaaataatttggaaaaaggggattcacaagtatcagggccatagttcttgaagaacccccacactgttgttttccctccaaaattagtactttgagaacaatgtattcacttggtgaataagcttgggtaataaaaagttgacttctaaattcatttcttaggatttgatacatacattggcatattaacatctctgaaaagccccttgatcaaaaaaaggcacaatgccttctaaatacacacaaattctctctctctctctctctcacacacacacagacacacacacacacaccacatacacacaacacacaatagaaccagaactcaaccccttgctttctacagaccttgattcaaaatatcaccttgtcagcgaggtcttctttgtaaccctacatataattcctaaccccttctagcttacatgcacacatacatagatatatacacatatgcatatatatgtggtatcaaggatctcaattttattgacagtgtaatctaaaattaaaattaacttcagtcatagtcagaatctgctctacacagatgtgtactacacctctagttttcttaattcattcagccaatatacgctgagcatttattatgtggctgtttggcaggctctgtcccaggtactgagaatacagcaaggaacaaaaacaaacaaaagtctctgcccatacagggcttatattctaaagaggtagacagacaaagatcaatgtaaataagaaaaaaatatagaatttgacaattataaatgctaaaggaaaaaagcaggtcaggaaaaggggataggaagtatgtatgcatgtgagtaggaaggggttatgaattacatgtaggggtgcaaaaaagacctcactgagaaggtgaaattttgagttaaggtctgaagaaagcaaggggttgagttctggatctctggagagagagcattccagcagaggaaacagctggggcaaaggccctcaggtcaggttatgccagtcatagacaaagaacagcaaggaacaaatgaagggagtggcaagagatgatattagagaaaaggaaggtaattatgtaccacctttagcttaggaggttggcttgtactctgggtgacttggagatgtattaaaggattttcactgaaggactgccgtacaaaaaactgctaaatgtaagtaagaaagagacaataaccaaatagaaaatgaggcagaataagaatagaatgatgctggctactgcattggggataggctgtatggggatggacagaatgcggaaggcgctgggctattggagttgactatgcgggggatgatgatggcaaggaccggagtactagaagtgaaagtgttcaagagtagtcagatgctggagatattttcaaggttgagtttgtaggatttgctgtttggatatgtggcataaaataatttgaggaatcaaggaagacttcactggcatcggtctaatcacagaaactttcctttaataatgatgtgcttgaattcctgctcctagagccctccagtccccacaactgagaccaataaattcctgtgaataggcttaactcactgtccctgccgggctgccaggtataaagagaaaaagggattccagacaaaggaaattcagagggacctaaagcacagcctggcggctcagcatctgtcagcctcttatactggtgcagctcgggccttgtaccccagcttcagaccttgctctcttgtgtcaatcctcatgcctctgaatgcccatttttgttgtctgggataggagtgacattctatcacccaagtccttcaacgggatgaagtcttgatatagtgctgtactgctggctacctacttccaaaatccctgatgccaaccacctgcctgcctgattttccatctatttcctgttgctaaatctgttgacacagggcctgcctgactgccaggacatctgcctgctgcctatggttggacctctatgatgctggcaccttgccatcctggcctggacctttgccagttgcccactgtcactgtcccctaaagctctgtggctctttccacgtgttcagtcttaccagttcttgagttaattcattcatttaaggattgactcattcatgtttgtatttgtgcattcagactaactgtggttagtttactaaaggctaactgtggttcatctgtctcttaggttcatctgcctcttaggttcatctgcaaaagaaaggtgaataatttaaaaaaggatggagtcttccgtatgctttattgtctaagtcctagagaatctcttatagtcgagaaggacataggctaatggtgaagacagatatttgaaagggaactgtgataatttccctctatctataatcatcttttttaaaaaaactaagactttttttttccttgcaaatagtgtggtgcagtgttttacagcttgggattggagttaatctgattgaggctggagttttggctctcccacttcctagctgagtttctttggcaagttaatttacctctgattccttcatctttaaaatgggaataacaactagatgtcttactgttttggggaaaattaaataacgtgttcatgtaaaatgttttaccatagcttctgacacgtactaagaccacaataaattttaacatgtcttcattttcttcttctcttcctcctcttcctttttctaacagtctaaatgggggcaaaaggaacagagaaagggaattcttggtaggaggaaaacattctctgatcacagtggcctggataggaatccaggcttctcatagtgacctgctctgatctcagtcataacatggtttagtaattgcctgtttatttgaccctctccctcatgagacttttgtctctgtgggcagggactttgcttgctaacattagcaggtccagcctcttgcacagtggcatgtatgacgaagtgcccaataaatatttgttaaataataataacaataaaaaataatagaagaattcctgatggtgatgtcagttgcataaattaaaaaaaaaaagaattcatcagatgaaggaagagccagattgtttcaagcattaaggataatgtgagcagagaagtaagatatgagacctttccatgtgtttaagcaatctgaagtagtgctggagtctaggatataggatatttatctatctatgtggtgcatgaaattatgaattttgaaaggttggcagtaatcaaatcaaaaaggatttgatttgattactggtgctgggcacgttggctcatgcctgtaatcctagcactttgggaggccgaggcaggtggatcacctgagatcaggagctcgagaccagcctggccaacatggggaaactctgtctctactaaaaatatgaaaatagccgagcgtggtgtcaggcgcttgtcatcccagatacttgggaggctgaggcaggagaatcgtttgaacccgggaggcagaggttgcagtgagccgagatggcgccacttcactccggcctgggtgaaagagcgagactccgtctcaaaaaacaaaacaaaacaaaaacaaaaaaacaaaaaggaccttggatgtatgctagctaaagagtttgtacctttttctggtatgcagaacacctaagagtaggaactaggccgggcacagaggctcacacctgtaatcccagcactttgggaggccaaggtcggcggatcacttgaggtcaggaccagcctgatcaacatggagaaaccccgtctctactaaaaatacaaaattagccaggcatggtggcgcatgcctgtaatcccagctactcgggaggctgaggcaggagaatcgcttgagcctgggagcgggagcaagatcgtgccactgcactccagtctgggtgacagagtgagaacctgtctcaaaaaaaaaaaaaaaaaaaagagtaggaactaggtacttgaagcttttcaccatttagtccttacttctctttttcagacttttctccttgactaaaaatttatgctctggcaacaccaaaatgtttgtataccacccgtcccccaccccgctgacatcacaatgcttgtttctcttgctttctttgcttatgttgttctcactgcctgaaatgttcccttccactccatcaccaataccacaattcccccatcaccagcatctctttctctctgttgttactcacactttagcccttactcccagccagtcattaaacttcacattcagtaagagctcacatgtgtcaagcctcctgttgagtactttgtatccataattcgatgtaatcctcacaataatcctacaaataggtactattattattatttttttaagttgcaaacttaaaaacatactttaagaaattattctacattttatgcataagtaaactgaagtttagatacgttatctacagtgaaagagtggctaaactatagcccttgatacaggagctacaatcccccttgagttttagcattacattctgctgcttaacagagatcatgtgaccctgccctgtgaccccataaacatctatgtaacattgtttttagcagtcttggttgggtcgaatatgaagttgacagtcttcttttttccaaatacagtttcaaacttttctgtgtgaaattccttttcccattcctttatgatatcttgggcagattccataattatctggtcactttccattattaaactaactccagtacagtttaaaattttaatttatctgttctacaactttttttcttattacaggacaggcttttggctgaagggacttggaatgcagaccgggtacagtctgctccgtcattcccttccccacctccttgtgctacggtccagttccacagggtgggagggatcagggaggaaagatgtagagaaaagggcaagcatgtctttgcttaactggtcttggccacagttctctccctgtggctgtttgtgctttggagacagacactaataggctggcatgttcatgggtgtggtgaggaccagacactgggaatatcagggactacaggtgcaccattgggttcttcggaggggtagtgcacagacgtctcctgtacagttccctgatatttcagatgcagctgctgctccagtactgctacaagcccctctcacaccagtttatgccacagggggtctcccggcagacttttattgctgaggcctgctcagtgagtagatggccttcgtgactgggactccagtaagttggctcacaggtaagtttcatgatctctacgcaatcatgagaaattcacacagccttgctatcccaaagggtagagaacacaggaagctctcctgccatctccactctctgccctgttatccatctagtcacagggcattgagaaaattcccatctaggagatgtccattcagtgtactcaaggtgatgctcctctgcagcagacactctagcctagagcttttgtctttaaacagtttttttaaatataaaatatatcatttagattgggcatggtggctcatgcctgtaatcccagtgctttgggacaccagggtagaagaatcacttgcgatcaggggtttcaggccaacctgggcagcatagcaagatcccatccctaaaaaaaaattagcttggcatggtagtgtgcacctgtagtcccagctacttgggaggcttatatacactttattatgaaatacatttcataataaatatatacattttataataatgtctatatatatttcataagtatatatttcatgattgaggtactcttctatttatcgtgcttgctgcctgaataccttgggttttttttcattgtgttattgttatttaggtcctgtgagatttatgctttaaagagattccattttggtgtatttcaaggatttgtttcaagatttagagatccttttaacagttcttgtagttctggcttgatagtgacaaattctctcagcatttgtttgtctgggaaagactgtatcttttcttcatttatgaagcttagtttcactggataaaacgttcttggctgataattgtttgattgaaggagactaaaaataggaccccaatctcatctaacttttaaggtttctgctgagaaatctgctgttaatctgataggttttctttataggttacctgatgcttttgcctcacagctcttaagattctttcattcgtctttactttagataacctgatgactatgtgcctagttgatgatctttttgcaatgaacttcccaggtgttctttcagcttcttgtatttggacgtctagatctctagcaggccagggaagctttcctcaatgattccctcaaatatgttttccaaacttttagatttctcttcttccttaggaacactaattattcttaggtttggatgtttaacatagtcccaaacttcttggaggctttgttcattttttaaaattcctttttctttgtctctgatggattgtgttaatttgaaagccttgtcttcaagctctgaagttctttcttctgtttgttcggttctattgctgagactttccagtgcgttttgcatttctctaagtgtgtccttgatttccagaaattgtgatttttttttatttatgctctctatttcactgagcaattttcctttcatatcctgtgtcatctcttttatttctttaagttagactttacctttctctggtgccttcttgattagcttaataatcgaccttctgaattccttttctgacaattcagatattttattttggtttggatccactgctggtgagctagtaagatcatttaggggtgtgaaagaaccctattttgtcatattaccataattgtttttctggttccttgtcatttgggtagactgtgtcaaagggaagatctgagattcaagggctgctgttcagattttttcatcccacagcgtgctcccttgaagtggcattctccccttcccctacgaatggggcttcctgagagccaaactgtagtaattggttttgctcttctgggtctagccacccagcagagctaccaggcactgagctggtaccgaggagtgtctgcaaagagtcctgtgatgtgatccatcttcaggtcttgcagccatggataccagcacctgctctggcagaggtagcaggggtgtcaagtggactctctgacggtccttggttgtgtttttgtttagtgcactggtttcgtgtttgttggcctctagccagcaggtggtgctttcaagagcacatcagctgcagtcctgtagagagcatgcaaatttgccttagggacacctggctaagtattcaggtttctcaggcagtgggcagggccatagagcttccaagagattatgacctttgtctttggccaccagggtgggtagcgaaagaccaccatgtgggtcagggatagatgtgtctgagctcagcttctccttggagggagcttgctgcagctgctgaaagggatggggatatgattcctagtccaatggagttatattcccagagggattatggctgcctctgctgaggcatacaggttgccagggaagtggggggaaaaccagcagtcactggcctcaccccgctgccatgcagccaacagtcctaaaggccagtctcactcccactgtgcccccctaatggcacaaagtctatttccaggcagctggtgaccagggctgagaactttccccagataatgaacctcccctttgagaaagcaagcccattaacagtttttcagcaactcagggagcctgcaacagtaatccagttccttcaaagtgtctgcagagtctcttggctttcctagtaatttcctgtagtagttcttagagcaaaagttcacagtgtgagtctccacatgctgctttgtccatccaaacaggagctgcaagctagtcctgcttcctgtctgccatcataatccacaactcctccaaaatattttttgaaaatatatacatgtggtaggcagaacaatgcatccctcccaccagatatctacacctattccctggaacctgtgaatatagttttaccttacatagcaaaaagtaccttacatggcaaaaaatatcttgtaattatgatgacatcaaagaccttgagatgaggagattgtacaggtgaacccaatctaatgacatggaaccttaaaggcataaaatcttttccatctgtggttaaagggagccatgactaagaaagaggagtcagagacaggcaatgttgctggtttcaaaggtggaaaatgaccatgagccaaggaatatgggtggcctctggaaacaggaaaaggcaaggaaatagactctccctgagagcctccagaaggaaatgcagccctatggacaccttgatttcagcccagcaagacccacattagactccaaacctacagaactataagatcatatatttgtactgctttaggccaccaagtttgtggtaatttattacagaagtagtagaaaacaaatacaatatacatgtagcaaagttattttttaatatactagagtgaatcaacacaaaatccagaattaaagagtgtgctcagggacttctgaggcattggcaaatgttttaattctccaaagtgtacatacacgttattttgtattaatatgttttaaattgcttatatactctttattatgaaatatatatgcacctgttgtcccaatactacattggtactacatcccaatactacattgggactacatcccaatactaacattgactataaatggcctaaatgctcctcttgaaagatacataatagcagaatggataagaattcacgaactaagtttctgttgttttcaggagactcatctaaaacataaggactcacataaacttaaacggtagaaaaatatattctatgcaaatgtacaccaaaagcaagcaaaagtagctattattatatcatatgaaacaaactttaaagcaacagctgttaaaagagacaaagagggacattatataatgataaaaggactagtccaacacaacaggaaaatatcgcaattctacatatatatgcacctaacactggagctcccaaatttataaaacaattactactcgacttaagaaatgagatagacggcaacacaataatagtgggagactttaatagaccactaacagcactagacaggtcatcaagacagaaagtcaacaaagaaacaatggatttaaactatacctttgaacaaatggatttaacagatatttacagaacgttctacccaacaattacagaatatacattttattgatcaacacatggaacattctccaagataaaccatctgataggctaccaaacaagccccagtacatttaagaaaattgaaattatatcaagtactctctcagaccacagtggaataaaattggaaatcaactccaaaaggaactctcaaaaccatggaaatacatggaacttaaataacctgctcctgaacgatcattgggtcaacaatgaaatcaagatggaaattaaaaaattctttgaactgaataataatagctacacaacatatcaaaatctctgggataaagcaaaaccagtgctaagatgaaagttcatagcattaaatgcctacatcataaagtctgaaagagcacaaatagacaatctaaggtcacacctcatggaactagagaaacaagaacaatccaaacccaaacccagcagaataaaagaaataacaaagatcagagcagaaccaaatgaaactgaaacaacaacaataaaaacaatacaaaagatacatgaaggaaaaatctggttctttgaaaagataaattgatagactattagtgagattaacaaagaaaagaagagagacaacccaaataagctcaattagaaatgaaacaagagatattacaactgatgccacagaaacacaaaagattattcaaggctactatgaacacctttatgtgcataaattagaaaacctaaaggagatggataaattcctggaaatatacaaccctcctagattaaaccaggaagatatagaatctctgaacagaccaataacaagcagcgagattgaaatggtaataaaaaaattgccaacaaaaaaaagtcaaggaccagatggattcacagcagaattctatcaggcatcaaagaagaattggttctaatcctgttaatactattccaaaagatagagaaagagggaatcctccccaaagtattctctgaagagaatgttcagtttttccttcctgagttacttcacttagaataatggtctccaattccatccgggttgctgtgaattgaacgccattattttgtttctttttatggcttcagagaatactttagggaggattccctctttctctatcttttggaatagtattaataggattagaactaattcttctttgatgtcggattagaactaattcttctttgatgtctgatagaattctgctgtgaatccatctggtccttgacttttttttgttggcaatttttttattaccatttcaatctcgctgcttgttattggtctgttcagagattctatatcttcctagtttaatttaggagggttgtatatttccagaagtttctccatctcctctaggttttctaatttatgcacataaaggtgtgcagaaatcatatggcaagagaggaagcaggaggtagggaggtgccaggctcttttaaacaaccagctctcatggaaagtaatagcatgaaaattcactcactcccgacaagggaaagtataaatctattcatgaagagtttgccatcatgacccaaacacctctcattaagcatgggtattatgctatgttatgtgcaaatgtttatagcaagtcctgggtagctccaacactttaaaaggcatcatgacttttataatgtgaaggtcagtggtgaagcaacaagtgccaatactgaaggtaatgaagcttttaaggaaaagctgcataggataatgtggctgagaaatatttgccagagtaaatatttaatgttgatgaaacagattattctggaagtgtatgcagagcatactatactcttctgttttgcattgctataaaggaatacctgagactgggtaatttgtaaagaagagaggtctatttggctcatggttctgcaggaggcacaagcatggcaccagcatctgcttgtcttctggtgaggcctcaggaagcttttactcatggcagaaagcaaaggagaggcagatgtgttatatggcaagacagagagaaggaggtgtcaagctctttttaaacagccagctcttgggtgaactaatagagtgagaattcactctttattgcagggagggcaccaagtcatttatgaaggatgcaccccccataacccaaacacctcccactaggccccatctccaacagtggggatcacagaggtgagccacaacaaggctcgccctggtgcccagagacagaaagagtgaagctgctgaccctgaaagcgagggacagctggccatgcagctgcaggcgtgggggtggcaggtgccacagagccagaacaaacagctgagataaaggtgaacagtgtagagagctagtgtgaggaagccgctgatgagagctgctgctgaataaaatcaacttttacctgcctacggctccctgagtgttctttctgctcattcacccactcccctcggacttcagcatgggctggaccttgaccacaggatctgacaattggccatgaggatgggatgaggtgagtgggtcttcagcccctgagggctcctgggtcggctatgtggccgcagcaagagctgtggtacctggtggcagtggtgctgcttggatgggtcccagtggaaacgtgggagacggtgcactggtctcccatgagtgtggagaaggagctgaagcacctggaagtgcacagcaccgagaagtatgcctttgccgcagagtcagatgggcgtttgtgactgtgctggtgggaggtgcatgcccagtccctgcgggacacagcacagggagaaggaagaaaccccgttgcaggctcgcccagggatgcaccggaaaatagagcatgagcagctgttgggccccaagggtgggcccagagcccctctactgtggtggagcacacttcctctggtccctgtgcccccgctgagttgtgggagtgaagtaagtaatgtcggcagtcatgtacaaacttactgcaagtcattcgggagaaggacattgctgcgcaacccggtcctgcccaagagttccagttcaaaaagtacccgctgcagctggcggaagtgtaaagccttttctgtttgataagagaactggccgagatgcctggcttgtgcggggcaccagacaaccagagccacatgtggacttggcaatctgctggtccctgaatctgcgtaagttttcaggcagagctgcatttattaatggctataaaggctggtcagtgaaagtgaaacctctgtctctgcatcttagcattggccgcttggctctcctcttatgccctgtgtatgtctctcccatacctgaggacactccgggggcggatgttttgcatggctcggcagctgtgctgtctgtcacggacttaatggaccatttgacaacggaactgagacaatccaccgagagcctggaacagtttgccttcatgggagggcgacaatggacttttacagtgttgctgcggggctatgtgcatagccccatcgtgtgtcatgattttgttaatgacgttatgttaacttccaattatcttgcaggtttagaagcggtaacacccccttttgcctgagattgggatgataaggctgagacagcctttctaaccaaggatgcccatttacactagatgtacatgtaatcacagatagttttggctagggcctatagcagtgcatggaacgcttggaagctccagtgggctgttagtcccaactatggaagggagctgagctctggtattccttaataaagaagcagtttaatagcaggattggtgtgttcatggataaccactacctcggactgggaaagcagttggtaactgtatatactgcccttcaggctcataagagtgtggcgggatgggctacagtcgtcgtgcagatgacttacctgacagcagggtgggtgtgttcatgggttgcaagccctcaaaatgggacggtacagacatccactttagcgaagtggagcgctatttagagcagtaaagtaccctgagtacaagtcccttaccagcagagttacaagagattttagggtctgtagccctaatgcaagataaagccatggggcctgaggcacccctagaccctgagcctttaccataaggaagggcatacccccattcctgatggggcatggtatacagatagatccagccagagtactgctgctgctgcagtattgacaacagcctagtactgacaccatatggtttaaaaccaggtgtgggtgaagtagctaataagctaaactcagggcagtatgagtggcaatcaccaaggaggagacatctgtggtaatctgcatcaatcaccagtttatcaaagcctatgtgtatgtatcgggcctgtgtgcccaaacctgtgtatcaagcttgcatgcccatagcttgtgtgtgaggcttatgtgtcaagcctatgtgtatgtatcgggcctgcatgcccaaagttgatatgtcaggcctatgtgccaaacctgtgtatcaaacctgtgtgtcctaggcctatgtctccctcggcctagagggtggagtgtaaggtacatgaatgtgctttggtcaaggaataggccaaggcagatgtccaggcctgcatgactcagtgagtttggggcacaggtgcacacctccatttgttatataacctgtttgtgtaagttcatacttggctctgagccactatcgtctgtaaaaggtataattgccttgctaacaccgtacaggggctcttgaggctcggcttggctcaacatggcttaacacagcgggtgcactggcacccagagaaagagagaaagagaaccagagctgtccttcttgtaggtggacagaggggagccacagcacggctcgcactggtgcccagagacagaaagagtgaagctgttgaccctgaaggcaagggagagctggccatgcagctgcaggtgtgggggcggcgggagccacagagccccagcaaacagccgagataaaggtgagcagtgtagagagctagtgtgaggaagctgctgatgagagctgctgctgaataaaataatcttttacctgcctacagccccccgagtgttctttctgctcatccacccactcccctcggacttcagcataggctggacccagaccccaaaatctgacacacagtatgctatgctttttaatattttatttcagaaaatatttttcaattataattttaaatatttcttctttttcattatttttattttcttctttgaagacatcaattttatgtatgttagcccttaggtttcctatattgtatgtctatcacattgcattcatttcctattgctgatatttgtagcaaattatcacaagcttagtggcttaaaacaacacaaatttattttcttatagttctggaagtcagaaatctaaaatgggtgggcagagctgtgttccttctgcaggctccagaggagaatcagtttcatgccttttccagtctctagaagctgtctgtatgacctgactcacgggcctagatccctagaacctctccttccattgtcacctctcctctgactctaaacctgctgcctctatgtaccctggtaatgatattgcacccacctggataatcaagaataatcacttcatctggacatcctcagtttaaccacatctctaatgtccttttgccatgcagggcaactctcataggcctcagggtttaggatgtagacatctttgtggggccattattctgcctatcaggcaaatatttctcaaatccttttttttgaatcattaaaaaatttgtttcatttcccctcaattttcttccttctttgttcttatttactttactctaccttttatggtgtcattttgcttttgtgtttttctaatttagtcctcttttgtgaaattatttttttcttaattttttactgattattcacttgttctgagctttttctattgcttgttggtgctgtttttgtcaaagctttcattcttctctaatacttaaatattacagttttcatctgttccatgacctcatttttctgacgaattctctctgtcttaattttattaagacctcattcaactttttattgtaataatttggtatggtgctagaaagttgtttttttttttttttttttttgtccatgatgtttgaacgaggaacaaaataagatggaactttctgggttaataggagaaagacaagacaaggtagctttctctgtagcacagtttaagaattttttctctgtttttaccaggaaaggttaaaaatatgtcctctctctatgagtcactttgtttctctaagccatatctggttaagaaagctttccttggctgggtgtggtggttcatgcctgtaatcccagcactttgggaggccgaggtgggccaatcatgaggtcaggggttcgagaccagcctggccaacatggtgaaaccctgtctctactaaaaatacaaaaaattagctgggtgtagtgaccggcgactgtaatcccagctactcgggaggctgaggcaggagaattgcttgaacctgggaggtggaggttgcagtgagccgagatcgcgccattgctgcactccagcctgggcaacagcgtgaggctctgtctcaaaagaaaaaaaaaaaaaaagaaaggcttccctgccattcatctgtgaggtccactgtcttgtcctccatggctgtgctctcagtatcaggtcttgcatttactctttttgctctatttttatttatccgttaataatgataaatattttcctgtatgttctgaattctttttttaaaaaattggattgtgtgtatttgaagattacagcatgatgttatgtagatagtaaaatggttactatagtgaagcaaattaacatatccatcatctcacatagcaacttttttttggtggcaagagtagctaaaaagcatttgctcttaaagtacttcctgagacttcctttctctgagcttgtcaaacattctctcattctctctctctcatttctcatggttccttcctttttcagttttgctatttccaatgggatgaggcattgtcctactagagggaagtatgtgagattttattgaaggccagaaccaccatacccatgttagtttccccaatatctgtgtaattttggcactgatctgcagctctgaggctgtgaggactttttccattatcacgaattgttcttagacatttttttcttcccagatttcctctcagggcaaaatctttttttttttttttttttttgaggcaggggcagcgggggtcatgttcatttattactgactttttggtttttatgacttttaagctatttagctgtctttcacttcatgctctctcaccacaactgttgatcgtgcatgtcctgctgctgtagctgcttcgtccccaagatgtacccacactcttggggctgttgttcccatcgtcttagctatactagcttctctatttgattttcaagagaagtttgggacacttaaaacaactacactgctgatataatcactttacagaaattctgacatacatttcaagagaatcactatgattcctgggttgagattagactataggagaatgagtaaggaagcagggagaataatttttagactattgcaataatccaagtgacagatgatgatcacttggaagatgactgtcaaagttagattctggatgtcttctgaaggtggaaccgtaagattctctgatggattggatgttggatgttaaagaaaaagaggaggtggaaatagcattgagtcttttattttaatatttcaagggatggagttgtcattagctgggatgtggcaaatgtggctaaaccaggttgagtgtcatattaggttagggttaggccatactgcagtaacaaaccctaaacaattaatttattgcataacaaataagaaggtggtggggaaggggggccctcctttatcatttagccctgccatcatgaatacattttctttgcttttgttttagcagagggaaagctagctggaggatcagagattggggttggcagctgcttctacttctgtaccttcttttcctttttgttttcctccttctctttgcctaccctctcttcttcctcttacaatttttttttctcctcctccattttatttccttcttttcccagaaccataagtggcattcatcatttctgcccatatcccattttccaaaactcagttatgtgcacccaatctaatggccaatgagatggaaaatttatttgctgcccatttgaatttcattttcagtgaattgctgttcaaatgctttactaatttttcaattttttatgtataggagtttttaataaactctgaaaaaataacttattgcatgttaacatgtttcaaacatcttctctagtctattgcttgtttcttagccttgtttataactactttgtcatgtggaatacgttaattttgtagtgtattctttgtgatttgagtttcctacattttctttaagaaatttctccctgtcttaatatcataaaaatattactctatatttttgtctgagttttgaattacttggcttgttttatgtacttgtttatttaatgcatttaggatagtgttttattttatttttccatcggacttaattcatgacactgccttggtcatatatggagtttttatttatgtgcaggcccatttttggttctttgtttccattgtttccaaagttgtctccgttgatgtatttgtttctccctgtggaataacaaaatgttttagttgccattattataaaataagtcctgcttctttatttagtattttgtcatttaatttcttggtccttcttatacatgtacaaaatttttcacacgcattttagaatcagcttgtcaattttcagcaaaaattttattggtatgttgatttcgattgcattgaattgtatatataaacttggggagaagtgaaatatatataatattaaattctttcttctaggacattggcatatcttgccatttgtccatttacgtctttcaatgatattttccaattttcttcatataggtgttatccatcgtctattcggttattcctagcttttttatctatttatttattttgggaactagattttttcttttaaaaaatattgtattatttacaggaacattgttttatcgtgtacgttatgcacacatccaactgcttgccagactttaaaaaattacaatattttacctaaataatctatttttttgtaaaaatgtagtttttgttaataatttattttcactaagttattttatatacatatataaacagcttagtaaagtgtctgatacaataagggcctaataaatgttaaattgtattataattgttttcattactattattttcttggtatgcaaatgtgtcacttgaaaatgacacatttttgtttatttaaatatttacatctcatttctttttcttgatttattgtgttagtttggaatagcataaatgataataggaatgcatttatatttcaacatgaggtgcgattttttgctactgtggttgattaattcttttattgggttaaggaagttaacttctatttctttttggctaagagcttttgaacaatcatgaatacaagttggttttcacaggatgatactgtttgcatttattaaaagaaggtttatgctcctttggtagttactgtgcaaattccatttccagtcactgaaatataggaaggaaagcccaagagagggctagaattggtgttgggtgagccagtgtatcatctgtgccccactacatcctttggacttttcaacatttcatccctctccatcttctgatatttaaagttccaaataaactcatcataacttcaaagtgctactgcctaacataatgcatctattccttgtacaaataaaaacaaaccatctctttgaaagtgatgacacagtctcatcagttcttgcattaatttctgctttatgtttatcctctttttagtttataactcagcagcattttggtatcctgtaatctctgcactgagatattacctacacatcctgtataaaatcacaggtagaagggagggtggaaaataaaaggaattatataaaaatgagaacataacagagcaatgaaaaaaataggggtgctcatgatagttctcatttttacagctcttcatgaggtcatgtttgatatacaataatttcttttgtaactactcatttcatatttcctttgctttcagccaacacctttatttgaaagtttcctgagctgacaggtcacttgaaatttattcctgagaagtttgcactcttgatcctgcatttataagatgctgaattgtttccttcactccttcaactgcatgtgggcagactaggaggcaactagcaggattccctgaataatagacatactcctccttatctccaatcatacattaacaatcctacctctctccttgatagtaagaatcatttaccatagataacacaatagataaggaatatggtaattgaagttcttcccacttgaaggtgtttccattcccattgtccttttggaccactcaaaatggtaaaagcagaggcctaacgatccaattttgtgtggtgccaggatgccatgaagaaccatctgtgaaccagacttgagggttttttttttttctgaactagtcagagggaattctgaatgatgcccaggtgtttcctaggggctaactactaacatacagcaggagtaggcattgatatggtttggctgtgtccccacccaaatctcatcttgaattgtagcttccataattcccacatgttgtgggagcgtcccagtgggagacaactgaatcacagggggagggagggcaattaccgccatactgttcttgtcgtagtgaataagtctcatgagatctgatggttttataaggggaaacccctttcgcttggttctctcattctctcgcttgcctgctgccatgtaagacatgcctttcaccttccaccatgattgtgattcctccccagccatttggaactgtgagtctattaaacctctttttctttacaaatcactgagtctagggtatgtctttatcagcagcatgaaaacggactaagacagacatcctggaaatgtgaagatcccacccatgttactgtgaacacattcaggagctgccaaagcccgataaagtacatatctttcctacttggaaacagaggcttatttagtcctgcctgtcttcagtaagtctatagtatatcagatgacacccacttgatgtcatgctcaggtcacttgatcacttggtgtctatattcatgtgtttagtctgtatcaggattttaacaagccaggagcagtttctcccttccaaatactaaccaggccccaccctgcttagcttccaagatcacatgagttcaggtgcgttcagggtgctatggcaatagacaggaaccatttcccaaaaagacagcagctacttgtttaggagggcctgtaatcccagcactttgggaggccaaggcgagctgatcatctgagcccaggagttcaagaccagcctgggcaacatggtgggacgccatctctacaaaaaatacaaaaattagctggccatggtgtcccagtacctgtagtcccagctacaccagaggctgaggtgggaggattgtgtgagcctgggagttggaggctacagtgagccaagattgtgccactgcattcccggctagacaacagagcaagaccctgtcttaaaaaaaaaaaaaaaaaaaaaaggagggcatacctttgtccacagctatgattttgaatttaagacctaccatagggttgttacagaaacctgttcagccacagataatttgagtgctttggatccattgactatcatagattaacgatggctgcattttcattacaacactcactgaaaagttttctaatcactctctgcttgaatctggtctagcttattaacttgcttaaccaataaagtatggcagaagtgatgcatagccaattctgaggatagcctcttaaaggaccggcagattctacttttcccacttagagccctgagcatccataagggaaattcaaatatcctaaaggtgtcatgctgtagggaaattcaagcaacatggaaagatcataggtagagaccacatggaatgattccagtccccagccatttgcattagctcaactgaggcccagacattgtagaagagggatgagtcttctccatagagccctgccaaaatttcagatttgtgagttaaagacatgattgttgtggttttaaataattatgatttggggttatttgttatggcataatagattactggacagtagttcatagagactagttaacatggcttcttacattgggacctgacccagctgaatgcagttttactgtctttacttgtacagattccactcaaaactgtcagcctcatgggctacttggtaaatagagcagaatatcctaatgcagtatgtaatgcctccaaagttcaaagaggcaaccgagtgttgtgacattctcttagcgatggaatgtacaaaataaagcaacatgcatttcattgtggacctgaaaggaacagttcaaacattagatacctaaaattttgttgtggttacagctccctgaatttcctggtagtttatcatctgcactctggaatacacatttcttaacaaggtattgaggatacacacatgctacttcctgctcactaggtcccattagtgagatgtcataaatatggtgagccattgtgattttcatagacaccatgctgttgttcagtgtttattcaaccttcaacaaagacagaagtgtaagacaattcccttttctgacctagatccaggaggaagacaatatttattttggttttggatggtcattaggcatttgttttgtgttccctgggctattcttttgggttttgagatcactgattttgctagaaaataagagtaataaagttttttgttgaacgtcgccactttattttaaccatgcactgaagaattaatagcattgtttatgctcatttgagaagcaagagtctggaaaacgttattgttagacatcggatgaagacttgagaaaggtggagcagtgattaagtagtcatcataggtgaaaactggccgcaaagacaaatgtgagatatctcttttgagtaccagcaagactgtagattcctaatgtgaaaaaaaatggtctttgcatttttaatttatatattaaaagggaagttcttctctcctgaaagctggagaagatggatttaaataaatccttgaatattaggtctagggatatttatatgacaataaggtttgggtctgttctcacccaaatctcaccttgaattgtaataatcctcagatgtcaaggttggggccaggtggagataattgaatcatgggggaagtttcccccatactgttcttgtggtagcgaataagtctcacaagatctgatggttttataagtgggagttccccggcacacgctctcttgcctggcgccatgtaagacgtccttttgctcttccttcaccttcctccatgattgtgaggcctccccagccatgtggaactgtgagtctattaaacctctttcctttataattgcccaatctcaggtatgtctttatttgcagcatgagagcagactaatacatatgaaatataaaattacaaaactaagtgtggtatagtaaaagatataccatagcatgctcattattatacatgttataactaaaacaactgaaaatacattcctgtttgagatatctgtgccaatttatcaagagaagctggaagtatttgtgtatgattgatgtttagtagcaccattattttcatttgcttaatttacggcaaatgagaactccaggtgatgtactatgactgatcaaaatatccaagcatttcttttggtaaagatatatagcagagaactaattccttatctcactctcagatatgcttttgaatagagacagatagggagagagagagaactcatatattccttaggatttctcaggtaattagctaacagcagaacccctttgatcacttaaatgacttctttacaattcaggcagagtaaattagtgaaaagctcttgcctgagagtctcctgactttgctccttagggcttgtcctggagtttgcaatcatgtctgaaagaaaaacgaagatggagcttcctcagtggcacatccttttttaagcattagggtgaattgggtgttacagttctctcgggcaagctgaagtgcacctggtcagtacttcgctcactatgaccttacagaaaccttgggatgttgctgcaatatagtattatgtttccttatcccactttgtaagttaagtcccttagaatcagacacgatttagcaatttcctctaggagcaaaggcaaacattctaagtatatacatataattgttgttaagatgacacatcctagccaagtggtcaagatgtattttaccctcattagtagatgtaagactagttcagacaagtgtaaaacacttgccagctttttatttttaggccagatatttctattttctgtcttcttggtgaatattcagtccattagtacacggtattacttaaagaattgttggtgaagggcattcattaggggcttctggaccataagtattttcaacctaccaataattgtttatgttttaaagtaggatgatagtaagtaaaagccacactcccctttttaaagttagggctgataaaggatcctcccctgctcactactacaatgatttgtgtgtgagcatatgttttgggaaagaagcttttctctgtgtatttttcaggattagtatctgtttaatcctccagaaggagctggaagtgaagcaacccactcctgtgttcacatcacagacatacatccttcgcatttgcagcatgtctatttcaatgctttcgagtgggagaggtttgttggtgagtgtggctgttggaaacagataaagaggaaaaacttaaagataaattggcaatccttttcctaagtgactttcatttttaaaaagagaaaacagaaaagcttctattactccttgctttagaacttttaatggaatgccattaagaaatgagatgtgtgtatttcatagttactggactactcaatataatttaatcatagtatgttcaaccattactcatttctttctccatactagtacaaattaggaaattaggaactattaaattaatatatactttaatggagaataaattatgaaaacaaaaagttctttggagggagctatatgttaatatcaggaacaggtaatctgcatgtctctacacagagtacatagcttaatgcatttaaattactggatgtctaaattataggttaattatgaagttatctacatatcatacatacttgtagaatcactttgcttatgtttaaagtatgataattagttctgggttgtcatgtacaaaggtgcctaaaaaataaattccaagttttacactttgagaaaaataaaataagaatatgaacacaggcgtcaattggaaaggggattaagcttaaagacaggcaatttttttgtgtgtgtcttacaaagttttatggactagatgacattcttaaggtattttaaaataaagttacattttttaataatcaggcatgtacttttagtcaaggaaggaacaatagaaggaaaaagtcctttatataacctttgaaagagtctctcataaaactgtaacagtgttatatactatttaaatcaggtggatgagaagttgttattaaagagcgtgacagtatctggatttgaaggtgttctctgctgctgtgagttttgtttgaaatgcttcattcatatttgtactttaaaaaaattacttttgcaccagcctaataaaactatattttcatcatgatattgctgaattttggctctagaatatattgcaaatttaaaatgccagtgagtttattccctcttataaaatacattttaaaatattgaactaagaatataaagttttaaaggcaacttaagaaaataaaatattggaaataaacatttagaaccatataatattaattattgtattaaaggtggtttttacaaataaattggcattagtaattagggaaatgcaaatcaaaatcacaatgagctatcacttcacagctactaggatgggtataatttagaaaaagcaaaataacaagtgttgttaaggatgtagagagactgaaacctcctttacattgtgaataggaatataaaatggtgcagccattgcgaaaatgtttggtagtttctgaaaaagttaaacactgaatagaatacgattcagcaactcccatcataggcatacactcaaaataattgaaaaaaagactcaaagagatagttatatgacaatgttcacttgttcactgcatcatttttcacaataaacataaaacatgaaacataaaaaaccaatcatagtgagaacttgtatcaactaagtctagttttagtaactttaaaaataaacattataacatttatttgctaatgaaatcctaaatatttgatacattgtgagtacatgaaaattaataaaatatgaaaataggaaagagttgagagaaaggttagtctattccaaattatctgcacaattggagtaggtgatgaaacaatcctaactagacaataatacagaaaccgattattttgatattcgttaaatttttaaactttcttgtgattatggtctggtggtctgggatcattcaacctttggaaccaaagagaagcatgggaaaggtgtccagcttcccccgttccacacctgcatgcagaatcattgtggcactgtgctttgttctccaattcatcaagtactcacatttgtggttgcttccccaccacatttgcaatgggtctttcagcccacaccagtgcttacctgtactattgcttttcaagttggcctcatctctcactgagagcttcttttctaccagcagctgaaggcaggatctccctactgcctccattaaaaagtgctcattgcaagaacacatggacatagggaggggaacatcacacaccggggcccgttggggagtagaagggcaaggggagagatagcattaggacaaatacctaatgcatgtggggcttaaaacctagatgacgggttgatgggtgcagcaaaccaccatggcacatgtatacctatgtaacaaacctgcacgttctgcacatgtatcccagaacttaaagtataaacacataaaaataagtgctcattgctaagttctggcacctcagtcctctaactcctgccttgctttccaaaatgtggtttggggctggtcttttctctgcccatcaccttcccttgttcatgagtcttgactctaattagacactttggatgactactgtattagtctgttctcatgatgctaataaagacatacccaagtctgggtactttataaaggaaagaagtttaattgattcacagttctacatagctggggaggcctcacaatcatggttgaagatgaatgagcagcaaagttacatcttacatggcagcaggcaagagagcgtgtgcagaggaactcccctttataaaaccatcagatctcatgagacttattcattatcatgagaacagcacgggaaagacccacccttatgattcaattacctcccgctaggtccctctcatgacatgtgggaattatgggagctacaattcaagatgagatttgggtggggacacagccaaaacatatcagataccttagctgcaatgattatttacttggctttgacttcaatttttaccaacagtggtggaagaataaggggtggtggtggactgaggcacagatcaaacagataagatgtccagtcttaggctgttcctttcccgagtccattgaaatagacttttaattggttttatgctcttcaaactctctgtattgtctttcaaaaatatttttccaaatgcagatgtgaaaatgtcctctgcttaaaaatattgtatgaattcctgtaacgacatattttctttacaattctatttcataaaataatggcaggataggaattacctatctatgacgtgtctaccattctaaataaagtcacttttcaagttaagcttcctggttctaagtatttatatggaataatcaaatagatatacagattattataaacccacttctggtattaactatgcagaacatctcatgatttctatcttgtacaacctctatttattggacaatcaatgtaaatagagcaggacaagaaagaggaaggtcctacagtttaggaggactccctattttaactcaccaagacttggttttaacaaaaatcaagtaaatttgcacattctatcatgtcttctcttgaagagggtttttaatagggccactaaaattcatagtagtacttctgcaacatagtactttctgaaatattccaattgtttttctatgtctattgttaattttctcctttcagagtttcagcagttcttgtcactaagtgtgagatctgtagagtgattgactgggtctagcacttccccagtgtgacttttcagaaaagtggcagccatttttggttgtgacagtccttcaacgattatgtgacatggccttgcctaatatttcagattctcataaacagactgcactggctatattctgtaatcttaagcatcagtcccaaaaaaggactctgttgcctcagtttatattcctttgcacaccaccctaataaagcgaggttggtttttgttctcaagcagtgttttaattatatagtttgcatttataagagtaattgtgacttaagtagatatgaatgataatcgttggtttcttttccacattaatctatcatctctcaacttcattgattggaacatactaacttatgaaaaactcctcatgatcatgacttgatcctcaaacaaactgccttgaaaagatgaccatgcagcctaatgtgaatagaatgatttatcagaacagtctataatcttgctaagcaagcagccaagttggaaaatcttttctgcttcctatcttgtgaaacgaagggccgaaaatctgtgtggccctgaatgatttgggaatcgcagtaaaatgaccccagtggatgaatggggtcattttactgaatgaataaaatgatgagtaatacaaaattgtcctgttaagctgctcgttacctagattccctgctaagctgcaggaagtcagcaagagtcctcagccaccagtgctgaaaaatattgatggcctaaatcattttgtggagtaaatctatacataattataggagattgtttagaaattatagtaatttgatattatgttgattttcatgaacatttaaaaattaatataaatatcttgtgctgtatgtttgttttcccggaatgtacttgttaaaaattaagcgctgactcacagaaacatctgggcaagagtgtggatgactcaggacaaactcatcactgttattgaaacacagagagtatggcttcctgaaaatgagttgtgaacattatattctcataaaatgggcagtggtctcaactatttctccaccctactcatgcatctcagtcctccccacatgatttggatagatgtgcagccttcaccggtggaatattggcaatagaatgaaagcatgctgcttttatcttaagctttttgcttgcattgtttaatgacttttcacagtagtaaccacagaaacataatttctttttacaaatgatactgataaagtcatgaaataggagaatcgtgaataacatggaaggaatactaatttttttggttattgctcaccatggaaattcaagaaaaaacagagaggcagttcgccattttcatgtaaactaatcctaatgattaaccttgctagtctcaagaaaaattactgaaaaactttatcactgctatatctaagccatagttttcatgatagtggttaatgtataaataagattgcacacactctttttagattgagtaaagtacagaattgcataaacatgtcttttaaaaattcttgtcttaaatatgtttctaattgtgcgatactcctgtgcttacagtatttagaccacatgtttaaatcagagtttttagtaagggattacagcacttctattccaaagagtgctggctttcttctttcctttctttataaagcttgccactgtttgacacaggctgaatctttgatgtacatataaggtttgatttttactttaatgttttagtttatgatctattttgtacattgaggatgacattctggggttgaaaaaatggtgaagttatttctagaaagaaaaaaagatccttcaccctggagcagccatttggaaattatttaatcacactaagagtaaccttaaaaacattaggttattttcaaatgatattcccagaggtgagcagccaaattctcactaagaataagttcatctagcattgacgttgcttcagtatcaaaagcacaaagtactactgagccatgacagtttcgtttaaccaatgattttagagaaatctgggtggttttccatgtgttgcctggtgctgggcaggttggctgttgcatgtttgtaaggttcagctgtgtccagagagaaatataaaataaattaatttaatttaatactgtctctgaattctaataacatagtgtactatttgttccttaaaaatgtgaaaaaaagttccataaagttagatccttagacaagtttgctataaagagtataaaaaaacaaattaacttggtcagaattttataaacagtgatttatttaaaaattaaacacaaagaaaattgcagctgaattttgcacatggtcaggatttattagcaaataaaacattatgcctatataataattgtgagaatcctcctgcatttgctgaggacttactatgtacccactgtcgcagtacttttgctggtatactttcccttccattttgtattgggagcttggtcttgttagtgggtctgtattcttctactctttacttttttttcccctagttggtttacctaaatgctttctaggacctaaggatgttgagggagcagcatctctgtggcccggggcacacagattacagggttaacacttggtatctagtttatgtcttggatttcagagtgaacttttcaagtttttatggactgtgaccagcgaaaccgaaatactaagatcattggcatatttaataacaataattttaagagaaaagctatggatggattctagggtcataaatttagtagcaattatttttatttatcctaatatataaagtttgtggttcacttattcattaaacattgacttattatatctatgtgccagatactgtgttggaacctgcggacacaaaaatgagtcctaatagacgtcatttctgtcatcacagagctcaatgttgggggtcgggagaagacaagaaacacagagagaaagacataaccaaataacgacacacacactaatacaaaattgcatctctgataaatacgtgaaggagtgattcacatgctttcagagttctaattgtaggatgtagcagacagaggaaaggatgctcttaggaaatgatttctgagctaagatccaaggaattattcagagttaagtgtgaaaaacgtgggatgaatccagggagaagaacatgtgcaaaggtcctgtggcatgagagacagtggcaagaagaaggattgaaagaaggctggagtaaatagcaaaggaagagaggttggaaaaacatgatgctgggttgttaggtggaatccaaattgagatcttcatagtttacataaaaacatttcgttttgtcttaaaaataataggtcttaaaatgggagggttttaattagaggtgggagggtgacacaattaggtgtaattttttcataatcacgtttgagagagaccagagtggatgctggtagacctggagcaatttaacatagttgtctagttgaaagatgatagtaggttttacatctggttctttaaaaagtctacatttctttaagcacaaatatgaaatgaaatagttttattttatccccttacttctttcagatctcattttcccatcccttagtgacatctgaacagatccataccgagtgcacatgtttaatcatttagtccagttcacgtggggcccatttaaaacttcagtctcatgttcacattcgaatgctcctctcttccaactttggctaaagaacttccaaaaatgacaaagtgctatctgtgcttccctaccttctccccattccactagccatttctcctttcgtatgttgagaacttggagaagagatgaagggagaaggggtcagatgctttttctcttagtggtgatgacgatgccatcctctcttgaccatcattgtttttctggtgaattctaatgtgcttcaagtgtcccctttgggacagctccccaaatgccgccatcttccatggagcatgtgtgggttctttccgtagcacatagtggggctccttgctgcctcgttgctccactgcccttgctcccatctctcatgtcctgcttgtgccttcttactgctggctcttccttgcccagcagccaccatcctgcataaggtgctggcaagatgagtcacaccccaggaacttccacagtgtctaccagacccatgggacacttactcatccttgcccaagcaaaggtaggaaatcaggctgtttctgggctgcctctctaaattgacatctctttttcagttctttgttttcttcacttaaatagacacaagtgtattgtgactacttaagtatatgtaaactgtataaacaaatctaccagaaaaagagaagccaatgaaaatccatcttccaatctctataagagattttcttggagcccacttcacctgagtttatgggagtagggatggtgtcagtgggggtgatggtgcatcacaaaactacagaccgatgctgtaaccataacttctactattctccttgagtcccttccttcctcatagtcatcttattatgtagactggagggagttgatgggatgatagctgtaggttttagctggtttggatgtttaataaatcccaaggatgtatctggtccccaaatgctttctggggtgtttagcatgtgaagtaatttttactttatattcccaactctggcttttgctttgatctagtgtggcaaaaagcaacttattcagaattctgtatggtttggacctgtaatgatgtcaaaggacatggaaacactgggctaggccagaagaatacctgataaaacacatgttacggctgggtgtggtggctcacgcctgtaatcctagcactttcggaggccaaggctggtggatcacctgaggtcaggagttcgagaccagcctgaccaatatggtaaaatcccgtctctactaaaaatacaacaattagctgggcgtggtggcacaacacctgtagtctcagctacttgggaggctgagacaggagaattgcttgatcctggaagacagaggtggaggttgcagtgagccaagattgtgccactgcactccagcctgggcaacagagtgagactccgtcccagaaaaacaaaaaaacaaaacaaacaaaacacaaattatatggtgatcgattgaatatcgaggatgagaaagaagaaggaaacaggatgactgttaagtgtctgttttatactctacgtacctagtggatgctggtataagggaaaacactgaaagaggcccaaggttccccataattgcttcctgccccatgggaagagggagccacaggatggcatgatgtgtgttcagcttggatattttgagaagacattgaatagacaaggctggagctcagaggaattatttgggctgaaggtgcacatctgtgagctattttttattggcgataactgaagctatgagtatggatggcattgccagagagagagtttatagtgagatgtgtgcagtgtatacacacacacgaatgtgaatgtgtgtgtgtgtgtacactgtgaatatagacactgtgtgtgcagtgtctgtgtgtgtgtacagtgtgaatatagacacctacagaaacacacacaaaaattagataaatttttaaaggtttgtagacttactgtcattatgagtagttacatactctaactctctatttctatatgtctatgaaatgtgatatggtttatcctataatcccaagaaactaattggtgagcccacatattgcttctagatccaaaaggtgtataacttcctttgataacaaacacaactcaattatttttgaatacagcattcagacaggaataggggagcagggaatagagactagtcccttacaaaatatggctgggttataaatctaacttttctgggattctaaactccatattttgtggggaggcatttgcacctaccttaggacagaggtcccggtgggaacagcattgtgccagtctccgggtgtggttgcatccaggcacaatgatgcctccaggagggaggagccccatggcagagaggggcaagcagagactgcagctgcagcagataggattttgaacaagactggggactctgctggagaacttggaggggaagattcagggattttgatagaagtggttcagaactgagaatggttttgttttgttttgccgttattagtaaacattttcctcctaaaataatgattttaaaaattagcatgggatctctaagatcacctattaaagctgcaagaagagatgtaataataaataataatggcagcaatgcacacaattaacattgttcacatcttccctcatactaagtgaaagcttcccttttggtgcttggagaatggaagctgaacctgcctcccagatgcctcccagatggctgtgattgtcacatggctctgccctggtgaaatctcctgtgacagcaggttagagactgctgtgcagctccacctgtgatctattcagaggctggaagctgttcacacactaaaatgtaaatccaaaatgctccaagcacagtcaggtaatgggaactttactttgaaaacctggcctgtccagagaatgtgtcctgatgcattattaataatcctctcttactttgggaaagaaagatttatgctaatttaattggtattgtgctataatcatttgaggctgtaagaaaggagtacattttacttaagagcacaattgcattttaattggcatgtttggggtgattttaggacttttaggacatggctaactttgcaataaaaaatagctatttactctagtgattttcacactgtttttcgtgaagagaagcttttgaaagaggtcaattaaatattttgcctaaaatatcccaactaatggaagagatttattgttaagcctttgggcttctttttcttcttcttcttctttttttgtcttttacattgttaataaaataatttgattttggcatgcaatagtctcattaagagcagtttaggccgggcgcggtggctcacgcccgtaatcccagcactttggaaggcccaggcgggcagatcacgaggtcaggagatcgagatcgtcctggctaacacggtgaaaccctgtctctactaaaaatacaaaaaaattagccaggcgtggttgcaggcgcctgtagtcccagctaagcgggaggctgagccaggagaatggcctgaacccgggaggcggatattgcagtgagcggagatcgcgccactgaactccagcctgggcaacagagcgagcctccatctcaaaaaaaaaaaaaaaaaaagagcagtttatcctcttaaaattagttttattatatggcttcattttcctggctcctaatttattcagtcatgagaaaatctctgctgttacaaagatccttaaatgtccaacggggagatgtggggaagacagtgccagagtctcaatggagtagcttctcctatgtgacagttttccaggtagcttttgttgtttaggtggccaaaaaaactgtgaattgcccacgatcctccattatggttcaggttatgtttcctagaatagaaatgggatccctctggctttatgcgtatgcagacgccaggggtgaagaaaataggctacctttgcagaaatataaataacttagtatagaggggtgtacacatagggagagaaagagaaaagattattttatgtaaagcagcattttccatgctgcgtgctgtgaactatggcatccctccacaagcgtgaagatgtctcccaggaagcagaggtagacagacactcaacagagagcaacagcccggcgcatcaacactaacgaagcagttcttttttttaacctccatgttcatgtttgagagctatgacagcataatttaaaaatgctgcttgcatgaatttgaaaatctgtgcatatgagacgagtagaaggtttgaggatttgggtgaataatcttctggtgattttttaaaaagaataaaaggaatattttattaaagcataatctaaaatattaattatcgatatttgagacattctctaaggcaaacaggtgctgcatgtcactcatactgattggtcatgaatgagttgtaggtgtccagagatactgattccttctcttctcaggaaaggccaggcggggcctggggcagctccagctgccaatactctggttggtttcattcttgtgctgtatgaatattgtccttttctctgaatgtcatgatgggaaatggatgggaagcactgtgctaaggtccttttcttgattttatcaccagtgtatttctgtactgtctgtggaattttgatctgcagatgtcaatgtgtcttctactaaagagagattgtaccctctcacactgtaagaattcagccagcattttttgaaacataaacacctttcataaaaccgttatgaaatatttgataatcagttatttctgtttcatgaagccttaggggaaaataacattattatgtaattaccgagcagacactacatgccaggcaccctgataatctgtgagactggtctattatttgccgttagaagacatacaagtgagtgtaatgagcaggttaaaattctagcaccaccattcaccagcttcagcaagttacttaacatctctgtccctcagtttcctaatctatgtaatggggctaatcataggatgtgcctcattagtcagttgatcaaaatgaacaaccctattagttacctgataaaagtaagtcatctttgtgtaatgttgtgaggattattatgtatgtggggtttagaaaagtgccagtcacgtggtaagtgctataaaaatattagctattatatttattttcagagatccccaaggtaggtggcgggcatggtcatcaaggtgttcctgcctgggtaagaattcaaagattcagcgggtatgtctgaactgcttccctgcatctgagatgcctgtgctgcaggctccagagatgttgtcttaagcagaatgttcctgtgtgttatttcacttcccctgatttctgagccttttatgagcctatagtggggctactcttcaggctttgagcaatccagtagccttccaatacattgctttctgtttgatttagtctgagttggtctctgttgtttgtaaacaaaaactcagattagtacatccctatttgatatttaagaaaaagaggctcagaaggattacaagtcttacgcaagttcttgaaactagtaaagaattaagagagaattcagcatgcattatccctactgcaataccgtgagctccttttactagaataaatccttgcaaatgcttcctttaaaataatgactgagttttgttaagttttctgtgaaaagattaatcaatatttttatttagtgaatgattaaatagggttctctgatatttgaaagagggttgtgttttgttttgtttgttttgagcaatgtgaggcaactaccactggaatactaagatatttactgaaacttcattatgtggcacttttgttggtaaatgctctgcccaatattattatgatcttgatgtctctgtctctcgttctggagtaccctctgttgtacaaaggtcagtgtaaaataagtaaattttcagatatgatacaatgtgtgcaataaagattaagtgatgaagtgtgaattacagaattttaccgtattaatttagttagttggtaaaagtgaactctaacttaaatagttaacgtagttactagagaaattttaggatatagtatgaatggaagggagccctagaaagacccttcagagaatgatgaatgctatgaatttaaattaactaggtttctggctgggtgacatttccttaatctgaactatcctgtatataactattaagttatgacatcaattcgtgagcctcgggggtgtcgctgcaatgtcttcagaattgtatggtgtcttgtagaaatgatttggtctatggcagtctcacactgtggtgtttaggttttgatgatgatgatggggtcaccaaggtagtttagggcaaaaaatgccaaaaccaaaccataaatcaggggataagcaggaattggaattgggttattaaaccagagacagatcttgcgacaagtccaggttgaatgtcgttaaaataaagaaggccacaatctatgtcaagaaaggatgacaaacgtggaggatcagagacaggaagaattggggagatgagtagtggacagagccgagagaagaggcagtgagccttgtgtctggactgtctaatgagtgttgcccaagatggcgattctccaccttgggccacacacaacgactctgtgatgaaacatgtgggattttggctgggagtttctgggtaaatggatctgaccttttcatatccttaaggactgtgtagtcaacccaatgcttgtaccaattgggaaactaattcaataagttatggctcatgacatctaaacattggaaatccagccactagtcagagaaaatcgttctctcttccactaatctcctttaacattttaatattaatattttcaatcaatttgtgtacaagatacaaatgaaataaaacagaaagatttttctcttctttctttatttttttgagacagagtctcactctgttgtccaggctggagtgcagtggtgccatctcggctgactgcaatttccgtctcctgggtttgagcaattctcctggcttagcctcctgagtagctgggattacaggcacatgccaccacgcctggctaatttttgtatttttagtagaaatggggtttcaccatagtggccaggttggtcttgaactcctgacctcaagtgatccacccacctcggcctcccaaagtgctaggattacaggcgtgagccactgtgcccagccagaaagacttattagaatagaaaaacaatagtcccctgtataacttcgacatttccagttccattttccagagaaaactaatatgaagaattcatatattttttgttttggtaattcactctcttgtatcatttgatttgctgatttacctatttgcttagattcaaaagaataggatttagcttaccgtatgctctcccctcctcttattatactttttgataaggctcttctttagttacactaagtaataggctctatttcttattccatcaaatttaagcaatatcacttgagacccttgacccccttgaaggatgatgctaccagtgactctaccattgtctttgcttctgcttctcacagctctcccaccttatatcaactctgcctttacttttacattctcagggttacatttgtactaaacttgcaaccacaagaaatatttcatctgtgctcataggccgattccaaaaaaaaaaaacaaaactatactatttcgtctgttccatgtgttctcttggaggtttttctttcttttattttttagggctattgtttttctccatgtgcctggtaatctttagttgtttgttcatgtctaagattcaggacttggttgaatttgaaggaagctagtctgggttgctctcccaatgttgtgtgtgtagggtgttttcccactaggtcttagtgaatagaaaacatgactgtgatctctgtgtctgggaaagggcttatcaatggcaggcttcacttgaggatgagcaggaaaggagctggtttttagactgggacctccaacctgccagaatgggtaaggttttcctggagctccagaaatcttcccatcagcccttcatttccatagttatttggtagatttatctggagttctcaggtgtttgccagggtaaaacctggactgccttgggagtgtgaaatgaaggtgatttcaagcttaaggcactagttctgaaggttctatgtcatgccccctttgttctcgtgtcatcctttttgcttgttaacctgtgtctggagcctctctggactctgtcctttaagacaaagataaaatctctcctttgctgtcatattcctgtgcatatttttcaatgctgttttaaatctgtcaacaagttttcactctgtttctgtctttcataaatgtgttaaaaacctcttgtcttaggatggaccattctctctgatgtagtaagcttgtttatgtgtgattattttatcggggtcattggaagtaatggagaaaagcatctattctaagtctgtactcttgatgagacttgctcagacttgatcagactcgatctgaaaactaacaatgactttttgacacctctttggaaagattttacaaactctcctgaaattaaaagtaaaagaaattagttgctatatttataatgctttgaaatatgcatgaagctacttacatttttaatattattcatcaaggacatagagctacatcctaatctgatataattgaggcatcagttttctctgtcaagtgaacccctgaaagtttcctggaagatgagagtaagatagacatctaaatcttatagcaaattatgatatcttccatgatgactgaggttgtttttgtttgcctaatacctgttatctagagtgacaaagaataattgaaaaaaatctcagggcaacttttactggaagtctttaaaacccagcttctttcgtttcatgtttctttgctggttgactttgaaatttcagtatgctcagagaagagtcagatgaccatgaattgagaatagagctgaggcatttcagtttacatggtgaggatgagagaaccaggcttcatcaacaaaaggattaaaataagcatgagatcaaagatttctaacaaatggaaattagggaaggactcttagctgcaatacaaaatggaagcttaggaatgtagcattattgaacaatctagctgcagatttcatgtttccaggcgtggggtacgtttgggtcaagaactaaaaatcatttgttaagagttagtttgttcatttttgtatttaatcatcttttattcattctacaaatatttattgagcaacaattaaggtcttattatgagaattctggggatccagtggggaaaatgtagacttggtttctgttcattgaaagattaagatctgatgtggggtgcaacaattaaagagacaatagtctttgctaaaatctagctagagccaaagcacatcaggataagtcaacaatttctgccatgacagatgtgttcttatatgctgagtatagttaagtaatttgttagtttttttttcaaaaatagatattggcattaataaagtaaatacattcgacagtgtgggcagccttaaccatcagctgaaaattacttcagtaacgtactgttctcagcaatattcacgtacaaatcatgtgggttcccaaaagtttgtaaagagaagctataggtattttccgaagcctaatggcactgaggggttttgatggacacttgaacttccagctgaggaaatggaaatgtaaccactggttcactctggccagattccaaaatcattgtgttgttttttgtttgtttgtttgcttgtttgtttctgaggcagagtttcgctcttgttgcccaggctggagtgcaatgacacaatcttggctcactgcaacctccgcctcccatgttcaagtgattctcctgcctcagcctcctgagtagctgggattacaggcatgtgccaccacattcagctaattttgtatttttagtagagatggggtttctccatgttggtcaggctggtctcgaactcttgacctcaggtgatccacccacttcgacctcccaaagtgctgggattacagatttgagccaccacacccaccgtgtgttgggttttgatcgatgcttgcattccccttgtccttgcaggtccttacctgaatgtttgcaattctgagatttgatagggcaagtggaagagttagaggtgggtctaaaaatgctgtctacctttaggaatcaggctgagaaagagttcgataggaataaactgagcatgcatttaacaagctaaatctacatcaaagggacagaaaggaaccacttgataataaaaatgttgctttgattgaaactgggcaaaaagccaaaggtactggaagaagactctgaaacatactgaattgtttttgatcaaacactccataaatctagggtaaaatgtgaattttttccagtaaattgtgaggctacatcaaaatggtcctcttgctgagctccagagttgagctcttgttcataaagtccttttctctctaatgaaataacagttatagatacatgcattaattcaaaatagatttactgaatatcaatcatgtacaagaatttcttatcaggaattatgatgagaagttacagatttcttctttcactcatttctttgattataaagaagtaatttaacagatttcaccataaattcttattaaaacaaacaagcattcttagagtgtaacagtactcatttgtaaagcaactttatttggacataataaaattaacaacacactctattatatttcaggctattttattcactgctttgtcagtgtttgggagtaactgtttaagatttgtttcctttattatactgtaaaatgctggaacaggaactatgattattttttttcaagactagcccataacagggaatcaataaaatgctaccaaatgaagctgtcatacatcgagatatattgagaaaactaatatgtatgacttgatatcatctttctatataaccatggtttgtgtctaagtgggagagaatttataagatttagagaattttcatatgaatctatctagctcacaatcagagacattagagataaaatgatgaaaatctgataagacaaaattaagtgcaggtccagatagttaattggtgtcttagaggtaaaacagcttatgaagcaaaaacaaaacaaaacaaaacaaaacataacaaaactttctcctggggaggctgagtgtcaggtagccaggcaattctccactggagacctgtgataaccctgatatccatagtcatcaagcatttaggagctccaaaggcaggcttgatgcagggcagtgttagataaaaattagttttacctatgaatgtgtctgctttctgcagcccaagtgacaatatccaagaaaacatacaaaataaagttctagtgtagctgatgtcaatttgaagggaacagggtgaaacaaattgcccttgcaagggtttctaagaataaaatcatcctttgtattggatggatacaagagccaattagcaacaacaggtaacattttttgatacctggtaaaaaatgtttgatacaggtaacattatttgataatggcacttactatttgcaagcacactatgaaatagtttgcatgcatcatctatttcaatcctcacaaactctgtaaattctacactcattaggtccattttacggataaggaaactgaagataagacaagtcaaattgaccaagaaggggcagagggaggacccagattcaggctacttgtctccaaatctcacagccttgagctctgtgtaacactgcctcatctcggagaagaatgagcataagggcgaaagaacagaaacataccctggggaatgagcctggcaggtgctgtacaatgagcatcagagtggaacagctttgagggaagagcctgtaaaccagtaaagaaggtttgctaagaacagtggtttagatagggagactgcagctagatgttcatgtggatacctcatactctattctgttgcaggtataaggtagcagagaaggcacttctgcttagtaaggaaggtggtttcattataatgccaaatccactactgtcctaggaaactgataatccattgctgcgcccagaaaagtggtgtccctattgctcttcattatacgatgccaagtcaaatcttttttttttttctttctctaagtatgatacaaacaatacagagagtttgggttgaggaaagttgttattgtttgaagatattcaatttattaatagagttaataaatacctatttattaaatagatatggaggtatctaaacaaatatctctcatgtgccagacattgatctggaggcataaaatatactatcaaacaaatagacatatgtttttatgtacttggaccagacaataaataatgaatataatacagtcataaactgtatggaatattagaaggtatggtggaaaaattaatcagggtacaggtgggtttggtattggaagtgcattgttattctaactagtttgggcagactagaactctcagagaaggtgacatttgagcatttatttgaagggggggaatacattggtcctggggatatcacaaggaagagtgcttcagcaataggaacagccaatgcaaaggtttctgatgtcctatatgttctatatttgctccacatatgtgccgtatgtgttcccgggtagaagtgatggtggtgtccatgaatgttcttctctgattgcttctattttctcagtgaaataataagcaggattgttagctgagagtgaggatggaaaagggaaaggtggtttgaaggaagataagagtgggtgatacagtcctctatcagtatgggagagggaatgggcatgtcagtctgctagggctgccataatagagtaccatactggtgcttaaacaacagaaatttattttctcacagtccgggaggctgaaagtctgagagagctttaaggcaaagatctgttccaggcctctctccttcatttgtcaacggctgccttctccttgagtcttcacgtagtctgccctctgcacccaactgtgtttacatttccttttattcaaaggacctcagtcatatttgattagggctcatcctaatgatctcattttaactcaattacttctttaaagaccttgtctccaaatacagtgacatttgaggtactgggagtttggactcaatatatgaattttgggaggacacaattcattccataacaatggacaatatacagctagaagagtcaggagttaagaattaatgagaaagaacttcactaggggtgagaattgagagtttatattcaatttttaaataacctctactcagaagctctggatgtagcactttaaaatttctcaccaatatccgagaagacacagacaaatgtgaaagctcaaatggcaacataaaaataaaacgaaacaacaactgacctaacaattaacaagacatagaggacaaaaaaaaaaaaaaaaaaaagacacacaaaaaaacgtggaacaagcatggcaaaagtgggttctgtgtatgagatttattttttttttaactcagagaaatgaaataatgaatagaagaaaagaatcaaccccagtgaagcaaaactgcaccagataaactatcattggagactagatattgaccttgggattctgcacagtaacctgctctctagctataaacctgagaacacaattgatctgtcactcacataagattagcagtgtcatgggcaaatcacataacagatctgttgacgaacgcttcatctctgtatgttctgctttattggaaaaagagaaaagtaataaaatcccgtgaagaaacagtgcagaaccagggtaagaaacatcatcatgaagatgcaggtgagaaggtgaatttaaaaattattactaaagcattgactagaacacattaggtagataacaaaaaatcctaataggatgcaataatacatcattccaatgaaacaatcgaaaaaaccctaaaaggagatataggatgtgatgacaaaatatatacctgagacaaagaaggacagcaaggaaaatagaataataatccaccctggattgggtaaccgtcagaattaaaaagggagaaatgggaataattgtttggaagataatatttacaagttttttgagaatgcagaggtaaatgacagcaataagaaaataaaagaactgatcttattgctgaaaaaaatattaaaaatcaataggagagaaacaatagttaaaactataactgattaaaactaccttgcatgtgcaaattgaaaggctcgttaataatgagaacagattcacactgtgacatatcctaagtctgttcaaagaaagcaaaattaaaaaatcaaatgaccaaccccttccagtacaacaaactccttataaaacatccatggagaaaaaaacatcatctactaaaatgtttgatgcaatccaaaatgccaaaaatatagagcatattttgcaaaagtgtaattcgatctaataattgtataattagccaacttgtcttttgtttgttaagggagacaaaagtatattcaaatatagaaatggtacataaaagtgccaccattatgatattcttttaaaaaaatcacttaataacaccagttcacagaagtgaaatgaaaatcagatgttgaatgacaggttgaggagataaaaaaagagtaatataaactgtagtatattgtgattcagtggaatgatgaagaatattgaaatattttattttctaaaatgtataattgacatataataattctgcatatttatgggaaacaaggtgatgttttcatacatgtatacattttgtaatgatcaagtcagtgtaattagcatatccatcactttgaacatttatcatttctttgtgatgcgaatattcaaaaatttcttttctagctgttttgaaatttacagtatacattattgttaaccctagtcatcctactatagatgcaatagaccaacagaacttatctcttctttctaactgtagctttgtacccattgaccaaactctcacaaaaccccttttccccattctctggttatcactgttctactctctacctctgtgaaaacaacttgtatatttcagagtgagatcatgcaatatttctctttctggagactgaagataatctccagattcatccataaagactgcattcttttttgtggccaaatgatactgcattgtgtatatataccacttttttttttttttttttttttgaggagtatctgtctgtcgcccaggctggagtgcagtggcgcgatctcggctcactgcaagctccgcctcccaggttcatgccattctcttgcctcagcctcccgagtagctgggactacaggcgcctgccaccatgaccggctaatgtttttgtatttttagtagagacagggtttcaccgtgttagccaggatggtctcgatctcctgaccttgtgatccgcccgcctcagcctcccaaaatacaactttttttttccattcatccattgatggacatttaggtttattccgtatcttggctatgggaataatgctgcaataaacatagagtgcagatatatctttgacatactgatttcatttctttcggatatatacccagtagtgcggttgctggatcacatagtagttctatttttaatattttgaggaacctttataatgttttccataatagctgtattaatttacattcccacaagcagtgtgtaaagggtataaaggttccctttcccaacaacatcaccaacacttgttatcttttgattttttgatagtcattattctgattggatagtgcctgatctcctggtagttttgatttgcgtgtccctgatcattagagtcattgagcatttttaaacgtatctgttggctatttgtcttcttttgataaatatttatttaggtcttttgcccattttaaaattgggttacttgctttgttgttgttgagttgtttcaattctttataattttggatatttgttgcaaataaattatttcattctgtaggttgtttctttgctctgttgattgttacctttgctgtgcagacgctttttagtttgacatagtcccatttgtctgtatttgcttttgttgctcatgctttgaggttttatccaaaaaatccttgcttaaaacgatttcagggagcttttctcctatgttttctactagtagtttcacagtttcaggtcttatgattaaatctctagtttattttgagtaattgataagagtctagtttcattcttctgtatgtggatttctacttttcccagcacatttattaaagaggctgttctttctccatggtgtacttagcacctttgttgaaaatcaattggctgtagttgtgtgtgtttatttctaggctttctcaattcagtatcatttttctatgtacctgtttttatgccagtaccatgttgttttggttactatagctttgtggtatattttgaagcgaggtggagtgatgccagccaaaaacagacaaacccaaaataagggtggaagggaaaaaataataaatattggagcaaaagtaaataaaatacagaaaaaaagcccaggagaacaaaaaaagttggcttttgagaagataaacaaaattggcaaattttagctagacttaaaaaaaagagaagactcaaataaatgaagtcagagatgaaaaaggagtctactaacaacaattaaataaaataaaagtgaaattgatatgtacctatgcataaagctatttgctataacttgggtacattgtgtatttctaaagaaactaaaaatctatcaaactctaaaaaaaagaaaagaaaagaaaagaaaatggagtctggcatcacaagatacaaaagatcattagatactattatgaacaattatataccaacaaatggggaatcctagaagaaatggacaaattcctggacatatacaatttattcagattgaataatgaagaaatagaaaatctcaatataccagtgagtaacaaattaaatcagtgataaaaaaatctttcatcaaagaaaatcccaggatcagatggcttcacagctgaattctacaaaacacttaaagtggaacttatactaattcttctcaaattattgcaaaaaaatcaaagtggagtaaattcttccaaattaattctatgaggccagcgttgccctgacaccaaaaccagacaatacaatgacacaacagaaaaagaaaactaaaggacaatatttccgatgaacatatatgcaaaaattctttttttaaattttattttattttattattattatactttaaggtttagggtacatgtgcacaatgtgcaggtttgttacatatgtatacatgtgccatgctcgtgtgctgcacccattaactcatcatttagcattaggtatatctcctaaagctatccctccccgctccccctaccccacaacagtccccagagtgtgatgttccccttcctgtgtccatgtgttctcattgttcaattcccacctatgagtgagaatatgcggtgtttggttttttgttcttgtgatagtttactgagaatgatgatttccaatttcatccatgtccctacaaaggacatgaactcatcattttttatggctgcatagtattccatggtgtatatgtgccacattttcttaatccagtctatcgttgttggacatttgggttggttccaagtctttgctattgtgaatagtgctgcaataaacatatgtgtgcatgtgtctttatagcagcatgatttatagtcctttgggtatatacccagtaatgggatggctgggtcaaatggtatttctagttctagatccctgaggaatcgccacactgacttccataatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccggtgatgatgagcattttttcatgtgttttttggctgcataaatgtcttcttttgagaagtgtctgttcatgtcctttgcccactttttgatggggttgtttggttttttcttgtaaatttgtttgagttcattgtagattctggatattagccctttgtcagatgagtaggttgcaaaaattttctcccattttgtaggttgcctgttcactctgatggtagtttcttttgctgagcagaagctccttagtttaattagatcccatttgtcaattttggcctttgttgccattgcttttggtgttttagacatgaagtccttgcccatgcctatgtcctgaatggtaatggcaaaaattcttaacaaaatactagcaaatcatatccaacagtatatgaaaaattgttcaccatggccaaatggaattaatcccagggatataaggatggttcaacatatgcaaatcaacaaacatgatacaatacatcaatgcaatgaaggacaaaaaccatctgatcatctcaatagaaacaaacaaacaaacaaaaaagaatttgataaaatttaacatcacttcctggtaaaaactctcaacaaagtgggtatagaaggaacataccacaacataataaaggccatacataaacaatccatagctattatcatactacatgggggaaagctaaaagctttctttctaagatctggaacaagacaaggatgcccactttcaccactttcattcaacatagtactgaaagttctatccagaataatcaggcaagagaaagaaagggcatccaaattagaaaagagaaagtcaaattgtctctgttcgcagacaacacgatctaatatacagaaaaccccaaagactccagccctgcccaaaatgaaactaatacatttagtaaagttgtaggatacaaaatcaacatacaaaaattagtagcatttctatatgccaatatagagttacctgaaaaagaaatcacaaagcaatcccttttacaataagtacaaaaaaacactagaaataaatttaaccaaagaggcgaaagatctttacatcaagaactagaaaacatttatcaaatgaattgaagaagacacacaaaaaatggaaagatatcccctgctcatgggttgaaatggacattgttaaaatatccatactaaccaaagcaatctataaattcaatgcattccccatcaaaataccaatgatatttttcacacaaacagaaaacaaaaatcctaaaatctgtgtggaaccacaaaagaccctgaataattaaagcaatcttgagcaaaaagaacaaaatcaaaatattttctaaattaaaatgaagacatttaaaacatataatattaatagcaattgctgtataattgctgatgtaatattacattaacaaagaccagtatgggaattagaaaaactcaaaaaacttaaatgttaacacaatagaatagaatgtatatcttctgaaacactgcggatcctataagtaaaataaaacttctaaaaaccctatatagtaaagaaaacaaaagaaacagcaagatcctgaaacaagaaaacagaagctagagcagatatatgagctaaaattgagctaagaaaaaaacatttgtgtgttctgtttgagaggaatgagttattataagcaatagcattaaaaagatacccattgtaaatattttgtggcaatttttaaaatcacaaaggtaaagaaaaatattctaaaatcatataaaatatttcagaaggctgttttaatttaaagatggagctctttggtaaggtaaaaacaaaaatcttacttattaagagtgtcataaaaaaagtacaaaagaatttccaaataaaagaataggcaaagatttaccaggcaaatgaaaggtttacaatattagtgttagagatttagaattccaggcaaaggtcatttaatagttggaaatcattaagtggggcaaaggaaaattaaaataaatcaatgataaaattaaaaggcaaaggcaaatctgggaactatttgcaatgtttactacagtcaataagctttcagtatttaaaaaataaacacctcttcaaggcaacataaatagttgaggaaaaaaaataagagaagtggaaggagtaaataagtgtgaaaaagtttaacccacttagagagcaaagaaatgcaaaataaagtgacaatctgtttttcacctactaatatgacaagtatggatttattttttgtcattttgtttttaaaataataatggcaacttcgagtttgtaggtaattgaaaattctaatacattgttgatagatctatgaattaccagtcttttttgaagggagaaatattcatttcctttgattcagtaatttcacttctcagcatttattttaggggaaaaaagcatgtagtcacacaataatgtgttacaagagagttcatcatagtggcatttgtgctactacaaaacaaaaacaggtttttctttcctattttactaaagacaaattttaaagtagactatgttgtaaccatttaaagttatgtttctgaaatatatatgatgatagagacaatccccatagttaataatgttaaataataaagagcaggttaatagattttcatttcaaattctatttataaagtatctttatagaaaaaataaaacaaaatataagaatagaagtggatatttaagcatggtagaattctgagtgatttttgttttactttttatttggtgtatttccaaaattaactgtaatcataaatcaatgttagaataaaatttgacttaaaaatacttgcccggtgctgaaaataaaataatgtggaatttttccttagcttgaatcatttgactatttttcgaactcaaagttattcctgattcctcaggtagaattatgttttgtgtcaactacagtatgctttatgcatttccctgaagatacctaaactgtgggggtttttggacttagttgataacatatttgtctctatctttaggactatgactatattagtccgttctcacactgtataaagaactacctgagactgggtaatttataaagaaaagaggtttaattgcctcatgtttccacaggctgtacaggaagcatggcagcatctgcttttgggggggcttcagggaccttttactgacggtggaaggcaaagagggagcagatgtcttacgtggcaggagctggaggtgtcacacgcttttaaacaaccagatctcacgagaactcactcactcactcactatgatgagaacagcaccaggagatggtgttaaaccattcacgagaattctgtctccatgatccaatcacctcccacctagccccttctccaacattgagaagaacagctggacatgagatttggctggggacacagatccaaaccatatcagggactatgagcccctcagtttgaggtatcctattctattaatattttaatatgaaatgcctcaacaatgggctgtttcccacatattgataatgcttatcaaatattggctgaattgaatgaatttattctactttgattatggagatagaaacttacaggcagaataagtggtttataaaatcagttaataatacaaagcattttggatgtgggttttttaatgttgtattctcctaatttaccaacttaacctatttcctgcttaccctgagaaataagctctggcagcaagctgcacttttctttctttctttctttctttttttctaaatgggaaacagattaaatatttacatgttcaggtaatttggtcccatcttatttatcttctctatttcatagatatgatatagttctaagtaacctacataaaaatccttttacttacacatttttagtaaatactgggcttgaaaaaatgtataatttaaaaatctcatagtttcataattaaaaagccatcatgcttgaattgaagactgtcctactaaaaggtgcaatgatttcccacaacttgaaatgcctacagtcagtagaatttactaattttcatatatattacatttctcctttacataaagaagtaatattttttctttctttggaaatttaaaagagggaaaataatgtggtagtgtgtatcagggaaactagctggatgacctcacggtatcattgatgtgtaagggcacaaacagcaagtatgccttggggaagagtgtaataaatatgaactggaaaaaaactacctgaaaggatattgcagctataattagtgaatcctctatagaaagagtcttttatatttatcattttactccagtcaatcaagtgatatttttaaggtctcttcggtactgttttgtgatacatggagacttagaatttaattgggcagagtaaacagaaaaaaaatgataaaactatctgaatgtatgatgagtatgtggttcatgcctattttcttagggtaattattaatagcatttattttcactcatctatgtgtcaaggataatttttatggtcaccttagtgtgatggttaatattaagtgtcaacttgattggactgaaggatgcaaagtactgttcctgagtgtgtctgtgagggtgtgaccaaaggagattaacatttgagtcagtggactgagagaagcagagacaccctcagtatgtgtgggcaccacccaatcaactgccagcccagctagggtaaagcaggcagaagaaggtgggagaaactgacttgctgaggcttctgaccttcatctgtctcctgtgctgaatgcttcctgcccttgaacatcagacaccaaagttttcagcttttggactcttggacttactccagtggctctcaggccttctgaaggctgcccggttggcttccctatttttgaggttttgggacttggactaagccactgctggcttcctcgctcctcaaattgcagatggcctattgcaggacttcaccttgtgagcatatgagtcgattctccttaataagctccctttcatatagacatctatcctactagttgtgtccctctagagaaccctgacggatagggtacatttaaaaaagacaaatgatggatagatatatgtaaaactgaaggacttgagacctgagatttttccactatggccttcatatacccctgtccgtggcagctgttccagcctctcttgcatgtaacataaaccctaactatttctcttcactcttttgataaaatccaggctgcccaaacaatagctgctaatccacatgaaaaatccttctggaaatgagaagcgtttccagaaagagttgaactttgaccaacctcaaagtttcctgaaatattccactcccttccccaatttagaatgtttctaccttccttcacagtcttctcttgccagatatttttgaataaagtcttatgggaatggtgcgctggttgattttcttccccaagcagaaaatactacaggaattcagaggtgaggtgggtgagattattttgagcttttgtgatcaaaggagattaagggagtgaggaagtatttgaattcagcttaaatgagtgaattgtttacagattaaaaaatacattttatatatttagagtttattattggagataagttttacccaagtgttcctacatatatcaaggctaaaaatatgtgtaaaacaaaattagaacctggaaaactccttgtgaaggtaaatatatgaatatatgcaccaattaaaatgtaaataaagccaggaactgtggaaagccttattgcagacagtacttcagtttgagccatcttttttttagttttgatgtggatttctaaaacctgcatacattctaatccacagagtctcaaaaatttcattcaaaaggaatttttaaatgaaaaaccatttacttggcatggcaaaaaagccagagctttcaaataaatatttttaaaaccctttgatttattataatgtgacaagaacattatcactaaaaacaaatataaatgtgttatttaaggtataaatacagaaacaatataatcatcagaatatttatgttaagttctcagccacttataacagccaggttaaacatgtgttcattcctgcaaatttcaattgcccctaaatgtattgttttgtcctagtcattatgcgtttcagtgcagagtactgttcttttcagatatggaagaaataaagtgggacctatttctgtctctttcaagtgggatttgagtgtagttacagagcattgtgtttacctggtctactctttgggtatctatggtctgaatgttcatggtcctcaatgcaatagtattaaagtgtggggcctttaggaggtacctaggtcatgatggcagagccctcatgaatgggattagtgtccttagaaaagaggcccagagaactgtctcttccttctaccaagtgagaaggcaccatctgtgaactagtgagccttcaacagacatcaaatctgctggtgcattgactatagttccccagcctttagaactgcaaggaataaatttctgttatttataaattacctagtttatggtatttttgtcataggagttagaatgggctaaggtaatattttagattaaaggaccaaggctctgcttatggaccagtggtgtgctggtaaatgttttaacaacaggctgttctaaaaaaaaagtagggaactgatttgtagtgtttgccaattttcgtgctataaatactatcactatggccatttcaaactaccaatgcaatgtcaccgaaatacagctggaaagagatgtactgagggacaccattataaatattttcatcgcacaggcatgacagacgtgaataacttcaagggcatagatcaaagtaaatgtaggaaattaattaggaagtgatgagttttgcatatttattttctttgctttagtattatttatctaattagaagttcatgtaatttaacttttaataaccactatggttttttttttggctatacaaatgcatacattttactaattggatacagaatccattaaaactctgaagagataagaattgaaaatatttgtagacagaagacaatcagccagtcaactgaggtctttaccgaacctttaaaataaagtttggcagagaatggtttctagatttttttttttttaggaataaaattccatttatatctttgggtgccacaaacttagaaactaccatcagagtgaacaggcaacctacaaaatgggagaaaattttcgcaacctactcatctgacaaagggctaatatccagaatctacaatgaattcaaacaaatttacaagaaaaaaccaaacaaccccatcaaaaagtgggtgaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggtgattcctcagggatctagaactagaaataccatttgacccagccatcccattactgagtatatacccaaaggactataaatcatgccgctataaagacacatgcacacatatgtttactgcggcactattcacaatagcaaagacttgggaccaacccaaatgtccaacaacgatagactggattaagaaaatgtggcacatatacaccatggaatactatgcagccataaaaaatgatgagttcatgtcctttgtagggacatggatgaaactggaaaccatcattctcagcaaactatcgcaaggacaaaaaaccaaacaccacatattctcactcataggtgggaattgaacaatgagaacacatggacacaggaaggggaacatcacactctggggactgttgtggggtgggaggaggggggagggatagcattaggagatatacctaatgttaaatgacgagttaatgggtgcagcacaccagcatggcacatgtatacatatgtaacaaacctgcacattgtgcacatgtaccctaaaacttaaagtataataataataaaaaaaaaaaagagagagagaactgggataaccactatgtttaaccaccagcttgcaaaattcctgaaaatttaacaacaggtttccatagactggtaagagcaggctccagagcagcacatgttttgtgtttactcctttgttttcgaaatatggtcctacagactgacacttcatcaacaccacctagaaatctgttataaatgcagaatctcaagttccatgccagatatacctaatcagattcttcattttaataatatgttcagataatttctactcaagttacagttttagaagtcctggaaattttactctaagtccatgccaggctcaaggatgggacagttcttgattaactgaaaagtgtactgctaacacaagttttcaaatttggagggatatatttttaaagcctgtaactgaaaaactcaatcagattttaaatcttgaaagctagggggaacatggaattgggacacaggttaaagtagttgtctatgtgtataatccacatgactttagatataacccaattaaaaataaatacctacttaattgtcacagccataggaaatgcctaatgatataacaaagagtgtgtgtgttacggcacttatgtcttccatgatgaaaacatctaattttaagttggatgtcaacaatcaaatttttcttcctaaaagtaagtatttaaaattctattcataatgaacagatctgcacatgaagaatggaaacactggaaaagacaaaaatgcagagatggactgaaagtactactgaatgtagcattccatagacaggcaaagtaggagttctgaattttgcagaggattttggagaaaggtgttcctctcttctttctttctttcttttttttttttttttgaaacggggtctcgctcttgtcacccaggctagagtgcagtggcgtgatgcctcactgcaacctctgcctcccccaggttcaagcaattctcctgcctcagcctcccgagaagctgggattacaggtgcctgccaccacgcccggctaatttttttgtatttttagtagatacgggatttctccatgttggtcaggctggtcttgaactcccaacctcaggggatccgcctgcctcggcctcccaagtgctgggattacaggcgtaagccaccacacccagcccgaaagctgttcttaacaatttcaataatcagatggataactttaggtggatatcaatctgcatattcctccacccgctcagtgcttgattttcgatgacctcggaacagagagaccgtgatgacagagatgaagcttctctatgagcagaacaaccgaggctttcccttcaaataggctgttgtggctactgattattgctgagtacccagcctccccaaaatagagagtaaggctggatcctcaatgtggcactgaagcctgggtgatccagcccgagacgtggtggctgagaggttacaccaaactgcttccatcatggtgggtatagagccaccttcactggataaggtatgcattctgcatataaatttaccttccctgactgtgacatttttgccagtatgactgtccatgaactcacaaaatgcaccatctacagtcatgatatcctgctcagcattgcttcttcttcttcgtatttttttttttttttttgagacagagtttcactcttgttgcccaggacagagtgcagtggggtgatcttggctcactccagcctccgtctcccaggttcaagcgattctcctgcctcagcctcctgagtagttgggattacaggtgcccacctccacacccggctaattttgtatttttagtagacacggggtttcaccatgttggccaggctggtcatcagctcctgacctcacgtgatccacctgccttggcctcccagagtgctgggattacaggcctgagccaccacgcctctgatcaaggaactcatttcatagcgaaggaagtgcagcagtgcctcatgcccacggaattcactggtcttcagacatacactgtcaactggtctactggaaaggtggaatggcttcctgaggtctcagtgacaatgctacttagaagactacaccttgagaggaggggcttttatcttataggacacagtatattctttgaatcagcactatgggatgttttctcccccttagtcataagacctgggtctgggaatcaagaagtagaagctgggtggctgtaatatcattgaagtcaatataggtatgtagatatgacagatataaaggaggagcttatgccagttattaatttattgcctctcagctcccaactcaccctggtttgccttgctttgtgatgttgcaactacaccctgaagattgcatgtgcctgcaccagctggcttgaggttaggctctcctgagaagacactggagcactggaagaggagggagggatttttcagctcctgtattctgtttcccatggaacattaaggacgttggcatgaagggaacacagcagcacacctcttagctgcagtgccctctgtggtttactcaagacaccccctggcacatatgttcatcaccactgcagtgaactgcttctgtgcttcatgagcagcatcctctaccaaggttcttggtcactaaaacgacaagatattctcgtggttccaccatgagtggttccattacgtttctccatgacccactggtggcagcatgtggcactcatgccatctcctccaaggtttaaatctcagacttgcagcctcctcaatatttctttttttttctttcctgtttctttttctttttttgagaaggagtcttgtgctgtctcccgggctggagcgcaacggcgcaatctcagctcactgaaacctccacctcccaggttcatgcaattctcctgcctcagcctcctgagtagctgggattatgggtgcacaccaccatgcccagctaattttttttttaaatatttttagtagagatggggatttcactaggttggccagcctggtcttaaactcgtgatcctcccgcctcggcctcccgaagtgctaggattataggcctgatccacctcgcccagcccttcttcgatatttctaagtttcttccttgttcatcattccctcggccctgggaagatttgctggtctgtggctgctccctctgtatcccttgcaatcaggttttacctcttagatattctttccattttcccttttcaaattcttctgactggatcctgactggtaaatataacttgcttcttaaaaagtttttcttgggtgtgaacttctcacaatagcctctgtaatttattaaaatacttattaagttaaagcttagaattaaatggagttctcatgctaccgtatgggttttaaactaatccttttgtggaactgaagaactcttctgtgtattgttatatgtacacactcattctctgggactttttactgtcattattgttttaaatgttttaccacagtaccaaagttttctaggtttgctctaacaacaattgactacaactgggtggcataaacaataggaatttagtctctcatagttcttgatttcacatttgtagagttaaatgcataggggaaaccctgagaaacctgtaggggaatcctttcttgcagcctctgaacttctaatggattgctggaggtttttggcattccttggcttgtggcagcctctctccactcagccttcattattatatggccttcccccatgtgcctctgtcttcaggtagccatcttgttacaaggacatcagttgtttaggttagggcccattttagtccagtacgatctcatcttaactaattacttctgtaactactctgcttccaaagcaggtcacattctgaggtaccaggggttagaacctcagcgtatctttttgagtgagatatatttcagcccaaaacactttccaataatgaaatattagccattaaattttttgacatgtaagtatcctcctgaaatactaccaggcaagaaactaggttattaaataggctttatcccatttttctaaaagaaaatacatgttttataattagaaaatatatattagtttatctacttaaaatgataacaatagttatctctgcattaaagaatagtgggattataaaaaatttacctatttatattttataatttttccccagtgagtttgtatgaattctgtgataacagttttttaaatttaaaattgctaacgatgttgttatagataatgcatttgtgggaaagcctactttccagtttttaaaaacgttttgcatttctaaaaatccaatgttttagacaaggtattggtggcaataagtagtggtagaatgggaaaggaaattctggcttgattgcagacttgagtgttcgaatcaggctctgggataactgattgggttgtagagatgaacaattgtctagaattgtggtaggggttgggggagtcagggtgagatttttttcttgttctacatgactcaaaaattaagctttgacacaaatacacaaatatgggtgtggccaacttgctgttgtctgtgctaaaattgtttcagagtgaccaaattaaacttaaaggattagacatgaagaagtcgctgcaatctgtctcttgtaaatgatgctaaaccataaataaagtctatgcacttatgtctctctcttgcagtatttccagaaaaaagttatttgcggagttgttccaaagtgatatgagagtcatggccaatgcaggcgtttacttttcgatttctggattctacatctctgtggcttctgatttgaatttctatccctctaaatgattccctctaaataaaggaaggcttagtgaagaggtattttggttgtaaggcaggataaaacactacaactctaagcataaaagtcaatacaaataatattaatccccgtatctggcatatttggcaagagttcactgagaattaacataggtagttttcagacatcaaaaaagggcccttagatagttttttttaatacttcagcataaggaaagcatagttatggagtttggctaaagactaaaataagttgggcaagtaaatatctgggctacttccccaaatttacttggtatggtccatataacttctggatactttctagggaaatttcaggggacattccttaactgcttttggtattcctttatgaagagttgaagcttaagatgtcaggaaataaagtagtgagttaaagttggtttacctagatggtatctacccagttcatttctctctggagactcaactctctcacccaccacacgtcacaggtcaagtcttatcacttagtagccagtttaatgatatgtcactttgctcccttggccatagatactcggactaaggttgaatacttgatccaaactgggcatagtctatttggcagtcaacttggattgctcagtaagagattgtagtctttgctttgctggtctctatctacaaaaccttgagatcatttcagaaacgtttgtcactatataacagtgtaaaaatgagcagaattccatgaaatcaactcaaatgcaatcaatttattttacatggatttcttcagacaattaattaagtacacagagggttaccagaaattttgtatattttcctagcacctttatattaggttggtgcaaaagtagctgtggtttttgccattaaaaagggtaaaaaatgcagacttttatcattcagggacttccaaaaacttgtgcatttcagctccagtcaagttgaaatgtcatctcttctcttccctgtggttggcccaaagttcattgcaggctacattgttgtctgctctgctcattgtctgtctgaggtctgcttattgaaactttctccgttgtcaccatctcagaattgaattttttttgctggtgttttccattcttcgtttagcaaatgtgtattaagtacctgctttctgctagaagctggatacagaactggcaagctgtagtgacaggacaatcttctgttctcactgagctcacatcttggagaacagaaacattaataaaatatgtatgtattttttcaaattgaaaaacacaaaccctatatatttataatggacaacaggatgttttgaagtaattatatgttggagaatggctaaatcaagctaattaacatatgcattacttcacatatttattttcgtgtgtttgatgagaacacttaaaatctaccctcttagcaattttcaagcttacaatacattgttattaattatagcaccaagaatctaaatcagtttgtttaacaaatttagtaaatacttattatttcctatgtattcctcactgttctagatgtcaataataaagtgtgaaaaaaatgataaaatacctgttctcaaggaggttactttgtagttgatataaaattataaacactgatacaaatgcaaagaaatattacagagttcaattgtgacatataccagggagacataatctgaacgagcagtttgagacgatctcctgagttgtgatgtctaagctgaaccatgaaagctcaattaggcaaagaggatgagcagtggaaaatatttcaagtagggaaaaaacattaagaatctgagctagttaccaagtaatcatgagaaaagtgctgaaatatgaaaattcaaaggtaattaaaagtactagcaattagtcctaaatccctgatcaattaaaattaattaagtgaccatagagctagtttctcttgagactatttccaacattcaatttatgttaaaaatattttatttatattattaaaaatatatattattcatgctgtatttgaaagtgaatattcattagggaattcttatcaaggataggaaactatagaagattagatttaggataaactcagttatgtagaaatatgttaaaattggattgccaagacgcaagcacaaattcatagtctatatagttttgaagttagtgtatttaagatatatgtgcactattgacttttttttcttttttacaaaagaaaataacagcatcaaaagatttcttttttctattgttgagcttaaatgatgattgcaggttagaaaatcagaaagttatattctaagtctgtgactttattttgttgaaaacataaagattcatatgaattttcatggtataaatgattatgaagtgaaataaattttctagtattatgattattcttgaggataatataaaatataatagtctaatataaaatattcataatgcattatagatatgagatttaatagaattagctgagtaatgaggacactaacaattgttagattaaaatgtgtttgattatcccctctctgtttatgtatcctaacttcttagtttttcatattactttcactatagtaatttgttcttccctaactacacatgttcatttttttcttctaaaaaaatccaatggcctaggataaaacaaggaatacttacaatacagatataataattgatagggtggaaagtaaaattttcaccaaggacagtgtagaagatgacttgttaatgaggtttcacaatgcactaaacatcctgtccataggtaggtttgtgacttgggtgcattcaatcctatttcttcacctccttttccaggctgccccaggtgattgttgtcattcaaacaagttcagccaaggttatcactacatgtgtagatgtggagtgagaaagggtcatttttttttttctctgtaggtatcagaagcctagagcttctcttgaccatttttttttctactacatggagtacgtctgcctaagaataaggtaatcacaaaagaaggcagagctgagtagtgaagaacggtatagaggctgcaagactacatttgagcacttgaagcaggaagagttcaaagtcaattatgtaactctggacttgtcagttctatcagccaacatgaatgtatgtattacgtgtttgtgcttaatgcagtttagattgggcttctgataattaaaaccaagctgaagagatgtgacaggtgatacccatcaaattttacagaaacagataatttatatattatttaagctccctggggacatagatgtcttcctaatccaacttgacagcaaaacttctgtagttttctccaaacatacactatattacagagatattccacttataactatagacaaaaatattaaacatgagtaaataaagccaaataccacaaaaataattgaatagcgctaatgattttttttaaggaattcatcaataggaatcgtattaacatagtttttcatattcatatccaagggagaattttgatcatcttgataaatatgaagttataaaaaatgcaacttcattctagattataaaatagaatgaaaagattttcattttataagaaatatcttgaattaatagctagctttatattacatttttaaaattagaaacatctacaatctattttggaacaagaaattgttttataagttatagcacattgaattagacacaaaaccataaatagtagttatgttattttcagaccacatcattacatagatgaaaagtataaaatggccaaatcaaataatatttgtttgattgaaaaggaaatacataaatgaaaatagtcatcattaaatagtaaaaaagtagaataaaaaagatacagcattcacaataaaatctacttcataaatttctcaggaataagatttaaaaaaattttctgctaggttgaatatttctaccttatattaaactcctttatagagctttcatccctaaacacagatcatgttagactaattttactaatgatttatgttgatggcctccctgtattccattgtattctgcactataacttagcagtcctcttccaccttgacttggctcagtcatgtgtcttgcttgggccaagaagaagtgagccagtgtgatataacatagacttgagggattcttacacattaggacttatccttttgtgcttgctctctttcttctctttggttccaaccaaagccatcctaggctattctaggaccaccggacccccagtacatgaaagaactcacccaggatcctcgagttttccacccaccttgaagctagctgtaggtatgtgattgagctcagcagtgatcagaaagcactctaactgactttcaggctcctaaacaagactaaattcttagtgtttgggtcactgagctttgtggggttttcttatacagcaagggttaatttaaacacaaataaatagattagaaaagacaaaccttggggtctttagaggaaaagagtgattctttaatacatggtaactgggtaacgtttttgaaaataaattggcaagctaatcaagttagaaacgcatctcccatcttaagccatactgaatttgagatgaataaaaatattggaaatagaaagaatgttcattgtaagcatcaccttacatagaaattttaattaaaatattatatttcattaagtaatgaaataaaaaatcttttgctccatgaaattctccttaggaaaaaacttacctgtgttttggaggatgctctgtgtaaagcactttatccgctagacctgaatgttcaccctggcaaacacactcctaagaatgaaggaacttgccttgcagtagtgtagatagcctgaaagattacacaacacgtgttgattgattagttttggatggtacaattaagatttaatttacttttctttacatggctttgtgcatttcttgctttttttctgtatcctctattttttgaaaaataccactttcataatcatgcagttctaaatattttgtactgtgtattattattttctccttaacccacaagttatttgtgagtgaattcgttttttaggttcttaacttattttttttgataggaagagcttattgacttgtaatttttttagaatgggttaacgaacaatatatgtgataataactttgggcctcattgagacatcatgtagttgatttaaagcacattattgctattttttttttttttttggaaagaggggttatataggagactagatctctgttagctcaaacttattaatcgcgttcctcaaatcttccttaccttctctatttttgtctgcttggtccaggagtttctgagagccgtgtgccaatacatcctgataatgattttggaggtgtcaaactcccattaaagttttatctattttaactatgtttttagggacatatggataattgttttatagtcaactttctcagtaactatgcaacacgtcctcctctttcctcaactcttcaatatccacttccttattctcagctgatagcttactgagaaaatagagacaaccagaagaggctttccacattctttctccatcaaatctgccaaactcgtgctacctgatatccttcttgtcacaatgagtgattgcccatctcttcaagagcatagtcatccttctagagaacacaaagatttgcccctgcaattgtctctttccttcatcattaatttcttcctgtagttctattttctttacaacctcccatctcctgttattcttcacataaattaccttcattcaaatgaaaccagcatggcagcccctcctttcttgaccacattgtatgagatatcatgggatcttcctcggattagccttttgctgattccaagtgctggggtagtttgaattctattttattggacgggggtaaagggtaaaaatgcatctggtttttcacttccagttattccatggcagtgatccttcctaaaacacacaaaggtaaacatactttgtcaatacaagaattaattctgtttctgctggagactgctggtttacgtgagggatgcacattctttctgtgaatataacttccttgcaaaaatgatgtagttgaccctgctatgtaaatacacattctttcttggcctgatttttattataaaggcttatcatcttaattaacaaagacacaactgccatgaaggaaagtgttctatttctatcctaatagaagggtagggtatgtatatgtgggactgggagctgggtgaagaaaactggagttgaggaatgttcagattactttgtcctaacagtaggcttataaatctatttctaaaggattcaagctgcttttatagtcttacagaagctgctcttcacctcatctgttttgaagaccatggccactgttgatttctcctctctcatgattataaagaaatggaagactcactaatctgatgggtttttggggttcacccagttctcctagaaatcctggttggatataatgacggaatttcaggtcatgcagaactggatacaaaattttatttctccacttactgtctgtgtgatttgagcaaagttatttagtctctgtctctgtttatgaaaacaggaaaatctcatggcttgtgggagaatgatattctacagagtttttgttagggattgcatgaaataacagacataaagtgcctagcacagtgcttgtcatgtattaagtaccctatagatgtttcattttctcctgctgagtatctgtagacactggagccctccacctgcagaattgtgttaagattccattcaggggacttgaaaagtatcttagctttttctatttttattgtcccccccaccccccttgatattcatgtcccctttcacaagtgatacagtcaagccacacttttgtacagcatatataaagtctgtaactttaccccagtccttaagttagtggggtgggaaatatgttggacaccccagccagtgcttaggggatgtctttaagacactcacttgagtaggacaaccgtccagattgcactaggagaggaagttctgttttgcatttccctcaagcagactctgccgtggtctcatttgtacatgatctatatccaaattggaacagagtacctttccagaaaatccttttttcccctttcttttagaaaggctcgtttatcccaaatcgcatcccacatgcttaggaaacacttgacggcttgactcgcaagcctggagagacacttgcacgtagtcattgcattttctcagatgacagctggagagcctctcctgcgcagctgctccctctgtcgcagccaatccagctggcaggggacagcacggccctttcctccatcaagtgcagcacaggggctgtctttcctggttgcttgccctacataggactgcttgtctgctaaccagagacaaaggataaagtggcttcactccatcttagacacagaaaggattttacagagaaaatgaagacagccaatattctctcatgtctgctttggaagtagtcactaatttcagtagttaatgttagcaggaatatcttaatggctggtaaccattattggttatagcacagaatattgttagtgttataattgcttttttagagcagaggtgtgggttgatttgcagtcttaagaattagcaatacacttttctgacaatatctgcaactaccaacccaacagagattccagttattaatagttatggtgtgctcattttcactggacttctggcatgtgataacacttatattttatgcctgtttggaaaaggatagtaacactttttaaattattcttgttgtattagtttcctgtggctattataacaagttatcacagacttggtgagttaaaataacaaaaatttattctctcacagttttggaggctggaagtctgaagtgaaggtgttggcagggccatgccccctccagaggctttaggggaggatcctgtcttgtatcttccagtttctgggggctgctggcattccttggattgtggccacatcactccaatctctgtttccatcttcacaatgcctgtgtgtgtgtgggagagatccctctgtctttcctataagaacgtgtgtaatagcatttagggatctcccaggtaatctaacacagcatccccatctcaacatctttatgtgaactgcatctacaaagtccaaatttctaaataaggtgacatcatttccaggttccagggattaggacttgacattttggaggccactgtttagtcagtatacttggtaagcagcactgtaaattgatggtaaatatgatacgtatgattttaaatatggtagtatttgaagaaaagggacttaaaagtttatttacttcttttggacactttttaaatttaactttttccttgtcactgacacataatagttgtacatatttatggggtacaaggtaatgtttcactgcatgtatacataggataattgtcaaattatggtgattaccatacataaataaatttaaaatatatcctaaggtaaatagcaaaaacgtgcataagaccaagagaaaaataaatttgtgaatgagattgtgagggacggcaaggcgaacagacagaagagaaaggagaagccgagaaactggcttctgaaagcattcgaataattctcattgctaaggaaaccacaatttcctgtctctatctcagctctgaacagctgctttacttataatttggcttctctgaaggactttaattgctaggtgaagaaaagccagagtaccaaagttagaatggaaagaaaaattatggtgatacaaaatgacataaaaacaaattatttaagataatttataaagctggtgcttttaaaaaggaggttattgctcctctctttcttcctacaagtaccctaaggatggtgacaaagttattgaaagtgattgcttaaaagcagtccttttaacctttctacagatgaaaaaacatgaggtgataatgttaattcatttttctcagctggaactgcctgtatcaaatggatattttgctccttcaccctctttcccttctgttaagtattttattaaaggaagtcaaaatgaatggattgctgaagaacctcaaagtgcctctgtgaatgggaagaaaacctcaaagtttgctagctccagctctatgggaatgtagttttatcttgggctttttcatgtagagttctatcaagagaatcttctcttccattctcctttttcattttcctctttgattgcacagaagagaccaacagctttcctcctcctcctctgctccaacactagtgggaagtttgagcctctcttttccattctatttttctgccaaaaattatttttttctatttaaataattcttacaaaatagagggtagttatggatattaataattgcaagctatttaaatacgtttttgtgcatagataataccaaacaaaaattcagaattactttatcttttacttagtgaaaactcaggatgctctggcagaaataatcaagtaatactttcagcatcaacttaaaaatgtctctagatcaatagcatccaatagatctataataagagaaatgttcacattctccgttgccctatatgatagctacaagctgccagttgctgttaagcacttgaaatgtggctgatgtggctgagaaaagtaattctaaatttcatttaattttaacgcattaaatttaaatagttgtgtgtagctagtggttactgtattggactgtgaggctgtagatggtttgcactggcattattttcttcattcttattccacaatatttctggctatgttgctgcttttcacccagtgagggtaagctacatcaaaagatacttttgcatttagaaaaaaatgttaaatcctgaaaaaactcaaaatgcatttggaaagaacactaggataattctgtgcacctacttgacttggtagtaatttaggtgatacatggtggggaaaaagttgtaacaatattatagacatgatcttatcattttatttcagttaatacctgcctactcatatacaactaatacatgctgaagattaaagctggcttttcagtatctcaagtttgtccttgactatgggttatctaaatcgcaacccttaggaaaaggacagatacaggctaaacacatagtcttaagtcatgctcttgagtaagagggtaggatggaaggaagtgctagaatatttggaaaattacatgccctaggaaaaacatgtctccatctcatcatttcaagagctactgaaatctcattctgttgtaaaatctgcccagatctgttggaaatccagacaagaagtgtgccaacttaacctgtacttgccctcagcccccagtccctatgtagctattcatctgatcaggaatcattctccttcacagttactaaaaactgcctttgattttgatatgttattgcccttctggtattatgaagaataacagtataataccagaagggcaataatatatcaatatattctttataaataaaacaaaatgatatatcatagattgttaacttctagggggcagggattatgccttcctcattattgaagttcattatcaactttaacatcacaaaggtttaaacagttaataaaaaaccctttctgtcttgctgctgtatgaatgagtagagctccaagctgcagcaaaaacatcatttctttttttacaattgatatccctcaatgatcatgtccagcatgacttggaaaaatgttaaatattttggaagttgagagtgaggaaaataaaagaaggagtctggtgtatagcaaggagtgcagttgcttctggaaacccgtgagcctggaaagggagtctactttgcagagaggtgaatggggagagggggacaacagaggagaaaatgtagctccttcctgtttttcctttcaaatcatcttgctgttaagcaataaaaaaatctaaatttcctaatctgagttcaatgacttaccatggtatattcatgcttggttcattttcactgtatattataaaatggacactgtgtgttggttattttaaattgtgaatatgatgctgcagagtgaaaaataagaacaactgacatacctggttttccaaaccaaacagagctcctaccctcttttctatatctagtaagtcactctggtgtcccctcctccccatccactctgtgatggaatccctatttctgactctggcaatcctgagatttgagttgccgtatatcaggatgcttgagctttggcaattagctgttggttcccacgtgttgattattaaaagaagtgaaaatgagtgttaattgccactccatttaagaggtctaaaaataactaatgaaagtcttttccataaggaatataatgagattaccaattaattttatgaaagccctacagaggctaccatatgattccttgaactgttttgtccgggtaatgaggggtgatttccctttaaaactcagcatttgtgttagaaaaaaaaagacaatatcctgagtttatttaaaaagtaaagaatgctaatatcctagtgaattaatataaatcctaaagaaaacattcatttccaattagtacaacagaaaaaaaccacaaaatccaattaaactcagctttcaatttttcattactgcatatatgtatgtacgtttatgtaaatatctgtatatacatacgtgtgtgtgtgtatgtgtgtgtgtgtgtaatactagttttctagtgttgccataaccaaataccacagagtgggtgacttaaaaaacagaaatttgttttctcacaattctggcagctggaagttccggatcaaggtgtcgactggtttgatttctgaagcctcttgccttagcttgtagatggctgtcttctccctttgtttccaacatggtcttctctttgttcgtgtctgtgttctaatctcctcctgttgtaatgacacccagtcacagtggattaggattcatcctgaggacctcgttttaacctaatcacctttataaagaccttatctccaaatacagtcacattctgaggtactggggattaagacttcaaggtatatattttgcggagatgcaatgcagcccataacatatagttcctcaaaactcacttatcttgaattctttttgcttcctcaagaatttacttattattttataaggtgcaatataagtaaatgggacaaaattgtaagaggcataaagtatctggactctctttcaaagaccaccagcactcatcctcagaagcagccactgttatcagtcgcttgtttaatcttccaagagatgtctgtgtgtgtccatgtattattaggtagaagcaagcaggatgcagaggagtgcgcatagtgtttctatgtgtattttaaaaataaaatacctacaagtatatatgtatatgtgtttacgtatatgttgaattatgttgccatggttttataatttaaaacaatttaaatgtttgatgcatttggaatttatttatgtttaggcatcgtttggatcccactgacatatatatttccaagtatttatctcactgtctcaaaactgtttgcttgagtaatctatctttcctccatcatttgggattctacctttatcatgtactgaatccctatatgtgtttggatctttttatgaactttttcttccaatttgtggagagacagttgtcccctgctatccccgatagctctctctgcattgcctgacagcacactagtggagacctgtggcttctcttcctcctggtatgaagggttcacttggcttcaattttccacaaggtcttcgggtgcttctagcacaattgtgcagcttctttggccagacagcatctatatcaacctacaggaatgagagcagcaggctggtaaggtcttactgtcagagcacattccaggataaaagtgtaacttgcccagcccaagtttgtgtctccatgggattgggagagatgggaaacatctgtgtcctcttcctgtgggttcccactcacactctgtgatgtttgtagaaatagccccagaccttctcacaacactgttgatttcaaataagattggaattttgtagctttatatttgaatatgttctaaagttagtcttccccttattattctgtttttcagattttcctgttttcacttattttcttctatagttccaagaacattaatttataaaatattctctctttatagagtagatgtttattctctctgtctatgagacagcttaagggtttgagactgactctcactaagagaaatataaaaacaagaggctggggctgcctctgcttgataatggagtaaaggcgcctgcatggagagacatttactgttctgtagataacagtgcagtgatacaggtgtctcgggaccagatgtgactcctgtgaaagggacatagcatgaggttatcttgaaaggaatctcactggacagcactgcttggagggaagatgtgaccctgagtgggtgggtcgcaagggcccaacacccgaggaagtgatcattaagttgacagtcagaggcaaggcactgccctcacgaagaggatgtgcctgcaatgaggttttctgtttcctcattccaagtccatttgcagctcttcagcctcagcgcctgtgtgctgtactactgtgcattgggagaaccagggcaacaatcttaatggcatttgtagaattgcatttaggagttggagccctctccaattgctcttacatgggatattctcacacgttcgtagatcatcccctagtggaatcagttatctcatgttccctgcttttagtcaagaggcaggcaccaccattggccgccttctgtgagtgtgcagagatacagacagaaggatcaggaaagtagacaaaggtcctttagctcacaaatgctgtcataatctaggcatttataggccttaagttgtaaaatttgaaacggtggtatttatgttgttcaaatattttttattttttaaaacttgactgatttatcaattactaagacccatgttaaaaattaccttatgatggtgaatttgtcaatttagcattgcatttttgcaatacaaatgaccaaattgcccacacaagatacagaaactgatacttcagaaaaattatttttacaaaggaacaatagccaattatggcagtgttttataaattattctgaggctgggcacagtggctcatgcctgtaatctttgggaggctgagccgggcaaatcacctgaagtcaggagtcttgagaccagtctggctaacatggtgaaaccctgtttctactaaaaatacaaaaaattagccaggtgtggtggtgggcacctgtaatcccagctacttgggaggctgaggcaggagaatcacctgaacctgggaggcggaggttgcagtgagctgaaatcgcaccattgcactccagcttggacaacaagagtgaaactctatctcaaaaaaaaaaaaaaaaaattactctggagttggaaaaaataatgaacatttaaaaatctttttatgaaattagatgattgacactgaaacctaaagataaggtaatacaaacaaaacacaaacaaaataaaactatagttcagtttaattataaataattaaggttaattataaataaatataaggttaaaaaattctaaatttagcaaacagtgcatcaacacattaaaagatgatttcatcataaatacatccattatagaactaataagatagttcaacattaggaaataaatgaataaaattcatattaatagaaaaaaatagaaaaaacagagataagttaacatttactaaaaaaggaataaatatgttcatgatacttcacactttaatatgttaagttgtacatctgtctattctttatctaaatttgtatttgctttgcattttactgaatggactaaactcaaagaggtacaagtagcaaatgtgtttgtctctttgccctcaaacattttctgcctatttctcctttccccatttctttaatagtatttgaggccgatccatccacttagaggtattaaggtttccaatcaggttcaagcttacatcggatggaagccttctccttctctccagctcaagccccagctatcattagtgggcctgcagcagagaagagtgggaggaagtctgtttattctgttcttgcttgcttttcacttccactttcccatcatttcgatgcttccaagtttccctttcttccttggttaccaaatccagggcatccaagttgaactctcccaagaactcttttaccagttgactttggcgcactggtgtggaaataaacatcaagccagggagggaggtgccaacttctcattcttacagaaaacttccatctcttcaagcagatctcttggagagccctcttttggagctctctgtgagcagggggcagcatctctcctcttttcttcatccataggccaaaaacctacttccagcacaggttctttcttctagacatacctcagtcttctgctgatatgggctggacagggtgacaaccggttgcattgctggacaatccctggagagataggagtggcagcttcttgatcactccctagaatgcagaattcctacctactcctctgctttgaggtttagacaaaattttaagaacaataaatttctcattatataacttattaggtatatatagtcctgggttttctagagtttaaatcctgatctgtgggctgttttctagtttctggacaaaatttggggcaggcaacttcataattttttgtcatttaaagatggttttggcatagtttcataattacataaattttatatcacaatttcagccttatctcattcaaagcttccctcaggcccagcacggtggctcatgcctataatctcagcactttgggaagccaaggtgagaggattccctgagaccaggagttctagaccagtctgggcaacatggtgaaaacttatctctataaaaattttaaaaattagctggacgtggtggtgcatacctgtaatctcagctacttgggaggttgaggtgggaggattacctgagtctggagtggtcaagtctgcagtaagccgtgattgagtcactgcactccagcctgggagcaagagtaagaccctgtctcaaaaaaataaaaatcaaaagataaaataaaacttccctcatctacagtgtgagcgtttagaatccatacttccatgctatgcaaaatggtggaaggccagtcttccccagttgctgacctttctcctcactttgctaaagcaggctgctttagccaaggtggtaagtacttaccataaaaggtaataatctctgagtggcctctcataagaggcagtctcctacgacaagaggacccccagtgctaagatcatgtgggatggactctagagccttgagcctgagggcaagtcccaagaggacagctggagcatgtcctgttcacattaagggcaaatgtgtaaaacagagaaatctctggagagatctacaaagactgaaatttagttggaaataattaacaaaatattacttttaactgctatgtgttatgaagttgaaaaattaaaactaatcataactcaaaaataattttgaaatttagaaactattttgaactaaatgatagcaaaaatatatatcaaatcttatggatacagctaaagtagtacttacaaaaaatttatagagcttccctcccctcccctccacttccctcccctcccctccacttcccgcccctcccctccatttccctcccttcccctcccctcctctccctttcccttctcttcccttcccttttttgacagggtcttgctgtgtcacccaggctggattggtgcagtggtgcaatcacagctcactgcagcctcgacctcctgggctcaagggatcctctcgcctcagcctccagagcaactgggactacagatgtgtgccaccatacccagcaaaaaatttttagtcttaaattcttattttaggaagacttcttaaggatagaagaatgcaaaacaaataatgataatgaagtcataattgagaggatcaaaaaggtacaagaatcttttaaagaaaaatcagttcaacaaacttttgacaaaattgatcagaataacaagaaaacagtcagaaatactttgttaagaaatgattaagggggcacaatttagctacagtgcatattaaaaagataacatagaatatcataataacttggtttactgaaatctgaaaacttaggatgagtgaacatatttgtagaaaaattactatccaaactgaattcagaataaatagaaaggtgaatcatcttatatcattaaagaagctaaattattagtaacaatctttacatttacacaaacccatactcatatgaataagatgaaaacaacacatggcaaggacaattttatagataagttactccaaactttcaaagaataggtaattatgatttttaaatccaaacattttatgttctcactcaaagtgggagctaagttaggaggatgcaaaggcataagaatgatacaatggactttgggaactcaggagaaagagtgagatggggtgagggataaaagactccacattgagtacagtgtacactgctcaggtgatgggtacaccaaaatctcagcaatcactactaaagaacttatttgtgtaatcaaacaatgcctgttccccaaaaacctattgaaataaaaaaagaaaacgtgaaaaaaaagaaaacaaaccaccacgtttaaaaaaaaatgtagaagtgcaaattgtgtgtctctcttctcaatgcagacaatttattgagtattggtacccttaaatcagacacgatggaataattataccacagaaataggcaaatgttataagtcagggttttgaagacaatcagttaattatttacctgtatgccattgggtgggggaacttactttattttggattatattctaatgaatatatgatattcacacagaaaagaacaagtatataaatggaacagaatatagggaccaacagtagatataaatatatgtgagaaattaaaatatgacaaggttggtattgcaattcagttgcaaaagaatggcttattaagtatatgatgttaatgtaaccagcaattcttcaacaaaatcagagatacactctcagcttacattacacagaaaataagtcctagttagactaatcactgatacaaaatgaaatgataaaaattttaaaagaaaatttgtatggtacttgtaggtgatttggttgaaagagtaaagaaattatggaagaaaaattttttccaatccccaattttagaatgtatacggcgaaagtcagctaagaaaacttaaaaaaagtagaaaaagtacttgtaacaaacatttattttccctagcataaatttttcctagaaatttataattaaaaaataaaggccaggggcagtggttcacacttgtaattctaccactttgggaggttgaggcaggaggatcccttgagttcaggagttccggaccagcttgggcgacatagcaagaccccatctctaaaaagaaaacagacaaacaaacaaaaaacaatactagagtaaaaagaaaacataaataggtatgacaaaagaaaaactacaaacacctagtaaaattatgaaaatgtacataattcaaatgtagtccgagaaatgaaatgaaggcaactgttgaatattatttttaccattcaaccaaaattaaaggaacatgtaagatcaaggctagtgaaatgtagggaaactaacttctgcaagtattatagcattaaatttctccagcttttttttagaaagcaatttggcaatagttactaaaagtaagaaaacacaacagcacacatgcacatttttaggagacaattttctatgggtctaccatacttctgtacttcttgaaaacagagacactgattgcctttgttccaaactatattttcaaaaatacttgtatcgtgaagaaccttggaagacagagctggtgtctccatctggagcaaaaagcaggtgcgtttactgctaattatgagagagattcacgtttcttttacttttctttcttatttatttatttattttacttatttttttgagacagagtcttgctgtcacccaggatggagtgcaataacccaatcccttctcactgcaaccaccgccacctggttcaagcaattctcctgcctcagcctcctgagtagctgggattacaggtgtgcaccaccacacctgactaatttttgtatttttagtagagacggggtttcctcatgttgatcaggctagtctcgaacttttgaccttgtgatccatcagccttggcctcccaaagtgctgggattacaggcatgagccaccatgcctggtctcaagtttcttaagtttagtttcttctgttgtaatcaaacccactgtgactgcctggtcctttctatatcacactacgggaattgcaacttgaggaactggtggaaatgctactgctataagtaataaaccattgtttttctctcacccttggatcgcatgtcatctgccaacattcatgaaattgtcgcagggtaccttgttagcttgcaggaaggaagaaaatctgaattttcacagttctttacacttttggcccagcaaacatgttttttttagaatctatgctatggaaataaaaataataagacataaaaatataataataagaaaacaatggtcaaataactagaaacaatctggatgtgcatccatattgaaatgaaaccatttgtactctacttatcttattaaatattatgaagcataacaaatgaagttgaatttatatcttttgaaatttagcgtaactattcacataagaaaaactaattgtaaaaacaagctgggatcaatgtgtttgattccattttttgtaaattaaaacaaaatgaaactgatctaagtgtttgaacatggaaagaggtctagaatttctcatccttgattacttgaagggaaagccctttctaaattctaccaattattttctatgaacgtttcaattttctggctgcaagtagcttgccttgggagttctgactgggattccccaaaccaagaccacgtccataaggctgtttgcattaggtggagccaggtggaagctttgtaccagctaagacaataggtctggcatctttgtaagaaatttggtgtccacttaagagtcaaatgcctggcatttccaaggaagcttaaaacattttctcaattgagttaactgggataacattgcacaaatttggttttctgcctggaacatccaggaccaaaccatgcattcccctaaactgaaattccaactttaatgtggtctccacacacgcccttttattgtctggtggtggcccaaaaccatccctgctcatgcggggcccagattttccctttcttcctttcttcagaatttaggaagacttggtgcaaatacataagcagctcagattgaggctggtaatttaaatctgaaatccagctgggtatgacaccttggctttaaatcttggcttcaaaccttggctttaactcccattaccaccatcaaatataacacttggaaatgctgacctgggtgactcaaccccactgttgaaagggaaacgtcctggaaagcaagagtaatttcaaaatcatacaataatgggaacacttggtcctcaacaggccttaaaacctccctgaatttccttttccgtccacctgactcaccccaaagctgctcccatgcccatcattctccaggccacaatttttctgtaacctttgtgaatctcacattttcctcataccctcttgccttcctccaattctttctcacaaaagccaaaacaccaggtctaataagaaaggtcctccataaagcagagtgggtagaaaagagaaccaaatgggacaacttagaagatcctgtatgagggtagggcaaaggaaggctgggagcgcttgtaagttaatgatttttatactgacatagggacaatttaatattcatctttttaatattaaacagagagtataattatatgatcaatcttaaagtctgtggatctgaagccactggcaagttcctaggtcatccaaacatctgtatctattgctcaggtagactacagacaaagcttttatattcctgaacaagagaaactgtttctcttaagcagcgagccataggtattcattacccttattcctccattaatacttgtgtgatgaacagattctggaacttcagtttccattgacacaaggtagctattgacagaagtgcttagaataaattactttacattcaatataaaatcaatagatataatgggatagccttagaaaactcacaaaagtggtgcattctgggttttttttcttccatatatacttttttgggaagaaagataagtggactatttttaacttcagaaataaactccaattatcataatcagatgaccaagtaatggaaactgctaagtcccttctcagtcttgcagttcgacactcaataagagattgcaaagtgctgaaagtttcattagagtcagtcaatgcacatcaatgaggcttccacccaaagaaagaggactctgaaagcaaccagctatacagtgaaggcagccatggataattcacagaactttgatgttgtttataaacaaaaactagaaacggtgtcacagtagttttctacttacagaaagataaatcaacagatgagagcagcaggaaaaccaacagagtgggtcagatggagacatcctgtaacgtaaaagataaagattatagcagagaagggatatcctgtagaaaacatttagaagatggccttttttctatcaactaaattcagaaaaatataaactatgtggcatgagaaacaaaagacaagataaaacaaaaagatgaaagaggagctaagaggcatatacaaaattaacagaaaagtgagtgaagtgaaaaagatgtgtttaaattaatacacttacagagtttccatatacaccttgtcatgcacggaattgtgtgaccccaaagttcatatgttgaggctctaacctcagatatgactgtatttagggatagtgtcttgaaggaggtaataaaggcccccttgaatgaggtcatagggtggatcctaatccaaaagactggtgtccttgtaagaataggaagagataccaggagtgagcacacacagaagagaggccatgggaggacacagagagaaggtggtgtctacaagccgaggagagaggctgcaccagaaaccaaccctgccagcagtttgatcttggacttcagcctccagaactgtgagaaaataaacttctgttgtttaggtccccccagcattttaatacgatacagccctagtagaccaatacacacctcaagcagtgacaggcagaactgaaactggagaaagttaaaagactaatatggagtctgggtgtggtggctcatgcctgtaatcccagcactttgggaggccgaggtgggcggatcacctgaggtcaggagttcaagatcagcctggccaacacggtgaaaccccgtctctactaaaaatacaaaaattagctgagcgttgtggcacatgcctgtagtcccagctacttgggaggctgaggcagaagaattgcttgaatccaggaggtggaggttgcagtgagcagagattgcaccactgtactccagcctaggcaacagagcaggattctgcctggaaaaaaaaaaaaatagactatactgaagaatcataacttcagaatctttttcagaatgtggagaaaaataaaaaccaattgacagaagggagcagggagatgtaagacttgggagacagagaatagggattcaacttataggtattgggtatattttttataggaaaaatataacaaaaaaattttaaaggacttaaaggattcgtttaaaccacaaatattacaaataaaaatggatccttataagcaaacatatttaattataagagaccaatactttcatgtagcctgatagtattatacaatttcaagattaagaaaagaatcttgtggttcccaaactgtgtgccaagatgtctgggggtattaccataaactgacacaatgggatattttcagtttttgagagaaacagaggaatacaggacatcttttgtatatgtgtaaattagcttaaggtagttcataaatttgattgtacttcatttctttctatgatgtcacgtttttgcgaaactggatttttgatgggtgttttgataaaaaagcacatcctatatgaaaatcgatgtgtaacaagaaatgaggctggaggtgttcaatctgatttcaagatttgagaagttatggctgtgatcagtaggcacatatgctttcattaatgtgtaattgtggttattgaatagtttaagcgtggttattaagtaatattaaattatttaagggtgccacgaaccgaggaagtttgggaacctccaattaagcagaagggcatttgagcaggaaaaaaaagagaatacaaaatatttcttataaaaataataaaacttagcttgtcttagtcttatcccacaaaagtaaaccccagatggctaaagaagtttctattaatatataggcaaattaatctcattttttttcagttttttttttggtgagagcatgttcatggtatacattttcttagttctgaatgtctgctattaccttttcgataaaaagaattactgaaagatattaaaagaagaggtgtttaaactaaacaagaaatacatcaaaattactaagctgtaggtgagattataatataaatttatctaaggcatttatatatatatatatatatatatatatatatatatatatatatatggtttcaaatccatttaaaggacaaataagctatttaaaaagaagacaaaacgtttaaaatacctttttcttttgagacagggcggagtgcagttttatgatttcacctcactgcaacctccgcttctgcctcccgggctcaagcaatggtccttccacctcagccttctgtgtagctgggactacaggcatgtgccatacaccaccatcctgggataaattttgtcttttttgtagagacggagttttgatatgttgcccaggctggtctcgtactcctgagatcaagggaatcgctcaccttggcctctcaaagtgctgggattacaggtgtgaggcaccgtgcctagacttaaaatacattttaataataaaaatgtatgtctacaacactactttttcagatgatgtatgctaatatgatcaacacaaatattttatctgttaaatttcaattaaaatctcttttttcatgctttcttgagagaataccatgtgccaagtaagtacttatgaggtgttggaccaatttcctaatgtgtaaagatttcttatgacattttatttactctctaggttatttagagaataaatgtttagaagttataaaagagtaatttttaatcctgtttatatatgatgataaattgaaaggaaaagaacccaagagaatgtgattttatttgatttttgagatttcaaaacataatatgtaggaaaatatgtagtaaaacatctgactttcatactttttatgttgagtttagtaatagaaatttatgaaataaaaatattaagaaaagtacaagcaaaaattaatattcttcctagctaatttaaaatgctggacatttttataatatgcattttaatgatttcataaatagcaaattgtaacaagttaggcatatgcacttggcttttatttatatattactcacttatcaaactatttttttagatttctaggatgttattgaggtaggagaatggggtctggagacagggagcctaaggcaaacctgcagctgacttcttggaattggactgagaggaaaaccctacctctcgatgcccaagtgacaagaggtcagaggcccttccctctacaaaaccccttccccccatgtcagaaacaggaaatgcctctgattggtctgggccaagccttcacttcagcctctgatcggtcatggaccaagcctttatttgcatagggtgtaaccaattggaggcctctaaaaggtacctaagggtgttaccaaattattttagtctaataaaaaccccaaagaacagtgcaatcagggcccttgaactgcttgctgtagcccattcccactctgtagagtgtacttttgcttcaataaatctgtgctttccttgcttcgctctttgttgctttgtttgtgcattttgtttaatttttcgttcaacaagccaagaacctgaacaactcgcagccaggactttccatctatctttcaaccaacgttatctatctttcaaccaaaaaagtaccatgagctaaaataaattagtcctaaatacacagatttgttttaaattcaacaacataaatgtcaaaaattatcccaaaaacctatacaagtaaaatattaagataataataaaaatagggctttactcaattatgttttggaaataggcagaagtgaaataatttttgcaggtgtagattctgttttcaggtttgagattaatatggtcttgcttatattagaggaatgttcatatcctcatcagagcctttcccacaaatccctgattggtttaagaacagtaggagtttgcgtttagtagggttttgcaatatgctggggacgagagcccttgatactgcccctcttaaactgcaggcgtgagtgcatttctggcacctaccacgtggttctttgaaaaagcaagatccctgggaatatacatctcaaattcctttctaaaatatgacaggttagtgaagttcattttcatgatcaatgtcttgctaatgttttgagattttatggacaaagaaaaatttacagatgtatatgtattttgctgccagtaaatgaaccacttttaaaacagtactcctttgagttttttattggtctgaaacacatgcaaatagttaatatattaatattttatataccagtgcttttcaaactttaatgtgcctaagaatgacttaaggatttgttaaaatgtagattctagttcagagatctagattctgctgttccagggactttgaatagcaaggatgagagcgatgaccaaattcaagtgtaactgaaaatgaagacttggaaatgaagagccttatgaaccaatatgagagtttttaactctattttgaaagctaaaggaatttgatctgtcatgaccatatttttattttagagaaatcactctggaagttgtttgagtatgtattggaggggaattggactagagccagagaaactacctagtagacaaaaagtaatctagttacccaggtacagcccgattaaaggctgcaggtccaaggaccacagagagccaatctatagatgacactaaacttgacaaaaatatagtgccagttaagccagactttcacttatggccttaggtaactgatgaaaagtaaaatgatcctgcttcttgcaacatcggctatagatttgagcacaaaataggacaccatgtcttgtttctcctaacgtatgtcttgttgatttttgttggaggtagaggtgaatactataaggggcaacttagacctcgtatttgaccacaagaccagccaactgaagcctcttgaagtttgaagtttctttttaccatctgtttccttctaaactggaataatgcaggaggtagtatggtaacatggaagtgaactgtactttaccatctaaatatacctcctgagatacggcatagttcatgaaattgatgtagtgaaaaaagccacttttagtatatccaagtaaagtatctagatgcccagtaaatactagtgactaatgttatctggtaatgaatgaagaagactttgaagtaaaacagaattccaaataagtaaaaatgcaatgttctatcactaaacatgatcagtcctttattttggacataaagaatatgctagacatattctagctgggttcagtatgccaacaaaaaatggaggttgaaccaactgtttagagagtatttgtttgaaaagggcctaagtaatggccttgtattttcactcatatgtatataactgtaggtgggattttgaatacatttacaagaaattaaacaataaaagaaatcagataatggaaaagggaaagtgttcattataactccctttatctggagagtcttatctaacacatataagtaggagtgtcaaggaaatacttttatttgaatagacatttttgaattaactctggatgtttttctcttcctggtagtctgattcctcctcttgcactctttccactatttttagtgctagtgaagaataggctggggtgtctgtgtgtgtgtgtgtgtgtgtgtgtgtgtgtgtgaatgattctgaggtaggagaaggttctgatgtacgggaagttgttatccctcaggaagagaatgtagacatctttcatgggaaaaacagaagagtgaaggaaatccatacagctgatattaaagggctatacttagtttcacatttagggatttgcggggggagatcacttcgcagtgtgcaatagtgcagccatagtaattgagaagtggtgatagtgcattcagacagaaaaagagcagaagttgagctcctccatgcatgttctgtctaagctcccatgtggcccagaaggcatttagaaattcccaggggggtagggaaagaagatgagtttggaaatttcagacctattattgggcttctacagaaaggggcagtgtgaccttaggacagaaacaaaggttcagggcctagacagaagccacactgagaatatggccaagatcatggtgggctgagtcaggaaggggacactatgctctgagcttactgaaaagaacagaccactagattcaccaactcttgacttcagaagtgggtgtcagcaggcaccagcaagcagaaaggaaaatgccattgtgttgcaagggcgagagggcactcagaacataggacagtatcttgcacatggctccaagggccttgcccccttctgccatgattatgtataaggattcccatatccaagtaccatctggagttggaacttaatataaggtgtcattactttaagaaaatggttacgtcttaaaagtaaccatgccttacattgttttaaataaagaaagaattggttataatttctttgcgctttacttgattaaaagctaaacaaatgtgacattttacctttcaatttaagcagtgttagttttctaaccttggaatttaaaaaaaaattcaatttaaattcaaactgctcattacagaaagttaagaatgatcttctctagcacagtagtcagtattttatcattattatgcctatcttacatggtaatgaaagttgtcgagcttgtgaaataggatataatgactagggatattaaaattgatcatatttctcaaattcattaacaattagattcttgacaatgcctttaattattttccttctgtagcatgttggcttgggtagtttttacatcatggagggcataaaatgttttaacatgtttcaggagaaagtggtttgcttgtaatttgtatcttcctccatgtgtacaactttaattttgacatggatatggtccaaagatacatgagaagggtggacaaatgattcacttttagaggtttataagactactccttagttcactggaaaaactcatttgctaaatggaccctcactgctctgtgagatgtttactttgctcttatgtaagttcagactgcttcgttcttctagcattaacttagttttggctatttcttcttatcccttttcatggtatataaatgctcagcagacacttaaaatcatgtgaaagacaaaccaaactacttttattttaaagctaattttctgagtgtaattttcttatctgtgaaataagagttgcaccatagaaaaatatttttttaaaaaaatgaatgaagcaaatctgatcactttaatctctttgttgtttaaggttaacattcccctaaacaccctgaaatgtaaaagaaattttaaacaaattgagggtactctctatatttccttaattagtatatttttggaaagagtatgctgtatactgtttttgttcaaaatcttttcctcagataaataatagggacattgaatagaaataaaatgatgcagagggtaaaaggctattgtgagactttgctttctttcaacaattaatatatatgttttcacattcagttgcgtttggtgattacaacagagaattccttgaaaatcgcagaaagatcagtacctgtcacatgctaaatgtggtataaattatgccagctgcgtttctaggcgccaacaccagacggcgctaaaacactgcagttagttgcctgcctgccagtcgaggtgatgttcacacttcgttctacgcacaacgcgtgttctgtacatattgctaaactgagggatgggcagagaagggcaaactgtaactacagtttattttagctcatgtttaaatacaggatatactctgttttccttctgtacaggagagggaactcttcacaggtgagctcaagaatgcatttcattaccctttgtctcttgttcttgttggcaaaaatcagtggttaggtgcctgagtgtgagcaaagaaataactggctatatccgtctaaattaatcactagtaaggaaaattagggaagttacaggaagtaaagaccctcaggcaaaggctcagggataatttagaaagaactagaagggtgcatggtgggagtgtagtgaagaagcaaacttgatttttgaaaacccagaaaaatataagaactagttttcttctttttccctgatgctattgcctttcaaaacgatgaaatagtaaatggtaaattttgagattgcatgttatagtcaatgcaaaagtttttaagaaaagcagatatacttgctgcttcttgagttagaatatagaatgagagatctaacacagcagtggctgtgttatagatagaaaatgtgatggaaagcagttgcaaagctgggcataattccataaaatttttctttttttaagatatatttgctagtaaggcagtatacacacaacagagcacttcagtttcaaattatgttaaaacatctatgaagtagtcagcagtatcatagattttttgcttctgccattcaatgaggccctgtcattgacagagcttggtgactaccaattgttgatgttgatgggctatgctggggctctcaggagagctggggtctctgttctctgaggttttctaaaattctgagatcatatggtttcataacaatgaaaatcacttgatagcagcaatggagttgtcgttatgaataccgatttgtttaactgttagttgtgaacacctaggaatgaatttgcttcttaatggccatattatattggacattctcagaaaaaaaggtttttaatgaagaaaataaaaaccaaatttcaaaatatactacaattatattttctattcattagacaaaataagagaaaatgaaaaaaccataaattgatgactttaaaactaaaaataggttatttattcttaaacaagaatttatttcttctttaagaaatataatagctgagaacctcaaaagaaacctacacctaaggaatgatgtgaagtaataggtacctatgacttctaaacttattgtgtatgaatttattcacatctatcatcatttatacaaaaaacacttaaaatttcacaatctctcctgttcccacaatttataacagaaaaaaatgaggaaaacaattaataggaaaaattactgttagacaatacaatacaatacaatacaatacaatacaatacaatacaatacaatacaatgcaatgcaatgcaatacagtacaatgcatgcttctgcaaattttgtagagaacatatgtgatgacagcacagcagttaacttttgttaagattaaaacagtcgtggtgcggtggctcacacctgtaatcccggcactttgggaggccgaggtgggtggatcacctgaggtcaggagttcgagaccagcctggccaacatggtgaaacctcatctctactcaaaacacaaaaatcagccagatgtggtggtgggcgcctgtaattccagctactcgagaggctgaggcaggagaattgcttgaaaccgggagaccgaggttgcagtgaggccaagattgtgtaactgcactccagactgggtgacagagaaagactctgtctcggaaaaaaaaaaaaaagattaaaacaacacaattgtgattttgcgatttgatagtgaagagagattttcaaatttattcctcagttttttctgaaaatgaaaatgttgtataaccacttaacaatttacctattttcaggaaataatattcgataaaacgttataccatcactgataggaaggaaaaaaagcattcttaatttgttttttgttagttgacttgtttttttttggcggggggcacaatttcttatgacaagactttgaaaagatcaagatcttcaagatggcttcaaacttatcaacttgtaggtattcttgtaaatataaagagaaatgtgaaagtaatatgcttcaataatcaaattaaattagcacaattgcaatttttgtttgaatcaagatggcttaatagttttatgaggctacacattatggagaatatattttactctcctaagccaagagaaaacttcaggaccaactaaagtgtacccaaatatgcatttatcatattttatttgtctatattactcttcaatataatggttttatgatgtagaatatcttgatattttatacctttatcagaacctttatacatgaacacaaactgtatacctacatctttagattttggtactaagacaaaggggtcagttacaagtgtctgagagttgtttggttggtaaaacttctagaagatagtgagttctgagaaaatcatggtaacagaaagtaaaacttgcacatgtggtgttgtgaagaaagaaattgaaatggcagttaccacttaggtaaaaggctaataaacccgattttagaagacatgaatatctgcattttaggattcttttcttggtttgaataagtgattcgagaatcccaactggactgtcagaatggatgttaactaaatagaaaaggattcttgagaaaaaatggataatgtaacacacagtacaaatttgaaaaacaacaaacatttgtgatgaaatgcaaagaaactggagctcctggctgggcgcagtggctcacgcctgtaatcccagcactttgggaggctgaggtgggtggatcacctgaggtcaggagtttgagaccatcctgaccaacataaaggaaccccgtctctactaaaaatacaaaaaattagctgggcatggtggtgcatgcctgtagtgccagctactagggaggctgaggtaggaggatcacttgaacctgggaggcagaggttgtggtgagctgagattgtgccattgcactccagcctgggcaatgagagcaaaactctgtctcaaaaaaaagaaagagagagagagagagggaaagaaagaaaggaaggagggagggagggaaggagggaggaagggagggaagaaagaaaaggaaggaaggaagggagggagggagggagggaaaagaaaaggaaggaagggagggagagagagagagagagagggagagagagaggaagaaaggaagaaagaaaaagaaaaaagaaagaaagaaagaaagaaggaaggaaggaaggaataaaggaagaaagaaagaaaaggagaaagaaactggaccttccacctcctgggtagtttggaattgctcagtctagcatccgattttgtaactctgataagtctgaaacaaatacatatattgatgaaaagttgacgataaataaagctaaaattatcatcacatctccaataatcttttataagagatgatacaactgcattccttttgactttagttaacgacttttagtgaagctcttcagtgacagcttgcatacagaatcaaacatgttagaactataacatccccagagcagggtcagaatgaagcctacagttgggatagagtgcatgttttgcctacctgtttaacacatttaaagaatggggtcatgatatatactacataagttcatctcaacccactatgctgccttccagatacttccacaagcaacttaaaattataaaatgagtacacatactcattttatgattatgaaaagagtactcatactcatcttactcttacttataagagtaagagtacccttactcttacaaaatgagtacatgtactcattttgtatatgtacctgtacatatataagttgcttgtagaagtatctggaagacacttccactaaaaagtaacaagtcagattattataatttacacaagttaagtaatatactgatattaaatcatattttgcattttactcatctatgttaaaatgtacttagtgtgtcctttatcaattttgattaatttgcaaactttaacatattatattctaattaaagttcatttaatttattatattctccagttgcgttttttttttttttttggttagcacacaacacttaaaaccgttaatccttagggttttggttaattaatactatcttattaatgagttttgagtacttattaaccaggagaaaaaatagtatcagtcttagcatctgaagtcagaaaaaatatagttaaaaaggttaagatttgtaatctctttattattggatttatcccgtaagaaaataattttgaattttcctctttgggagaccgaggcgagttggtcacgaggtcaggcgtttgagaccagcctggccaacatagtgaaaccgtctctactaaaaacacaaaaataccaaaaattagctgggcatggtggtgcccacctgtaatctcagctattcgggaggcggagcaggagaatcacttgaacctgagaggcggaggttacagtgagctgagatcgtgccactgcactccagcttggtgacagtgggagactgtgtctcaaaaaaaaaaaaaaaaagaatttgcccttattgtcttacattctaatcactacataatgctccttttttttttacaccaaaatcgggtcactcagatcctcagcatgaaactctcaaatggcttcccatctccatcagagtaaaatccaaagttctcacagtcacctacaaggtatggcgagatctctgagcacgccctgacaatatcttctcctttcttcctcattctctccactataccaacactggtttccttgcatgctcctatatccagcacactctagcctcccatcactgctagggagctccccttctccaaaacatatcttccctagacacccaggcagctgattactttgtgatctttcagtctttgctcagcctttctcagtgagacctttcctgatcatcttatataggaagacttccttctctatcccctcatctgctttattcatcttcacagaacttatttgttttctttaccctttccttcttcaggtcatagaacttattgccacctgtgctttacatgttcacgtttcactgattatttccttcagtagagtgtaaacttcaaacatttttccatatattattaaagttataactttagtactagaatagtgccagagacacagtgaatactgaaaacatatttattaagcatggaaagctcctaattctttgaaaaatcattttagctattctagtttctttgcctttccatataaatttttaaattattgggtgaattgtgctaatatttttgaggaatcttgtctaagatgtgaaatgtatgtgtgtctacttgtttgtactgtctccttcctattcttctgatgtctccataatctgtagtgatgcttcctgtttcattccaggtattgatcatttgtgtcttctttttcttttttttgccagatttgctagagagttgccaattttattgatcttttcaaagaaccagttctttgtcacattgatttcctttggattttccccagagtcgggggtgctcctcattactattaaatgggggaatggataggaatggatattccaccttcccatgtggtctctgctgacacgtggtaggggcagtctagttaccactggacaatggttatagttcttactttccatgaggcctcttctgatgctaccctagcaaggaggagcctcaatatccccagtgggaatggaagtttaggcttcccacgtggtctgtagtgacaccatggagagggccttatctccggccagcagggtagaaagtcctggctcactgcttggttttctctggcactgatccggcaaaggtgttgaggcccctcttcatagcttcttaaggacggacatctcagctttttacttggtctttgccagcataggggggatgcaaaatatttttttcatcattgtccaaaaattttctgtcttgctaggctgcccttttcctggtcctgtggttagagaaagcagagatttttccagtgtgttttttctttgcacctgtttgtgtttccagatcgcttttcatcagctctacatctgggatatatgaagctgaaagaaaatctacagagctcacaactctgtcatctcttggatcctgagattcttgtcctgtccatcttcctctctacatctttgagagtcttcttgtgtttgctttaaacataatgtccagttttacttagttgtacttagcaggaggagtagttgtactatatagttgtacttagcaggaggagtagaagaaaatgtgtttgttccgtgtttcccaaagcacaaatctgtctcaagcacacatttgtaactggtttgttaggggaatttgatggtcttatatctctacctgactgcttccgtgccccaggaaaattgctgacaggtgaaatatgtcttgtactttatcaaaacaatcaaaccaacaaaagcatgaagaaaaacaaattctttccctgaaagaatctccctctcttcattttccctgaacatgtaatttgtaagggcacaactcttttcagaacgtccagtttgtttactgaaagaattttgtgcctttgtgtctagaggctgtgacttctctcaaatcacaaattttgttacaactattctagcctaaattaaccagtcaggatatagaacgatactgtaatacaacagttctaaattggggtccatttgacctctgagggggcatttagcaatgcctggagaaatttttgtttttcacaacttagagtgctactagcatctgctgggcaaaggccagggatgctgaaaacatccccgaacgcacagtacatactcgaataataacaaattatcctgtccagacagtcaatcgtgctaagatcaacaaaccctgctgtaacagggtgtgtaacccttactagagacaccagtaccattctgcaaatagtagatggaaattgctttctgagagggctaccttaggagagagtgtagctttcaatttataggagagaatcagtagagaaactgtagtctgagacagtcggaattgaaaaaatgattctacgagagaaagtgatagcgtaatctcacagatccatgaatagcaataggcacaaccagtgaggttgtgtacaaaagaggattctcccacattgctagtgggaatgtaaatttgtacaaactctgaaaaattgccagagagtatctagtaaagttaacaatacacttatcctatgacccagaattcaaagcttaagaatagagcctagaaatctttgcacattggtaccaggagactcataaataatttacagagcagcatttttcaaaatagttaaacattgggaagaacaaaattttcctccactgtagaatatatgctaaattatggtccattcgtgcatgtgaatgctataaaaaggtgaaaataaatgaattacagttatatgtatcaacactgaaaatttcaaaaaagcctcagcaagagaaataaaccagtattcaaaaaatatgtacagtatgattctatttataagaagttcaggccaggtgtggtggctcacgcctgtaatcccagcactttgggaggctgaggcaggtggatcacctgaggtcaggagttcaagaccagcctggccagcataatgaaaccccgtctctactaaaaatacaaaaattagctgggcctggtggcatgcacctgtaatcccagctacttgggaggctgaagcaggagaattgcttgagcccgggaggcgggggttacagtgagccaagattgcgccattgcactgcagcctgggagacaagagcaaaactccatctgaaaaaaaaaaaagtttgaacactaaaacattttgtatagcagtaagtacagatttgtttaaatttttaaaaagtcaaataaataattgtctcatgtcaggacagtagttttctaggagttaaggagagggatgtgataaggagacaggcataggtcttctgtgtgtggcatgtgcaatgtttatttcttactctgcatgttagttacaagattatttaactattattttattgatcacaaatatatatttagtacactctttatgtatgcaaggtatctcactatttggagatgttaacaacaaataatgtggaaaaatgtggtgttaaggagtagtaatttttcaggacatatattttaaaaaggaatgaaaacacaatttatcagtacacattggtagtgtccaaggtagaaagaatctaatcatttggacaagagataacaaaaagaatcatatacatatcattttaattattttatcttgggcaaaataagtcttgtctgtcacctacccttcaaccaccaaacccagctaattgcctaaatctctttgttgtgtgttagatggaaaagttgaattctgataattaattaaacttatattgcaaattgatgacaaccaggaatgttctggttatcgggaaaacaatttaagtgaattcacttacattctggtgtatagatcagtcacactaatctcccaagacaaaatgagctttccatggctttctgcaccagcaaagctcaaggccattcctgagcatggtgatcccacatttattctactttacatcctgataaggttttgctgtgtgtctccacccaaatctcatctggaattgtaatccccacacgtcaagggagggaactggtggggggtgattggaccatgggggtagtttcccccattctgttctcatgatggtgagttctcatgagatctgatggtttcataagtgtttgacagttcctccttcacatttgctctctcttgcctgctgccatgtaaggtgtgcctgcttccccttctgccgtgattataagttttctgaggcctccccagccatgcagaactgtgagtcaactaaccttcttttctttataaattacccagtctcgggcagttctttatagcagtgtgagaacagactaatacacatcccatctactaagcttctgttgtaatttctactattacaaggttctgtacaatattactactttatatctgcatagaacttttgaatacttttcaaatttttcatttgtattttcttattggaacttaataatcacatggtgaaataggcagaagagctatcattatctgcctttttagttgaataataaataggttaagtggcaaatacagtggagaattatgtggactagctgtgtactggcagtacagatagatttttaaaatagagtgaagtgaaaaaaatgcaaaatagaatgaggcttgtgaatatagcacagtttatgtaagataaaaatatgccccaaacaatgtaacatatttagaaagcagcacaaaaaatttataaaaatgagacatattaaaaatggtttcttataatggtggagaggtgaatgggaattgagaataggagaaaaatgggaataaatagagaaaacaagaagattcaagtgcagacaaaactaagatgatttggaatgaactgagaagagtcgtttcttgtttttgatcgtcgtttttgtttttaactcactagctgcattatttaaatagccagtgatagaaaccagatctctagaataaaataaaacaaaaaattaaattgtttttcgcctgtacttcttactatgtacaaaacaatgcagtaatagttgtgcaatgactgaaattccaaaacataattttacccttaaagaacttagatcaagtttgagacaaaacatttaattgtaaaaagtattcataaaatataatagtagattgaaataatagtttatgttaactacataattgatgcctcaatgattaggtatgtaaatgacttaatctagcaacaattactgcatatcattcatgaaaatatcagttatgtgccagatttaagatccatcagtttacaaaatagaaatttcttacctcatgaagcttatattttatcctggggtgtgagtctataagtaatgaacataatgaataagcaaaatgttagataaaaaatactaggacatagtaaatgctttaggaaaaatagagcagtatagaggagtttagaatacggaatgtggaggtttgaggtacaaaattttaaattagatacttagagtagatccagcaagaaagtgacatttgaacaaagacttgaagaaagtgaggcagggaaccatgtggatatctgtgaaaatagtatcccaggccataaagtgaggtggtgaaaactgtaggtagaattgttttgggaaaaatcagacattcagttttggataagtttattttgagatgactgttagaaatctgtgttagtctgttttcacactgctataaagaattcccaagactaggtaatttacaaagaaaagaggttgaattgactcacagttctgcatgactgggaaggcatcaggaaacttacaatcatggcagaaggggaaggggaagcaaaggccttcttcacatggcagcagaagaaagaagaaaaagtgaagggggaacagtcaaacacttatgaaaccatcagatctcatgagaactcactcagcatcatgagaacagcattggggaaaccaaccccatgatccaatcacctcccactaggtccctcccttgacacatggagattaaaatttaagatgagatttgggtggggacacagagccaaaccacatcaacatccaaatggagatgtggcttacgcagtgattatataaatcgagatttcaggagagatgtctagggtagggatacaactttggagtctttgacatttatattaattttcaagccatgctgttatgtgaactatctaatggagtgtgtgtagctagaatgaaacaaaagcaaatgtagtgttctggaggcaaaataaagtgttggaacaaggaagtgattaatggagtcaaatgccactggtctagaaatgacaggataatgacattaagatgagaacttttaaaaaaggtattataaatatacttacagattgatagtaaaacttgtacatatgagatgataaataaaagatatgatcaaatttgccaactagaatttatagagatgaaaaatacagtttatttttaagaattgactgagatttcacagcatataaagtgctctgcaaaataaaagaacattgaacttgaatatataacaatagtactattaaaaatgaaaaaagaagaaattgatagaaaaaaattgaatagaccctcagtgacccatgagacaatatccactggtccagtacacgtgaaattggagtcctaggcggggaggggagatatttctactagtttcccatcctagttagaggctcttgaaggcttttttgtggagtcattttcaggaatgaattacacaccattctgttatgccctccaacttcaaaggattcctcttaggctccctaagtgtgtacttggaaccctctcaccaggtttcagatggtgtaaggaagacttacacactgagaattttctcgaaagaatgctttctactgccttcatctcaaggtttttattgcctcgaggtggcttgaaggttgcataacctgtttttaaccacctcaattcccagtccagcacaggtggtctagcagtgcaccttgtaatgcaagagtatttatactcactgttttgctctaagctttttgagacaatttccacaatcttaacataattttaagcttaagtataattttgctaaatcctaaacaattccttgttctcacgttaggaagatttctagaattaaaccaactcttttaagttcctgaggtacccttattaatgttgtaaatgtgctttacaattcttataaaatgtgatgtgatgtaaatacaaagtcataataatagttgagcataatcttatgggatctgcatgaacaactttgatgattactgaaagtcaacatgaattgatcaatccttgtgaatataatgcgactgtttcagatgttttcaaagctacaattgcctgtaatcttttgcttcaatttttatcacgagaaaatgaccttccaggctctaccttccatcatgtacttcttttaccttcagacttttgttcctacactacttctttgtcttaaataactttcctcaagtttatttttctaaatggtcaaatattgcccattattcaagtttaggtttcagttatatgtcttactattttttttttcagatttctctatttgtagtttttctttttctttgaattgctataaagcttctactttgaactatggaacttggcccttactatgagttatgacatattgttatgtttctttttttgaaagcctatgagtttttttttaatttttaaaaattttgatagcttttggaacacaagtggtttgcaggtacatagatgaattatatagaagtgaattatgagatttttgtgcacccatcccctgaatggtgtacgtcgtacccaatatgtagtcttttatcccacacctctatcccatcctcccccttctgaatctccaaagtctattatatcactctgtatgcttttgtggacccatagcttagctcccacttataagtgagaacatactgtacttgagtttccattcctgagttacttcacttagaataatggcctccagttccatccaagttgctacaaaagtcatgatttcactcctttttatggttgagtagtattccatagtgtatatatagtacattttttttgatccactcatcggtcgatgggcacttaggttggttccacatctttgcaattgtgaattgtgtagcaataaacatgtatgtgcatgtgttatgtttcttgagtttaattatacagatgctccagagctgggtgagtagacaatatacagtggcaaattgttgtcaatggagatggtgggctggaagctcagagacctttccactggatgacatccttattttgatgaattcatcactggttagctttctctccttcctccactctcatcttacagtatcagaaatctgattttttttttattatacaaagaatgaatccatctctcaagaatgatttcaaattaaatgagctttgatattatttggctctgtgttcccacccaaatctcaggtcgaattgtaatccccacatgctggaggagaggcctggtggggcgtgattaaatcatggaggtggatttctcctttgctattttcatgatagagagtgaattctcatgcaatctggtcgtttgaaagtgtgtagcccttctcccttctctatctttcactctctctcctgccaccatttgaagatgtgcttgtttccccttctgccatgactgtaactttcctgaggcctcccaagccatgcctcctgtacagcctgtggaactgtgagtcaattaaaccttttctttataaattacacagtctcaggtagttctttatagcagtgtgagaacgaactaatacaagcttccaaagactgttgcatgaatcgatacttatatactactttacaaagaattataaaagccaagaggattgtgcgattatattttctgacttacaaattctttccctgaaaagataggcaaggagccaagttataattagaaggaagcttggtgtatgtgagatcccaatgagctaggtgaatctacttaattttaatattttgtgaattaggctaagaaagcctgatgcatccatttctacagctaagggctgctaactgggccaggctattctggtctttgagtcaaagttatctatttcctgcacagttaggataatactgttggtttttgcctcagtaatattcatttttatatcatatctgggctcagagaaacaatcttactttagataatacagtcagttaggtaccaattaagttttgcaggccttggagatattcattgtttttaaggtgaatgctatagctctaatccattgtgtactgatttcagaatttaatgatttccttattcatcaaattttgagtgtatatcactctttatcacagcagcttcttcaatgtcatttttcttcccaggttataaatgactaagtgtagaagcacatcctatagaagttggatctctcttgaatacctaccacagtttaaggtctttgataaacaattaatacatctatatttgattaacaattaaaaatattgaccctcaattttttaaattttagttgagtatcttctctatacatgaagtattctccagtcacatccatgattgaatcttgaaccttcctaatttattacaaaattttccttctaaacaccctcagtcgtgtctcttacataatgtagaaaatagctctttttctgttactcactgtttctataaacctggaataaaattttacccttccagctccatactatccttcatcctctacttccagacaacactctattttgtggatctaccttcttttaaatcctattttataaaggaaatctaccaagtatacatactgaactttatatataatgatgtaatttctcctgtctttgttgactgtatttattttcatttctaatggggaaaagagtaatgtttaaaaagtaagaaaaactgaaaactggaaacaacatggtaaaatacttgtaatgtttgatttctctttttgtctgtttttctctttctcattacccatgtgggcataagctaaattatacatgtatgtgtacaaaacagtaaattcagtgtagactataaacattataattaattattgtgcataaacaaatgtgtgtatataatatacataaaagttttgtgagatttgcaaatcaccatacaccttaatagtaattattctcttatgattaatatacactatagtagaacttgttaatgtagataagtataaagtacttagaaaagaggaatagcacaagaaaatataaaacaaaagctataagattttctacttttcccttctatcccctgtctatgatatctcctccaaggaaaaccactgttaataactttttgtttttcttccagaaaactctgtgtactgttctgaaccttgtagcttaatttgtggcattgtagttgtatgaatgtttttcttgtggtaatttggaaggtgtataatttgcttttagttctcctagcagttacctttatgccattatttaatacatctaatgtcttttattgttttacctactgtagatggacgctactgcctcccttctaggaaaaaatgagaatattattaaacggtgtctccctcagtttccatttccacttctggctcacattttaacttactctatcatgtcatcccatttatagctctaaataatgtatgcagccctttctctcttgattaccttattttaatatttcttattgagtccctaaaaatgaacatgaggaaataaaccacgatgaagaaattaaagcacttttaagtattttcattttcattctctcctcatagtaaaacttgatttttaataaatattttcaagatatatgttaacttttgtatccatcgttgacactttaggcatagtgctttcaaaaataaaagtccagtgtttcccactaatccttgtagcacggtttcttcttcatttttttggttggttcaattccactgcagatttattaaggtctgggtcatgcttgctgtatttcctgagatatttcatatttgagaatatttgcctgttagcatattattaaatgacgagttaataatgacgaggtcaaattttccttattttgagacttactggatactgttttgatttcttttgattctgcctgctctgaagaaatcataagtctgtttgattttctctgccttgtaagaaatctcctccctttcctccaagatgcccgtagaattatttcctattattttaagtttaataacaatcagtagatatctgggtagcaatgcttttgtgtcattaacttctcaaacttgaagcctgttttaatctgcagctttcttattttgagaaaaatttctttttattttggaatacattttgtttcattatggggctctttagggtcacttacaaattttaaaaaatacagctaattaaaatataattaggcttatattttatttttatctgaactttacatctataaacttctgtataattactttgtttcttttttaatctatgttctctataattacttaatgcatttgtattattcaatattttctttttagctttgtttcttttgttttttgctgtttctaatttatttatcatttagatagtgattttgttttgatactctttttttaactactccaaaatcttctttttagaaaacatcatttttttgtttcataatttttcttttacatgatgaagcacacatgacaattttttgagcaagattaatgatttaatgtgaaagacaaagaattttgttttaaattattttaaaaggatagcatttgatactaagttgggtgaaagatggctggagagcatattgaaagaagacatatatttgtgaatattagacaagaagctttcaaaaatggtattatggtaataatcttcatctaacatcttaatttcattggcatgtaataggaggtttgtaattattagctccctttccttttttccttcttttcctttttcccttcttttccttttctgattttcacttctcttcagtattgtcataattttgactggctttggttgaaggaggtgataaagctctatgcaaactaaaatgctctagtttggagattttcatgtctttctaataaagccactgattgagtgctgaaccctgtgaattcaactgtccaagctaggaaaaaaattgtatgttcaaaatttattatgataagaaatgtttatttgttaaatgaattttattgatgtataacatggcatatatgtatcatgttaattgaaatactaatgccttcaatttaacaatactcaacaatttgtaatagatattcgtgactctcattaatcttagatgaaaaaactgttaaaattaggaaaaatatttacgctttttgccatctgggaagttatggcactaaatagcctcataatgactgataagaggttatgggagatattaagaccttgatcattagcttatagttgaaactgtgttataatgaattatttcccatggctgtcttaaattatgaaccatattgatgctctagagatgttttacaagattggttgatgtccatgtaaagcatataaatagttcaataatccattgcaagttcattaggtagcctgaggatcaataatattattgtattgccaaatgaataaactgtcccacttagactggccatccattcctcaaaccagcagacagacagccaagacacataagataaagcttgctttgggtattaaaatcaatgacgttcatttaataaaatacacttttcctgagtttaaaaaagtaatcttaaaataatgaaattaccaaaaccctttattgatttcactttgagttaaaaaccaagatattaagaaaatacagagttcaaaaaattgtgacattattttattgactgacttgtttttaaattactgtttttcctcaacccagcataatggatgtctcaatagattacttagaaaaataaatactcctagctgaatggctgttggtacgaatccaagttaaaaatatgattgagcatcaaccaatactttattttagatcataaacatggccatttctatctctagatttaatacacttattgatatgaatgctaaaacatcatgaattattgaagtattaaataaatcaactctatttcaacatatgttgcttaaataatcttatactactggcctatttaaataggttgtgaagtcattctcaccaagaacgtgagggattaatttagaagcattagagacagatagactatcttaaaatgttacagtgtaaaaagacagtagagtacacctgtatattaactggtttactggtttattctggaaagtagacactacatggtcctttcacattatatctgtattagaggctggttgggaagaagaaaaagaaagagcagtttatgtaaattcaaaacttacggcaatgagtaagcagggtgaaagcaaatgtactaacctatacagatgtggagattcttctattaaaataaaaaataattttctagagataggaaactaattagtcttcagaacacaactttaaaaaagaattggcagtttatagtccattatcatgggaaagtgaactaatttattagtggctcaatgtttcttttcataatttacacttctcagaatgtctgaagtggttaataatgtctactctgtgtcatacagtctgggcaaaaatcttggttgcattataatgaataaaaattatctcatattattgaaacttgagacaaaatgctgattgcttgaaactttgatattattctagagcattttctatttgctcatttgcatgaaagagactttttctagtcataaatcattcatcctcaaaagatattaggaaataaaatgtgtagcacagcatttttgaataataataaacagtagagatgttaataatttgcagtcatcacggttagaaattaacatacagaatagtataagatgttatgattttggagcctgatagagaaaatcaaaggtgttaaaggtataacttcttactctgtagaaatgtagcctgttttacacataatctagtatctcatttaggtattcctttcccgtttgactatgtccctgaaacattcttctactcagaccttttatctttcctatcatttcctttactaatgagataaataaaactttgacatgattgaaaatctttttaaaaacaaattatcagaagccttaagaaatgtttaaaaagtagttgccattgacttgtgacatacagagaaagcaatcagagtactgccctgagaatctcccaccgcaaatacccatggtttctgtttcccggggctgtcagtgacaaagtaccacaaacatggtggcttaaaaacaatagaaatgtattctcccactgtcctagagcctagaagtccaaaatcaaggagtcaatagggccatgctatctctgaaggctgtagcgggggctcctttcttgtcccttcccagcttctggtattgctggcagtccttggtgtttctgggtttgcagagccatcactccagactccgactgttgtcacacaatgttctccctgtgtgtctgatgccttgcattctaatttccctcttcttgtaaggaagctagatgctagattaggaccaactctattctggcgtgagctcatattaacttgattacatatgccaagacgctatttccaaataaggtcacattcacaggttgtggggagttagaactttaacatctcttttaaggggacataattcagtctacaatgcccagctatttacacttgagcttatgcattgtttctccttctgttattctggatgaactgtgctttgttcctaactaaatctaagcactctacttgtgtattatattagatcccatcctctctggcctattcaatgacacgtatataaaatatttcaatctatgtcttgtatcacaagtttttctctcttaactggatcagcaccactggcatacaaacatgtgaaatctttcccattttaaaaacaaacaaaaacaacccccttatattactccacatttccctctctttgttctcttttacagcaagacactataattgagttttctgtacttcctttatttaattcttcttttattctttctctctaccattgtcaaggttaaaagtgacctatatagtgcaaaattcaatggataattcttggtcttcatcctactttgaaatggttgatcattgcttcctcctagaaatgctatttttctctgtcttcaagacaccacagttgtccctcttcctcctgatatctctaattacctcttttagtatgctccttctcatctccctagctgctacatgtctgaatgcccttgggctcagttttgtttcttgtagcttttctaatgacatgaattcccaaagcaatctcatccaatttcatggctttaaatatctgaaatcttaaaacctttaactatttgtgcaaaggctttccaagtttatatcaccaactgagctgctcttcagagttttggacttgtgcatctgaaagacttcatgacatctttgatgttaatattttatatattaatatttttacactctgcttcctcctactagaatgtaaatctaatgagagtaaaaaatttgtccatttgttatattatcttgaaaggtatccgatgggcattgtgagtgctcaaaaaatatgagtaacttactgaaggaacgattttttttttgttgttttttgagactctgtcgcccaggctggagtgcagtggcgccatctaggctcactacaagctccgcctcccgggttcacgccattctcctgcctcagcctccggagtagctgggactacaggcgtccgccatcaagcccggctaatttttgtgtatttttttggtagagacggggtttcaccgtgttagccaggatggtctcgatctcctgacctcgtgatccgcgtgcctcggcctcccaaactgctgggattacaggcgtgagccaccgcgcccagcccggaatgatttttttttttaaatctcacttaaaagcagcagcctatagccatacttagaaaatgccaataaagcaacaaaaagaatgtgaagtctgtggttttgcatagagaaatgttgcttttcagaagaatctttttggtgaaaagtgttctttctatgccagaaaaagtaggatcttccttatttcttctcggctagggcccatagactgtcttcctggttatattctttggaaggatgatagaatatttgaaacactataaaaatgagatataatacagttgctaattaataattatgacgaccaattaaaaaatagtggcttaaacagatatttcctgtgatagtttcttgagtagcactgaaacctgaaatgagtaagaacaaataaagtttatagaataattgccttgtatttatttgctcagaaaaaatgtattattatcgtacagatttacatctggatttattatctgtagcttcaaagttaacctttcaatgataatggtgcacttttgcatatcatgtttaataactccttttgcaaaattaaaaaaaattacaaaaatccatttcccaggagcaaggagaataaaaatctctacaaagttggaaactagtcaatattgaactaggcaggataagccacaaaacatcttaaaacttactgtcctttctatttattttacacatattaaagattgaaactaattactgtgggggcttttttccatgcctatattttgattctatagtaggtttcctgagggcagttttgaggttttatgccagcaatttgttgggtcctaagtgaataatagttctcaaaggattactgatgagattgatgtatttataacgagaacaaagagattatcttaaaactgattaagtcatttcccaaataaacataaaatgaactcttttatttatgatggtggtgagagagattgagaatacatattttaatgtttgtcaccatattagtgatagaatctacccaagaagcagatgatttgtgaaattggtagaaatgattagaaaagaaatttatttttaaacaatcttaatggatagaacaaaatcttcagaacacacgcttgatgttatacaaaagctttaattttgaagaaatggtgggtatttaagaagaagtctggtataaaaatttaagttatcagtaaagactaacaaccagaaaaaaagataatgcgttttaaaatattttattattatccaaaaggaagagtctggaagacagtgttgagtcgcagaataaattatgtacagttttagcacttccttaatgaatcttttagattcatttggtgcttcaaaataaagaattctgttcaagctgtaaactcgctctgccataattgctgtgtagcagttgttctaaagaaggcagaaacaagcaacctccttttccctaaagcctgaagcaatgcagtcatgtcctggagaaagtcattataaaaaagccttttctatgttttgaatctctttaaggatgcatctgcggattttattcatcattccatttatcataaggttcagagacaagtattgcattaagtatatttggtacagagggagttgcagattcttagaactggtttgcaatgcctctcagaggcagtaactgggtaaaaactgagtacaaggtatgtgatataaggagggctgggatcaactttccatacatctgtttactttaaagttgatgtcatttgccgctcagtgctattttaaacactcttagagtttctaacttctttttgttcctgtattttgagatctctgttttggcaaaaggttagtgagacctgcaaatcgggcggtttgagcacctgtaactctctgtgcacacttctaccttttcacataaaccaaatattggatttgaggttgtcactcccaggatagtgtgagctacttaagggcaaggtcatgatttacccacttctatgacctcacgtctttgctgtgtctaggttgtagcaactacgcaagtgtctgaaaaataacactggcttactagctgattgaactatgctttattacatataatttattaaaatatcaactatgattgtgagagctctgatctcatacttttctgttccaaagtgtgtttttttaaatgtgaaatgagttaatttagtaaataaactcaagtatgtggatattaactccttaacatgataatcaaaataaattagtggtctggagcttagtcaaactcttcaactcctcaattctagtgcaaaaaatgtgtatttgttaacacttgtcctctaagaaaatttgtttttgttttccctccaatgatagcttggttaagaacttactactgtgtcattttagttacaaagtcttgacatatttagaggacttagacatacatatccaggtatttttggaattcttatagaaaactcacattatcaatttttcaattccattatttcactgctgactggctttaaaattttgtccatagatagcatgcgatctttataattctttgcatttagtttttcaaatactacactttgaggatatcctgagcaattacattattccacaatttgatactacttcaaagacaatcttatcatgagagctgccctgttatcttcttccacaaaatgcaagacaaataattaggttaccatttgtttttgcctcattttcttttgtaacatgttaaccaagttctttcctgatggcctaactgattttcaggctcatatataaaaggaaagcaaatcttattttctttactttgaagcccctttagcatatccaatttcttctgcaattttgtctttacttttgatctagttggatagtctcttcatggatattctctaaaaaatataagaaagcaaataatttattttttattcagagttgttgactttgccagtttgctgtgctgaattttgattgagtttatgagctttttgatgaggcacgtgttagtttttacatttatagtaagttttaaaaactatcttcagttttattcaagattagttatttaaacattcatatcctaaaactcctttctgatatcattatcttttgtttagtaatagaaggaagtgtttttcttttaaatctctctactagaaaaattagacttaattgtgtaaatatcacaccatcatttttgtatgtgttactgaaaacctgtctcagtatgcctcctttcctatatgctcaaaatttattttatccagagatagttatttgctttactctccatccctctactctataaagactggtgttgggtgtcccacactgacattcagacctttgcccagccaaatgtcctttatctctgaagacccgggatttctgtcatggagtattcacatctgagaactattctggacactttataataagagcagagtaataatttccacgtattgagcacgtaccaagtgccacatactatgctggttgtgtcatatattttccctaattcagttctcacaataaccttacagtattggaaatattatgtgtcttttataatgaggaagcttgaattagaaagtttgaataacttaatttggatcagttataagtagaagagatggggatttgaacttaggctggtggtctgtggaacctctgcccttaatctttgtgcttggtacaccataaatatatttctgtaagtgcaacagattgattgatgtctcctgcattctctatttgctggttaccgttagtaggctggcttcctggtctttttctcctatagctggtgaccatttaaaaattgtggtagtgcttgctagtgctttaaatacgggaagcccttttatttttaaccatcaattttgtggacttttcaacattgttataatgctttagaataatgattgaataaagtatgtggaggcaaaaggcaccagagaattcagtaatgctgtgagatgaagttgcattttatttattgcaatagtatccacatattaactgcaaaactacagatacacaattattaataaccttatagaacatttcattagtaatgtgaccttcagtttttaatatctgagcttgatatttgcttgcttccttatgtccttgccctgaaataatatcttctacctcaaaattctgtacatactttattttcctaaataattggaaaggagccatatatatgtatatatataaaatacacagaatagaatagtactctaccaagatgtttttctcctaatagctgttacctgggaatatgatatggtacttggcaagggataacttagtttgcagatggaattaaggctactaatcagctgacctcaaaataaggagtttattttggattacgtgggtggcccaatgtagtcctaatgttaattaaaatataagaaaggaaggcagaagaataaaataatatgtgacaacaaaaacagagatcaaaatgttgccctactggcttggaagatggaaggagtggccaacagccaagggtgcaggtagcctccagaagccagaaaagtcaaagaaaggaattccccactagagcctccagaaagaatgcggctctgctggtgacttgatttttagctcagtgagaccacttcatacttctggactctggagctgcaagataataaatttgtgttgttttttgccatgaaatttgtggtgataaagtagcaataggaaactatatatatatatttttatttacatacattttcttgttttgcaaacagtttttatgctaataaaagtgctattttgtatttctttacaataaaaaattctacttttgagttttctaactctctgtcttctctcttagaactgtgacctgaaatgattaatcatgtcatgtcaggatttaacatcaacatgatgtaaaacaaatccacccttctgttacagttggttacacagtaagcttcaagaattcatgttcttatagaacatgttcttatagttcttatagaaaggggaccagaatagagtgatttaattgattatttcttctcattaaataggaaaacagtttttctctaacttttttcgtgagtagagtgctttattttttttttttgctaaactgtggttctttcaaaaaggccttcatgggatctctggcaaacctctggcagaacagctgtagcaacagtgttaagtctcagtgctgctgtcattctccaaggggaatgaccaaagtgatttaaagaggagcaattatgggacctttgctagggccttaatctcctcctagaaaaataaagattttgcaagactttactaaaaaatattgtcttttattcattcgaaacaccattactgatatcctactggggatacatataaccatccgctgtggggacattcacagcttgtgaggaatgagactgtgggcctttgggaagaagcccattgcatagtttgggaaacatccaggaagaaagtattaattctactttgggaaatttgagtaggatgttgtggtagggagaagaaagagtatcacaggaatagggagctccatttaccaggtgacagaaatgtcaatgtgcacgctggagtatttgagtgacggttagatcctgacaagggatgaaactgtttgagtagagcgataaggtttcaaagggtctttaatgtcatattaaagagactggaatttatcttgttttcaatggagcgccattatagatacgtaattggaagtgtgcacaaaaatatttatatctccaagcaacataaagcagcagttggagagaagggatgttgtctaagaggagatatagaagagtgaacccaatgatgaggtgattttagttgaacttccagttccactagacctctgtgatttgcaagcagctaaaacagcgtctgacacaccatagtagtattcactaaatatgtatcaagcattattgaataaaccaatgaatataggcctacattgaaactggatggattttaaaaaattgtagaaattataagtaccccaactagaatgcaagttctaggaatagaatgtaacaggttatagatagataagctgttttcttcctctgagttattttaatttttcttaattttggattttctgtagtttgaatatgatatgcttttttgtttttgttttttgtttgtttttttttttaataaagaatttatcctgcttgatattctctgggattcctggctctgttgtttggaatctgatattaatttgaggaaattatcagtcattagtgcttcaaatatttcttctgtttctttctctctttcttttctttacacaggttaccttttttagttttcccacagttcttggacattctggttttttttttttcagtcccttttctctttccgttttcatttttgaagtttctagttacatatcttgaagctaagggtcattcgtcagttgtgtcctgtctaccaatgagcccatcaaaggcattctttatttctattacagtgtttttgacctctactatttcttttatttttcttaaaatttccattgttctgcttgtattgcctaactgctcttgaatgctatctactttatctattagagttcttagcatactaattatagttgttttaaattctggttctgatgattccgacatccctggcatagctgggtctggttctgatgcttggtctctctttaaactgtgatatttgttttgttttgttttttgtcttttaacatgacttgtaatttttttcttagtagccaaatgttatgtactgggtcaagtgaacaaaaggaaatgagcctttactaaagtgttggtaaggtgtggggaaggggaagtagtctatagtcctatgattaggtctcagtcttttagtgagcctgtgcctctgaactgtgaattacacaagtgcttctcagtctccctccgcccttcataggtgggacaggatggctagactaggctggagttgggtatttcccttctcccatgtcagttaggcactgatagaaccccaatagcttagactctgatttggcagtttctcttgagggcagttcttgttaagaaggacaaaatactctggtgtatttcaaaatgtttcctttttcctccctctgctataagccccagaaaatttttctccagtattcactgtgagaatctggttgagctcctgaggtaaaactcaccaatgtaggcacctcttatgactgagccccctagagtttttgactctcagagttatctgctctgagcctctggcaattcatcaattacagttcagggttttcaaccctggaaggttttttgctggaagtttctggtcttgtaagctatgattttctgtactaacctgtattctatcctatttgggggcagtagtttgtcctgtgacctcatttctctggatctaagaagagttgttgatttttcagtttgttcagcttttcacttgctttttgcacaaagtgacaacttccaagttccttacttgctgagctggaagctctgaatgcttgcttttcacagtggtatgacctgttaattctaaaactaccagatgtgcattcttggtctgagaaaataaattaccatgaaaaatgagagctacttttctatctattgaaggcaagcttaagagaaggtaaagaaggttagaataagtcctgtggtattggattagaatagtaggtctcagcatgaactcagtatgtacaggtatctagatctagatatagatacatatgtagacataaatatgtttgcatatgtacactttttttttatctctgtccactgagagggtgtagaagctatacatcctaaaattagtgagcccatctagcacctggaagctagtttctaaatatcaatttctaataaaaggagccaggcctccttggagaaatggctgattccagtggtgagacagtgctacgagttgaactctgtcctccttaaattcataggttgaagtacaaaccgccagaaacttacaatacaaccttatttggaaatagggtcattacaggtatacttagttcagatgaggtcattaaggcaggtcctaatccaaaatgactggtgtgtaaagggaaaattccactcaaagatacagagacatgtgaagagggaagacaatgtgaagagacgcaggaagaagtggccttctataagccaaagagagaggactggaaccagtcttttcctcatggccctcagaaggaaactgccatgctgacaccttgattttgaagttctaaccttcaaaactgtgagatgacacattgctgttgttttcaccacctggtctgtggtgccttgtagagcagtcatagcaaactaacagatggggtagcacaaggcgagtctggagtatctctgattactgaaatctcaaaaaattatggcgatatgtaaaaaagacatagggtccatcttaaatatgaggaaaatttgaacaacaacatgattaatgatactaaaaattgcaacccatcacataaaaaaatcaatgagttcatactgacatgaaaaaatgactaaataaattgaaaggaaagttcttgtctagaggggattataattaaaaacgtaggagaaatgattaggaaatcgccatttgccaataattacgataaattttttcaggaaagaatcataaatgaacattaaaatgaaaggaagatgatattatagaaaatactatatttatacaatcttaaattatcttcctacaataaatgttaactacaaggggaaaaatagtagcttaaccatgaagaaacctagaagacaccaccttaacggaatgatcaaaattaacatcaccaacaatgggacagagtgatacaatgtgcctcctgataggttgcaccaagaaggatgaaacatgcaagaatgataaagcgtaaaagattaatatttcaggaatttggtaaagtgtataagggaatattttatactacttttataattattatataaaatgaaaagtgctgcatttggtaaaagactaggtaaaaaggatgaggagaggagaaatgaggattcactgtgtgtgatgttttgcttgagtcatgatataggtggtgaattacctggaaattctcagcaaatcattgttgattagatattatgaatacagaacaaagaatagtgttaagaagcaagataataagttatgttccacacatggtgatatggtttggctctgtgtccccacccaaatttcatgttgaattttaatccccagtgttagaggtgtgggctggtgggagatgattggatctaaaggtttagcaccaatcctctagtgctgttttgtgagagttgtcatgagatctcattgtttgaaagtgtgtaaaacttccctcttcactctctctttctcctgccaccatgttaagacgtgtttgcttcccgtttaccttctgccatgattgtaagtttcctgaggtctccccaaccatgcctcctgtatagcccgaagaactgtgagtcaattaaacctcttttctttataaattacccagtctcgggtagttctttacagcagtgtgagagcagactaacacacgtgggaaatttgctgtattcagctggtgtaataattctttttagccaaatgaaaaaataaaggcaatgtcttgaatactaaaagagcagtttttccatgtcatcatggaattttaattaaaataattttagaacttactctttctcaagaattagctttgggaaaaaataatatgataacaaagacaccgttttaaaagagaacaaaaataggtagcataaaatagtagataaagatctactaaagtggttagttagtatgaaattagaaacccaacttctaattcctaacataggttgcagcaggagaggtctctgaaattacaggtgactgtgtcattaaaggtgttttaacagaagggcctttcttaggtgattgctatgtatttaggctaagtgaaccacatttgatgggcaattaatcacgattcacttttcaagtgtcttatttagaacattttgattagtcattttggtctactaggacacatcagatacaactccaaatcccgagaagaggtcatcagcaggttttcagcagtggagccaggtggatggcacacctgaattttgatctgaagggaaactactgaagtcagcaccctagggaaatgtatttctctaatactgtcaaaatcaatggatctttcagatgtactattttgtaaacaaatgcctggatatccactcttcccaattttttttttggaattcctactgcccactctccatgtgcacttacagaaaaaacagatatcttttctcactgaaggctatgttagtcactatggtttattaaatatagcctggactcaatcccccattccccctcccaaaaaaaccttctgtaataagtcataatatagttatttaattatttaatagtcttacttttattatattgactattcttacaagttagatggtcattttcatggattttatcacattgttgctgaccaacagccttgtgctaaatgcgttgtaaacctcaggatgctttatcctgtctatctgtgccttgcattactgtacacactaaatccttcagggactattcgggtatatactgtgaaactgggaaggtgttaggagaggaacatcttcttatttctgcagtttcttggaaaaattagctagatggtttgtgaggctgttcttcctactgtgtcattttgtgccataaaaagccttctggtgttttgagcatatcctcaagaaaggaaagaaacagcgaatgaagaggtttattggattctctccttcctttaatatcttatttgtaaagccaggatgtacaaaaagagctgagatggattttcctcttccctgctgcctctttcagacccataaataaagcattttgttattgatctattgccagtacctcctggagcaatagttttgatcgataattcctttaaaacagttctcagcaacccgaatcaggttgactccctttttctttagttaaccttctgagatgcgaatttagcagaagactgtcttttaatagactcatggtttattatttaaatcaaaacgaaacaaaacaaaacaaacagactgggcaacggaatgcatagagacaccaccggcacatgcttagagtagccttgttgcttaaatatagctccgtatgtatctgcttctaagatcacttatgcttatttgttacaatgtgtttagcacaggttactcagtgtgtagtaacaaaatagatctgcattccacagagataccattctttacccttttaaaagccccaacttacattatttcgtttgattcttacattattttgtttgattcttacattatcttgatctctgagaaagagaaaactcagaaacctgtgagcttctcagtgggacaggacctgctaagagtgtggcgtgggcttggggtgagggttcgggctcccctggcctcactctcctgaggcttcatgccacttgccactcgccagcactcagcagctctttgtagttcaaggagagactctgctccaagtgtctttggaattaatagctcagtcaaccaggagacatggttttctcttcccaacattacaaaaccagtgctcgaatgtcaaatttttgtttcctcagttttcaagtgaagaaaacatttctgtttttttgagcatatgctcggcaatatggatgggagatagaaagtattagattctatgttctagttctcatggagtttttaatctagcaaggaaaatgagatacatgtcctaatagcaaacaacacaagatggatggttgtcagcagcattaccagtaggagacattctccttacaacagttttctctttgacccttggatcacataaagaagacaaaagatagtttaatttaccacatagtgacttttttttgacattttaagattatcaggacaatcaaatccagctgatcctgtttatatgtgtgaaagaaaagtaaactatgcaatgattcttttatagattaggcctttcccatattatattttttgcaatcttctaattaccttcctttccaaacaaccgtaactatctttttcatataataaaaatttctattgacaagacagtttcttttttcaggaattcctttcttcctgcttctccttcattaacacatagcattggataccaagcccatccaacaccagacttctctaaccattctgtgcacactatattttaattttgatatgtgtttcttttaagattaaaagttatataattttcaaaaataaaaatagggaaactaggttcttaccaaaaaggaaaaaaaatttaatagaggatttagtgggttgaattgtggccccttgaagatatgtccacattctaatcttcagagcctgtaaatgtgaccttttttggaaacaagggtctttgccaatataattaggctaagcatctcaggatgagatcactttggagtaaggtggggcctaaatacaacaacaggggtccctatatgagagaaggcacagacagatgaggagagacacagaggagaaggccacgtgaagaccgaggcagcgttatactgttacaagccaagaggcacctggagtcaccagaagttccaagagacaaggatggattctctctgagaggcttaggagagagcatggcactgctgacaccttgatttctgacatctggactctagaactgtgatagaataaattcttgttgttatgaagctttcagttcacagtaatttgctatggcagccctgggaagctaatatagagtattccagaaacatcgaagacccaagagctagtcagattgggcgagtgggtttttaacacgaaacccttgttaagatagaggaaactgggaaaagagtagaatagaaactttgctcatcagtgtttatacctgtcctttcttgttttctcctgttagagaagttttaatctctagccatcgttctgattccaatattttctcagggacctcaaaggtactaatatcccttctctgtttcttttctctttacctgatttaaggtttcattcctgttagcatttacatatccttgtgaattccatttaaaagcacaaacaaacagaaaaccttaataagaggtcttgggaaactgcacatatctgtatacactggtcagcttcattctttttatactgctgcccagtacgccatagcatgaatatttcaggtgtttgtttattcattgcatccatttcctttctgaaacacgtatgatgtttcaacttttccctattataaatagaccagtgtacctcctttttgcataggtgggagtttttcattagtgtaggactaaatagtggtattttaggttatatgatatacacattttaaatggtcatacgtatttccaaaattcttcttgagtttgtattgatttaaactccctctagtatatgcttatacttttccccattccttcaataaaatgtagcactagtcatgtgagaaataaggtagctataaaaatccaaaataacagtatttaatggagaaaagaaaaaataaaactattgcatgttttatcttactatttacaggtgtatttcaatgcatagaaaaggcataaaagatatatatcaaaaagtttttttgttagcatgggtaagataaactttcttagagtggtgggggaactaaaaatctgtatttattggcattttttaagaaaaatatattcgtgtattgtgatatcaaaaggtatttcaaatctaatatcacattgattgtccgatggcctattttgtatgtatctttagaaaataaatggtgtcaataaaaccataatacaatcctgtcttattggaattttctatgttattctgaataaatgagttcattaagaattcttggacatagatttttaccttatactatgctactgttttggtgcttttctgagtacaaactagcattttaatgcttaattataatgtaatccttttaaagacattaaccatcatatacagtactaatgatgtacatgtctcagttgaagtgatatcaatatggtcaggtaaagaaaagtatgtcacgactgtcgccacagcctcatctgactgaccatagctctaagattcatttgttttaaatggtctcctgatattagatatattaaaatgagataaacaaagacatccatcaaaagtcttattgattctataatactagtttaagaatcttcccgtgactcaattctttcttctagcacaagctctttccatcctagatagacaagcatgttgaaatgactgtcttttcctgcttgctctatttcctgaacccacttattcataatcccatcacaatttgacttctgcaccaaatactatattagggtcaccaatgacctcctcatcacaaaacccatagcgaatatttcagtcctcatctttgcctatcttcattgacatttgacatggttgatctctgttacgaaacgatacatttctggttcccctttgctttcctggctgctccttcactatctctattaagattggactttttctttcctcccttaactgctgctatttgcaacattctttttaaagctttgcactcctcactacactgggcacagcaaacaagatccaagcaaatatcataaatgtgtgaaataggacagtgaaatagtgtaggtcatgatgtactttgtagcccggtagaaagtgcatatattgcttaagtatatttaaattcaataaataataaaagaaacaagaaaaagaaagaagaaaaaagtaatctgtggctaaacagaacaaatgggctctgctagatagatttgctgttgagttccttctagtcttctttctgggctatcacatccactcccatgacttcagttacaatctatacttgccggtatcattgtcaaatctgtacctcaaactctcttttctgattgaaactcttatccagctgatggctggacactgtcattttgggctccacggggagttattcccttttctaacccgcagcctcgctgatccgtcaggctgtctctaaccacttcaccatacatctggactgccattcctgtagtccaagtcaccgtcttctctcaccttttccttgataacacgccaattgttctcctaacctaatcatatgcttctttaatctacttttgatggcctttggttttatttttctttcatgaggccatgctctttcactgctgtgtactacccatgtggttccttctgcctgaaatgctctcgtgatttattgttccttctcttgatttcctgtataagatcgcatcttaaatttatttcgtctagaaaatctgaatggatactgactcccacttacccccaatgctgttttgctgttctatgtcagatgagcctgccatgtgcttttttttttttttttttttttttagctcttttggtgtctctgccatgcacttatttcatctcctttcaatgacatgtttgtgtgtttctcttaggttctttgaaactctcaaccatgtttattatcttgttcttaatgtaaacgcataccacataaaggctactgtctctgctgtctccatatttgctgagtaaataatgacacagtaatataattttattcccattccttttaaatattaatcccgcgcatgcttgttgcttcatcattaaaaagaatgttgatatgttatagattagcaattgtcatggtaaaatttcatgaagaggaaggaaaatttggcctgaatttataagaaagctttttttggagtaaatttactatagactgtgtactccatagggctgctatgaagataacataaaataaactgaaaacttctttaaaatttaaacatgttatatgaatgataatggttattatcactataatatacacagtatactcaaaagaagccaaagaaatagaagataaaatctctaaataaaaaaatccattcttcttttcagcagatgggaagcatttcctgtgagcctgtaattgtataagctgggagtaaagagggtaagagacatggtctttgccttcaacgctttacatctaggtataatggcttgatcagctatagcacaagaaaatatataaatttaaaaatcagaattttctacttgatcttctaggcctttaaaaaaagtactattttattgtatatggttctactattgaggtggagtcacatacaataaaatgtaacaatttttacacttcagggttggggggttgctcaagatggttgcctggatacatttaacactcacctcctccactcaccttttgggagaatcaaaatagcaagtagataatcatactttgagtagatcatctaagagagaacactggaatccacagagaagtgcctggaaacacctgaggcaaggaaggaaagcaaagccaggcagcctgttgggctgggattggctgggatcccagagaagctctccaatgcagggaatgggtaagagagagatccccagtgatccacattcccaccacagactcatgcaaccctagccacaggagagccttcgacccttgtgggccctgagactaacataggaagctgcttggaaactgtgcaatggcattggtccttccagagagagagatcacactgagtcccacacaccctgttagtgctaagcagctacagcctgatgtcattttgagagtccctttcagactgcattgtaccctgcggcccaacagcccctgcatccccacatctctagacccctgttgacatcccccacccacagctgctgccactgctggcagcagattccagggctgaagcatgaggcactggcactcatcacactgaccccagcagcatggtcactgcccatttaccagtgtcttgaggaccaccccccacacctgcagccgccacatgggccaaagcctaccttcccaggctctgcagtctactctgtccaaaatttatgtagtaactgcactttctattgcttctcaatcttttgactaagatcaagtgtcgtaactgcattttcttttgaatagtgttagcatggtatatctttctccattcatttacttttaatctatatgcacctttatatttaaagtgggcttatggtagacaacatatagttaggtcttgtttatttgatccactctgataatctctgtcttttaagtggtgcatttagatcagtgacattcaaagtgaatactgatatggttggattaatatctaccatatttgttactgttttctgttattgcacttattttttgtttctatttttgtcttccactttttaaaatctgccttttatggttttattttcacttttatttttaatttcaggggtataaatgcaggtttgttacatgggtaaacttgggttaaggggtttgttgtaaagattgtttcatcacccaggcattaaacctagtacccatttgttgtttatttgttgtttttcctgatcctctccctcctcccatcctccaccctccaatagaacccactgtgtgttgttcccctctatatgtgtccatatgttctcatcatttagctcccacttataaatgagaacatgcagtatttggttttctgttcctgtgttagtttgctgaggataatggcctccaactccatccatgattcctgaaaaggacattatcttgttcttttttgtggctgcatagtatttccatggtgtatatgtgccacattttctttatccagtctatcattgataggcatttaggttgattccatgtctttgctattgtgaatagtgctgcaataaacatacacatgcataagtctttataatagaaggatttatataccttttattttaattgacattttatattatttcacttttgttttccttcttagcatattaagttgtataccttttttaaaaaaaaattttagtggttgccctagagtttgcaatatacatttatagctgattcaagtccactttcagataagagtgtatcatttcatcagtagtatgagtagcttaaaatataataatccttatttctcccttctgactcttacatcattgttgtcattggtttggcttatacataagcataaataagcacatatatacacacatatgcatatataattaaatacattgttgctattattttgataaattattttctgttaagtcaattaaaaataagaaaactaaaagttttaactttaccttcattcattcctattctgatgctcttttttctgtatataaattcaagtttctgacctatatcatttttcttctcactaaagaacttattttaacatttcttgcaacatacgtctagtggcatcaaattctcttaatctttgttttagaaagtttttatttctccttcacttttgaagaataatctctcagggcatggaattcaatgttagtgggtttttttttctcttcagacttttaatatttcattccgtgctcttcttgtttggagggtttctaatgaaaggtcggatgtaattcttatctttactcctctgcaggtaaggtataggtaagttgtttcccactctgcttccagcttctttcagaatttattcttcatctttgattttctgtagttaaaaatggtaggcctctatctaggatggttttttttggtatttatcctgccttgtgttttgtaaacttcctggatctgtggtttaatgtctgacattaatttcaagaaattctcagttacattgctgcaaaaatttctttctttctttctttctttctttctttctttctttctttctttctttttctttctttctttctttcctcttcttctcctttcctttcctttctcctttctactttcctttcctttcctttctcctttgctttccttttctctttgttatattccgttcatgcacattttacatctgtcgtagcttgcccaccattcctggttattctgtcctttttttctttttcttttggtctgttttttagtttttttttctttttttctatttgccttttagtttgggacttcatttttacatatctttaattttggagactcttttcgtagctatgtacagttttaaaagcccaccgaagaagttcttatttttgtaacaatgttattgatctctagtattttttttggctctttcttagaattatttttcacctctgcttatattgcccatctgctcttgtgtgctgtctgtttcatctgttatagctcttagtatattaattatagttattttaaaatctggatctgataatatctgagtctggttctgatgagtgctttctgcctttaaactgtgttttattttatgttattttatttttgccttctaacatgtctcacaattttttctggatagccagacataatacactaggttagtcaggcatggtacaatgggtaaaaggaattgctgtaactaggcctttcttaatgtggtagtaaggtttttgaggaaggggaagcattagcagtcctgtgattaagtctcagtcttttagtaagcctgtgaccctagactgaacttcacatgtgctctcagtctcctcctcgttaggtgggactgatggctaacatggtctgaggttggatatttcccttcccccaggtcagttagacccccagcgggttaggctctggttaaatcctatctcctgaaagcagactttgttaagaagaacacaatgctctggtatatttcaaaatactttcttttgccctcctgctgccagaagcactagggaatttttccctggtatttattaggaggaccagttaaagctcctggaggtaaaactcacaaagtgtgggtggcccctatgactgggtcgccccggagtttttaactctcacagttgttcacaccgagactctagaaattcacccatttcagtataggttttcttaccagggaactggttcccatggaggttgccgttgtgattctctgtgttcccctgctggtctctccaattttgggctcggtggtttgtgctctgacctcagttctcctagggatctaagaggaatttgccttttttggtttgttcagccttatacttgttgtcaggacaaagtgacaacttctaaggttttacatgccagcctggaaactctaagtatgcctataattttaaaaaccattagcattgtggtgcatttttctgtattttttccttgcattttacttagttttaaaaaatctaatttagaattggacagcagtcatattttggcataggttagtaaaataaatttgatccttccttccttccttccttccttccttccttccttccttccctccctccctccctccctccctccttccctccttccttccctccctcgctctctccctccctccctccctgtgcttttgagattttaaagaagttattcctctggtggtttggtaactcaagttacctcaaagccttctgaaatagagatcaataaaggcaaactcttatgtttaagaataattttttcaatgcttgcattccgttttatgacatctgtttatacttgcctcatctagttaactgacttatgtgtgtaccaaagttacttttgaataattcatcttattgagtctttgattttcctttcagtctgtggaaacagtagatgaataacatgatttttttttttttttttgagatggagtttcgctcttgttgcccaggctggagtgcaatggcactatcttggctcaccgcaacctctgcctcccaggttcaagcgattctcttgcctcagcctcctgagtagctgggattacaggcatgcgccaccatgtccagctaattttgtatttttagtagagatggggtttctccatgttggtcaggctggtctcgaactcccgacctcaggtgattcacctgcctctgcttgccaaagtgctgggattacaggcatgagccacagtgcctggccacttgtgtttttttctgcctatttgagccttagtgccatggctaagagtaatgtgtggtggataagccttggagtcaggctggtggccttgaaaccatggttctaccatttattaaatagctgggtcaatgggaaagattttgaatatctatgtgttctagtattcttaactgtgaattgagaatgataattaccatttatctagtactcatcactagtgcaacacacaattctagatgtttaatgtgtactatggataggacacttcatttacaatattatttttctcatctttttttgtcattcagcactgcaaaggaaatctgaccaaattttaatttttgtattcctgtgtaagtgttttatatttttcttcactggaactcatgaaattatttttaaccctgtaaataaaaatacattgaacatttgatggactaaagatgaatttttcactgattttgcctagaaatcatagcatctttttaattcatagactggtcttttcttggctcagatttttaaacattatatgcttgattatttcttctcttccagcttgcgtgatttcttccagtgtgcagccaaaattctgagcacttttggttttgcttttgctttgtatctatcactttttttctacatttcttttgtatttgtcatttgttcattctttttattcattcattcatttggagacagtacagtaaaatgctgaaaatacggacagtggaatcaaataaacctgaatttgaattctggtattatcattttcaaactgtgtaatctaagacaaatcatttaatctcttgaatctcactttcttcaagtgtaaaatgcagagaatcatagaaatagaaaagagttatgttatttttagtaattaaaatatttagtaattaaaatattctctatgttttaaagttattttctgaatggatactgttggatattcccattgcaatgatcatttttaagaacttcattactgactttcattgcctacacatgcatttggcaacagtacaacaactggcatccatctttccaactcttacctctaaaatccatactttgtttactactgcagactgatttgcccaaatattgtttattggatgccctttgtgcaattaaaatggatctccagagtaatgtgaattcttcttcctccttcttttctatccttgtcttaattacctaatattaattttatgttcattttatctatgatgtttctttacatacatccatatctctgtcagtatttctcctttttctaactgaattcaactaacttctcttcaggaaaccatcccagctctttctcagaagttggtttatatttgtgtaacaattagaccttaatgatagtcaattatcttcatatcttttgtattattggattgagttttcgaagatgaacaaccaaaattgatgcatttttggaatctccgcagtcgttaaaatggttctttgaacaaacggtccttgaaatgaatgaatgaatagagagtatagcttgatatgttttcactagaggcatttttgtgcatgctgactgtatatgttatcccaactacccctaccctctcagagatgatagagtttgttttgtttcatggagcacgttgccaaaaagaccacttaagtaaaagtcaagacagcaggttcttgtggcatcgtttacttgtggctttaccttctttcaattcagtgtaatagcacacaagatatctatgttccactgctgcatcaaaattcagatacttcttatgttacagctctaatatgtagaaacataccttgaaaataggtgccccgtaaatatttatggaaatggaatgttagtatgtgtgcaaatattttttttaaaagaaagacaagaatttagtgatacctggacatttggtgaggttttgttctcttatatggaaatagttgctggaggatttttagggtaagtaaatgtcaacaacctaattttagagatgaggttgaagaaagtgggcctgaggtggtgacttggttaagattatacagttcaccagtagaaagcaggaaccaaaagccaggcctcacaccatttggcctaaagcattttttattccataatgctctgagttccaagaggcaaaccaacaggtgcaatgctttcagcagatagctatatttatatatgtaaacatctttctttttgtgggtccacaccttgcctagagaaaacatcttttatttctccttaattttttcaatctgtcactaaggagacataaaaatataacttttttttctttaacttttattttaagttccagagtacatgtgtaggatgtgcaggtttgttatatacgtaaatgtctgccatggttgtttgctgtacaaattatcccatcacctaggtattaagcccagcatccattagctgttcttcccaatcctctccctctccccaaccccctcctctacgggccccagtgtgtgttgttcccttccaaatgcccatgtgttattatttagctctcacttataagtgagaacatgcagtgtttggttttctgttcctgccttagtttgctgaggataatggcttccaactacatccatgctcctgcagagaacatgaccttgttcatttttatggctgcttagtattctatggtgtatgtgtaccacattttctttatccagtctatcattgatggacattgaggttgatcccatatctgtgctattgtgaatactgctgcaatgaacatacacaggtatgtgtctttataataggaggatttatattcctttgggtatatacccagtaatgtgattggtgggtcaaatggtatttctacctctaggtctttgaggaattgccaaaatgtctctcacaatggttgaactaatttatgctcccaccaacacggtaaaagcattcctttgtctctgcaacctcactagcatctgttttttttttttttttttgacgttttaataatggccattctgactggtatgagatggtatctcattgtggttttgagattgcatgtctctaatgatcagtgatgttgagcttttttcatatgtttgttggctgtatgtatgtcttctttgagaaatatctattcatgtcctttgcccgctttttaatgggattgtttgtttttttcttgaaaatttgtttaagttccttgtagactctggatattaaacctttgtcaggtggacagattgcaaaaattttctcccattttgtaggttgtctgttcactctgacgatagtttcttttgcactacagaaactctttagttttaattagaccccatttgtcaatttttgcttttgttgccattgcttttgttgttttcatcatgaaatctttgcccatgcctatgtcctgagtggcatagcctcgattttcttctagggtttttacagttttggaatttacatttaagtctttaatccatcttgagtgaatttttgtatatagtgtaaggaaggggcccagtttcaattttccgcctctggctagccagcactcccagcaccatttattaaatagggaatcctttccccattacttgtttttgtcaagtttgtcaaagatcagatggttgtagttctgtagtcttatttctgagttctctattatattctattggtctaggttgctcttcttgtaccagtaccatgctgttttggttatcatagccttgtagtatagtttgaagttgggtagtgtgatgcctccagctttgttctttttgcttaggattgtcttggatattcaggctcttttttggttccatagaaattttaaaatagttttcttctaattctgtgagtagaactttttattttttcaatccagaatgttttctcaatgtctccagtttgactcagccatacattattattatggaatgaataattagtgtgtcagtatagatttcttgttgtggcaaaggttcttttacaatcagaatgaaaaaagtagcctcctgttaatcttggtggggaggaagttatacaggtgcatataagtaggtttagatactgcagaagggggcaactcactctttcttgctcagctactgagagaacatattaaggaggcattttagaggtaagctgcttctagctatgtaagagcagaactggaggcaggaaagacttctgatttttgtttttaacatggctgcagtgacactgattatactagagaaatcatctgaaattcaacagatggaacagaatggtatttgcttctggcagagaaagtttcttcctacactacttgcctggaaccacaatcacaacaaaaccaagccatcaagaatggtggagattcttggttgtaacaggcttttgctagaagactgtagccctggtattttgtagggatgtgtatggtgcttggagagcaataacagcaaaaacaaacaaacaaacaaagaaacaaacaaacgaaacggaaacctctaaaacacacagacaagacattctagttttctttccataatcaagcctgaactcctggaatgactaagatattgaagtaatcataggaaggggatgaagacattcttatgatgagggagaagtagatttattattgaaataagaaataagacaagtggtattattctgttcaccaaactggtaaagatgtacttcttttggatcttgtggggaggttcatattaatgagttctattgtaaattggggtcaagatattctgtatattttactgttagctttgaactattttgaataatatcctgagagaaaatagaacgaggtaggatttatttgcaccttctcatcataattacaaatatctcttttatccatttgttttgatatttttaaaatgtgagtgcattactttctttgtaccaagtactgcttataacagatttgggaattctgaattcttctgaagttaaggattatttacatcaacattattgtttatgtccattattgtgatatcttcatgaactttaagtaatttttaaaaaaacacctcttttccaaaatattcatttagcttttcacataaacttagaggtgatggttacataaatgaagccaaatctcagtagtaatctgtactaaatggtgttatgtgtttgggctgtgtgctgcggatttcttccagggaagaattggaaatgtattacgtacctcatcaaaaaattattgaagaaagtaaatacaggtttttgagagactgggaagagaatgaataggaagatattaattattgagtgagaattgttcattagtgagtcattgtcagtaacatgaaaaaagataaggaaattaagaaatacaggaagtattcaggagaagatgggcagcaatacttgctaaatcagaaatggagataataaaaatggcatgacctcaacttgaaggtgacaaatagccctgactccccctcaaaaatactgttgcatccaagaagcaaagtcttataactcgatctttagataaaaaattttgctatttttccatgaatagagaccatacaaatgatcttgcaactttcatttttttgagatttctttggcttgatattttccaaacttacatacagtttcttaatatggggttagtgcaaaattgagatatagagcaatgtgcccaggtttagaggttttctttaaatagtcatttttaattaagactgttcattttataaattcatacttttttaaatcaaaccaactgaaatattttcaatggcataataatgtctttttgatgcaatttaatcttcatgtctcttctcacataatacatatctgaagttgatatgataagtctgacattttcaggagataactttgttttattattgggaaatctttcctgacaacttaattaaaaatgcttactaacttaagttcttttaatgattttagatttttttgcacacaacgttccatgtcaaaatatgctttcaaatctgctgctttgatagtgagaagattctcttttcgatcatcataacacaccttcacatgaatctttggtaaaaagtcagttttacctggaggctgtctcatttctctaaaattattctcctactcaatttctttccagttggcaaaggaaattaaaaaaaatcactatatccctaaggattgattacactgactaaaattttgtcagtatctaagctataagatatgaatagctaaatttaaaatgacattttgcatctaaaacttcatttttacattaaaaacgtgcatatgagattcaaatgggatttttgatacttatttttgctgtatatttttcttgggaaactataagctcctcttgggattaacttaattatatgccccttgtggtctgtgaaaaataatttgagtttttcttgcatatgtgaatttaaatgccagtaggaataaatgattggccttaaaatattgattctctgagcagatatttggagaaaatatacctcacattgcactggatggatctggctctgtaaatggaagataaatagaagagggagccataaattttccactcttaaaatccatagaagccggctgggtacagtggctcacgcctgtaatcccagaactttgggaggccgaggcgtgcggatcacttgaggtcaggagttccagaccagcctggccaacatggtgaaatcccatctctaccaaaaatacaaaaatcagccggatgtggtagcacgcacctgtagtcccagctactcaggaggctgaggcacgagaatcacttgaacccaggaggcagaggttgcagtgagccaagatcgtgccactgcactccagcctgggtgacagagcaagactctctctcgaaaaaaaaagaaaaaaatgaaaaaaagaaaaacatagaaactataagtctgtttcctatagagaagctattctttaactaaaattctacacatcatacaaatatttacacataagaattaacagggaacccttccaagggtaacttctaggagcttaaagactcaatgtttcaaggagagattactagtcttctgtctaacctgcagatacagcaactactacatccaagattagggcacgcacatctaaagagatcctcagcatgttgggagacataaagtattagtaagattcttggacttggagccagagaatgagatttgggagggcagaacttgaaatgctttatgttttctacagaaaaaaccagcagcattaacttcatttagaaatttgttagaagtttagattctcaggtgccgtcctagatctactgaatcaacatctttgggactgaagctcagaaatgtgttttaataaacactcaaggtgattacaatacattataaactttgggaaccactgtttcagagaagataagttgtttttttaaaatttatttatatttttatgaatgtagttttattagagacaaggtctcactctgtcactcaggctggagtgcagtggtgttatcatactcactgcagccttgaactcctgggcccaagtgatcttcccgcctcagcctcccaagtagctgggactgcaggtgggcgccaacattgctaggctaatttttttttatttctgtagagacaagatcttgctatgttggccaggctggtcttgaactcctggcctcaagtgattctcctgtcaaggcctcccagagcgctggtgttaaaggcataagccactgcacccagccagagaaggtaaatagtactagacatgagtcctattctactacttcttaaccagcttaccttggaccagtcagtcaacctgactgtttctgctaccgtactgagaactatgaataagatttttatattgactgtctcagcacccgtgcaaatgactaaagaagtagaagtcaacatcacatctaagatcataaagagcaaacattaacttatgggaacaattgaacagattcaggaaagcagatgctgagttgaaggtgccgcagagcaaccaatagatacagggagcaaggaattcagaaaattcttgttttaaaggacatgggattccccacccttgctgagactaaaagaaatatagatttgcacatattcaatgtgacaagaagcagctgaaaaatgagtcctagagaacccttctcatccaacaacctggctttactccttctgattaccctccatccccaaggtatgaggatcttaaatggagaaattgatctgctttgtttgttcatctatttatgtaaagaggatagaggatgttatactaaagatctgcatagcgcagggatggcaatgggcatctagatggggagatagaaggaatcacatctcagaaaatctgagagaagctaaagccaatcagaaaagattctgaactttaatctggccctgagatttccggttaagagtccagaacaataacaaaacaatatgcaccattctatgaacatctactatattttaggcttgttacctgcttttataataatcaattaatctattttcactttaaattaatggccagaaatctccaataagcaactaacgttgtcatgaaatttgagtaaatttgtagaccatttcatgtcttctaatttttcctcaaaatttccatactctctcattctcccattccccattagctgatgagctagtctcaaatgtcattttggaaatacagactatcagaattgaaattcttcatcttccactacaggatctatccacttaactatatcagaacttacatatcctgccttcactcctgtagaaatggatgaggtgaaatattcatgctcccagggaagacccgttcttgatatcctattgtctctttcctccgcaaagacttcacacagcaattacctcctctctctccttcacctgctttccctgtctgctgggtcattatcaccacaccaatatgctctgggatttctcattttggtctcacatttccagtattccatttttcttcttcttcttcttctttttttttttttaagtagttagcatttaatgaaactccctccatgcggcttcaagccaccaggacacaggcccccccaacactcttaatcttctcctcagctcttctgctgaagaatttggcctgcacggtgacagcctgcttggggagctttccctttcccagaactttgtagtagccagatcgcaccacatcaatgatgggagcagccccagtcttgtttttagcagcattcacccgtgtctgttcactgaccaaagtccacaatttgtcaaggttgacagttgggcagaagctctggttcctctttaagtggtaatgcttcataccaactttcccaaagtagcctgggtggtatttgtcgaagttgatccggtggtgatgcagaccaccagcattaccgcggccgccggggtgcttccggtgcttgcctatgcggccgtggcggtggctcacgtggcccctaagtttccgggtcttcctcagtctggatggcatgttggcagcccagacgaaaaaaaaaactatcttcttcttcttgagcaatatttctagaaagacttgaataggagttaagacttttttcaactcctattcacactttaaaaatataaatcaatattcttttagtaacacaacgaatagaagtcaatttcaagaaaatcagaatgcagaggaacaagagaaaaactatcaataatttcaccactgcaacaagttcaaaatctgctatatgttcttcctttttaaactatttaatttataatttcatcaggtagtgtatatacataaaaattttaaaaaattagagatgaggtcttgctctgtcacccactctgcagtgcagtgatgcgatcatagctcactgcagcctccaactcctgggctcaagttatctttccacctcagcctcctgagtagctgggatgacaggcatgtaccaccacctgtggcttatttatttacttattttgagacagagtgtctctctatcgcccaggctggagtgccgtggcacagtcttggctcactggaacctccacctcccaggttcaagagatttctggctaatttttgtatttttagtagagacggggtttcaccatgttggccaggctggtctcgaactcctgacctcaagtgatccacccgccttggcctcccgaagtgctaggattacagttgtgagccactgcacccagcctggctcaatttttcaaatgtttttcagagacaagggtcttgctatgttgcttagcctggacttgaactcctgggctcaaggagtgctccagcctcagcctcctcagtagctaggatttaacacatgttcatagttttaaagtgcaaagacactgatgagaaaatactttccaccctgctttcctcagcctcgtttaagaatgaatgagtgaagggctgcaaaatggcagccatgagatagaacttctatttatttagagtctttatatttttacgcagaattcttttttttttttttttttttttgagatggaatctcgctctgtggcccaggctggagtgcagtggagtgatctcggctcactgcaagctccacctctggggttcacatcattctcctgcctcagcctccccggtagctgggactacaggtgcctgccaccacgcccttctaattttttgtatttttagtagagacgggtttcaccatgttagccaggatggtctcaatctcctgaactcatgatccacctgcctcagcctcccaaagtgctgggattgcaggcatgagccaccgcgcgctgcctttcgcagaattcttttttttttaatttttttttattatgctttaagttttagggtacatgtgcacaacgtgcaggtttgttacatatgtatacatgtggcatgttggtgtgctgcacccattaacgcgtcatttaacattaggtctatctcctaatgctctccctcccccctccccccaccccacaacaggccccggtgtgtgatgttccctttcctgtgtccatgtgttctcattgttcaattcccacctatgagtgagaacatgtggtgtttggttttttgtccttgtgatagtttgctgagaatgatggtttccagcttcatccatgtccctacaaaggacatgaactcgtcattttttatggctgcatagtattccatggtgtatatgtgccacatcttcttaatccagtctatcattgttagacatttgggttggttccaagtctttgctattgtgaatagtgccgcaataaacatacgtgtgcatgtgtctttaaagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccatatcttctccagtacctgttgtttcctgactttttaatgatcgccattctaactggtgtgagatggtatctcattgtggttttgatttgcatttctctgatggccagtgatgatgagcattttttcatgtgtcttttggctgcataaatgtcttcttttgagaagtgtctgttcatatctttcacccactttttgatggggttgtttgtttttttcttgtaaattcatttgagttcattatagattctggatattagccctttgtcagatgagtagattgcaaaaattctctcccattctgttggttgcctgttcactctgatggtagtttcttttgctgtgcagaagctctttagtttaattagatcccatttgtcaattgtggctttgttgccattgtttttggtgttttagacatgaagtccttgcccatgcctatgtcctgaatggtgttgcctaggttttcttctagggtttttatggttttaggtccaacatttaagtctttaatccatcttgaattgatttttgtataaggtgtaaggaagagatccagtttcagctttctacatatggctagccagttttcccagcaccatttattaaatagggaatcctttccccatttcttgtttttgtcaggtttgtcaaagatgagatagttgtagatatgcgacattatttctgagggctctgttctgttccatttgtctatgtatctgttttggtaccagtatcatgctgttttggttactgtagccttgtagtatagtttgaagtcaggtagtgtgatgcctccagctttgttcttttggcttaggattgacttggcaatgagggctcttttttggttccatatgaactttaagtagttttttccaattctgtgaagaaagtcattggtagcttgatggggatggcattgaatctataaattaccttgggcagtacggccattttcaatatattgattcttcctacccatgagcatggaatgttattccatttgtttgtatcctcttttatttccttgagcagtggtttgtagttctccttgaagaggtccttcacatcccttgtaagttggattcctaggtattttacgcagaattcttaatgacaaaatttctttcaagacacaaataaataaatctttcaaagtggaattgtcgaattcccaggatttgtggaaaacacagttgtcctggtatgataagaatatgtgtataaatagatgactgctctgtttaattttgtgtgaactcgggattaggtagtatatagatgtgaacaatttaatagttaaaaccaaggcatattccatttagaacatttagtttcttcacttgtttatgcatgctctctacctaaatatatggtttacttttcaaaacatagtgactatttatgaattgatttagtaaaaataacattaggaatgtgaatctcctctagcagaaaatatattgtaaggtgcaattttctagtaagccttccgtcatataaccctttaataagaaaacactaaagcaattgtacttcaagacggtataatggatagcaataaaagtctgcttgtaagtcatgccttcttttatcacttgtgccattttcctgcttttggaataaaagcgtttccttcgtaagtagaatattaattggaaaacccaataactcacatctatattggaaagaacagcaatagataatataaataagaaatcaaatatgtgtttcagatgttagatttttaacgtcaattttaatacattttagcattccgtgagagtaaatctgtggtccttaatggtctagtttgcatgcactacagtctccagagatatttcagaccagaaaacacaaagcatattcaaaaataagaaatgtgcttttacctcttctgtcataagacttttcctacacaattataacatgtattaaaatagacattttaaaggaaataatttaaatgagtgtatgttttcaaaataaatatttaaaaagttaaatattatatttattcaaaaatccaatatcacatctttaagcagtgttaataatgattattgttatacctagatgtcacatcaactattcaactttacatctttgctttttaaaatgcagaatgtcatcttcgtatcatacataatattggaaagttccaattctgcatggtgatgtttcaacagaaatgtctgcaattattaaaagatctgaattacaggtaacacaacattgatatgttatttgttaaccctttatgccccacctcctgtttttggtttgggggtctatcatcacatggcagtgtttacccgtattcctgcattaataaattaccattcacaagtgttgctattaatgtttgtgtcctcacttaaattcatatgttgaaatcctgggattagcaccattataaaagggaccccatagagctagctcttcccttccaccatgtaaggacacagcaacaagataccatgtgtgtgttagtggcccttaccagacactgaatctgccagtgccttcttcttggacttcccagtctccagaattgtaatatataaatttctgttgtttaaaggatacccagtttatggtattttgttatagcatcctaaatggactagtagaaatatatgagccagaatagtaaatactacatagttgttattgtaacaccttctataagaattttctactctatttgaaaattactttaagtccttggttatgaaggaaaatgcttcgctaatgaagatgaatatttccaatgtgttaagcgcagttacttttgttccctaagtgtttttcttcacatataattaggctggatgatttaatgaaatccagatcagcgtccatggataatgaggtgaatcccatcaagatcctttcttagtggctttatttctaggaacatttttttaaataggccgtatctatacaagaaaagtgaagaacagtatagaattaattttatttttggatcaagggtgtacaaggagaataaaattaggtaatgagctaatgggaaatatgcacatttggggacttgtggcctcagactggttggaaactgaatgaatccatgaaacaattgcccaagtccctttctttttcaaaatgtttacttttaatattttggcctgtttgggttttattaggtttcttagatttgataagaaaatgggtggtttataaatttgaaattctagttgacttgtgtaattccttacaattatatcttgcaattcttttttattatataaagtcaaaatttttaagatcctgtgacattttgttacattttagcccaagattatttacatttgtacctattcttctatgcttttacataaactccatgttgttacaaaataatttaaaacagctcatatacttaaaataaagcaagataacatatgttctgataacatgcctcaagaatatatgagaaatatgacagaaaaaaattcaagggcatgatataaaatcagccagaaattattttactttacaaaatgcatgtactgatagactgtacagttactatctatgagtttctagttcataataagaatataacaaacataatggtgatgatatgagccactaagaattttggcttaatctgtgatagacattgagttaagctgtttacatagttcacttaataattacctcaaccctgaaatgatgctcattttctatataatgaaatgacctctagctccaaaatcttattgaaaattgtagagacggtattgtagaaactagaaactcaaactggctaatataaatataaagctgattctatcaactgtaggcatcactgcctcttaattagtttttgtcagctttctcttcattatacactgtagccaaaaatcatttgaatactaagcagttttatgttgtctgaatgacattgacccatctaacttacacttgcaactcatcacccaggagacagtagttcctcatacaataggatgaggataccagatacgggtcattgcagggaactttagctttgcagaaatttttgtaatagattattttactaaccttctaactggtttcaatgaaaatcacatgagtgtttggtagtccagcagtaaactggattttttttttaagtccttggagttttctacatagaccatcaagtcatctccaaatagtaacagagtttatttattcacttctgataagtatcacttttattcgctttcccccctatttattgggctgtttaggccttccagaatcctgactatggaagaaacaacactgtatattgatcactgcataagagcatgtcctgtgtaagccatgtgagcatacacacaaggcgttatcatagtttgtgccataattcactcttcaaaatgccattccattattctaaaatgttagtcactttataaagatggttaacatgatgatagccatgaattccacaagacatgagcccacttccactctttatgaggtgtaaaatgagtttgccttccttcagtgaactctagttctatgaagtggcataatttttgaaaatgattgatatgccacaacctctattatgctgattcaagttagccttacatttactgcatttgaaacctttccacttacgcaagtcaagtaagactttagtggactgcccatcaatttcagtcctacagacatatgattaattatagaacatcaaagttctctgtgggtcaagccattcctataactgctttgagtctgccaaccattctgattcctagtcttagcagttaagtgctgccacctggcccctggcactcctggatctcatcatcctcattgaattcagagagcccacttagacagtgaaagcttccactgttgttcctggactgcagggaagaaccaacatggagctcttcagttgctgggacacctttcaccaatgtgtttctcaaagacttgaaggaaatgtctttgggactcttctagttagggtgtgagtaagcagatcttacataaaaaatctaccctagcatttcagtctccccaagtcttcgattattgtcctttagattataccaaggaaattctggaatctcaagtgcattctctgtgggccacttttgggtttatgtctcaatacaccagttaaacaaatggtagaggtagagccattcccaggcactcaggcaaacacattgaatacagaatctcttcttagtatacccatattaatatatttgacctgatccaacatatttcttccactcagattctacttgttaggctatgttcccatatattttccccaggtttgtgttataaattggcaaaattatgcaattcttttggtgtgtagggtaacctctcatggattgtattttgtcagatgtcctaagcctgtggggactgattctggttacaagtctggttacaagtctacacttctcattagaggtggtgggaatgggacctcaggaggattaacaatgcctggcaaagcgcctatatcataagaggcaagcatgggtttgcaggcaagggcaggctaacctcctcagagaggggaataacggctgctcccacaggccagtgaggctcagtagaatttaggggttcaaagtcttcaacttcatcacaatctgctcagaagtcttcatcccaattttcaggacacacaccttttcaatttatggcctaactttaacataaaaaaggcttgtgaatatgggaatttagtttgcacagtaattcaggtatctgtagataagatttagggtttaatcttcagaaatcttgattctgaagctcttggaaataggatttattttagggtgttcataaaagttttctggtcccctacttaaaacttgagcttagaatttaaatgtctgtgcttacgatttttcttcgccatgtcctccatgcattagaatcaagcaatcaacttcatatatgagttattctccttagtttccactaaaatactggctggtagcaaatacttgttcacacaaggccttgcctttggtaagcatttgattgcaggtgataatcaaagttactctttttgccactgtatactgtggactgtaagtatatggttaacacagaaaaacagaaccattaacgttttaaatgtaactagatcagagaactaattatacattctcatccttaaggttctgttcccctggactgaattctgataccaatattggtatcagtcagtgtgtgtcagagaagtagaatctctacgagtattgcagaacaagagattctttatgagcatgacaccttacacagctgtggaagaagctggaagagttgtttttatttttgtttctttgtttgtttgtttttcttaagccttttcagggaaattagagattcagagaaaagtcactaaccagctcttctgtagtcagagttggaacatgaagcatgatggagatctggaacagagccttggccactgtgaattatcacgccctgctcagcaggccctgggagaagagctgggcatacaatgaggaaaacggggacaacttagaatctccttttcatctttttccctgatctcggatgagttccacagagttgtcaatcttgccttccacatctcaaataatttttcaattttggccatctccaacacagaccatacatgaacagggtttctgggaaacatagtttcagcttgtccaaatgacagacaagcaaaacatcttaggtggtaacatattctctttatagacatctaatctacgagccgaaaccaaataaaaagctagccagaatgtgaatgcctctgaatagatactttaccacttcagcacaaaagattggcatcgatcaaatataaattcttctcacatgggtcttttgacatatttaagagctctcagtcaatcagaaataaacaatttgggctaatgtaaattttagatcatttacattaacctagtagtactggctattaaatataaaaatctacttacgtatctaactgaacattttatcttccagttaaaatcataggaagttaaacctctagttggatggttaaattttgagatttacctggatgtttgcattataataataagcaaatgcagcaaagactatgaaagttcatatacaaggaaatactgttaagagggttaattagttgtttgccaaagcctaataatttcttctgtaacttttatagaactttataatggaaaaacacaatatgttacattaaatcctactgtaaaatagaatagtaaaatagaaaataatagcttaaagttaaagcactgaaaacaacatataagcaattcatagaggtctaagtaattaagtttaattgcaactctgactaaaggcattgccatttttctattgctcgtatatgtgagcttcttgaaatgttatgatctatccattttggtagaaggaaaggtgcattttgtagaaaatattttccaattctaatgtgggcagaaaatcatataaatatttatttaaaaggaaatgagtaactccagacctgtaggttcattttattttgcactgatatttatttcattttttcttgctgagcttaattagaaaaatcttgtgtagagaagttgaatgcaatttaatcagcaggaaaatgcatttattatggaaaaagtatttaaaaacaaagaaaagggactgctggaaggatttattttggtaataccacctagaggggtaaggttaaagattcaatttacactcaacaggaatgaagcagtgaatagaggaggcagagtgacttagcaagacattttgtggtacaaacagttcatgcaaaatagtcacattgacttggaactgggattggaaaataccagcagaaaatagaacaatggaaagaaatcaactgagtccatttttgcagacaggaaaagataaacaaatattttcaagacagtattcttatatgtaagtaagatgccatgggaacacagaggagttagcttctttgcctatggtagaatgtggagtctatcaaataaataacattcattggaacttggagaattagttggccttcccctgatgttaattaaagagcaaatggtgatattgtagctaagaagaccaacaggttccacatcatgggggtcattagagtttcagaaatttgctggggagggcaacgtaaaattgagaaacactgtctgttgtgcaagaagtggcgaacatctgggagttgtgctgatggtattaggaggggagagggaatgagaagcgctgactccatcatgaatgcttagggctaagttgtaaatgacttttgtagattaaattaagaggactgggtgatggagatttaatacatatatccaaattagtaaagtaataaaaaggtataatattttaggaaactgtatcaataaagcagagactagactagtgttggaagagaaaaaattgctgcagaaggtatagctgtatctgaagtttatggaagaagaacgaaaaattgtgaggaaatattagagagggagataagcatttagagatattaataataaaacacaaaggaccaaagaaatattatggcttctgaagttataggaaaaaatagggattaaatcaagggatatgcagagtcatcgtaagtgggaagaagaagcagcacaattacataagacaaatcaatcagaatctgaagcaaagccatatgtaaacagttgacagaactataatccttaggatactggctctgaaaagaaataactaaataagcaagaatcaaaccactaaccactggagacattttggaaatataaaaatgtcttaagtattaaagagcaatcattgcctctgaaggaactggggaaaagagcatagagattttgttataatatgtataaatagaagtatatctcaaatgaaatgtgaaaagcaattagtggaagatatgatgcctctttcacttttatttaaaataaaagggtaggatcgaagtgaattcaaccatatctggaaaaaagcttcactcctctgaacctaggctttaaatctgacaaacttgatgatccttatatgttttttcatcagaggaccaaattacatatcaaactttttccagtattttcagttagtatcatatagtttattcttacccaagtcataaaatattcttcaaagtacatttttatcatgtgaatatttgatttcacatatgtgttatggtttatttagcctcttctcattgttaagcctttgtactgtctccaatctttggtattataaaaaacatttgatgaacgtccaactgatcccagcaatctaatacagttttctcatggtaattctgaaagcggattactaaatcaagggattcaatatattttagtctcttggaaacataatgctgaatcgcactccagaaagaatgtatcagatgcccacatatcattatacacatgccatcatttaatattaacatttaaaaatttaccaatgtaagaagcaaaaattgtaattattttgatttgtttgctactaatgctcattttttaatacgcttatttatcatttgtgttgattttgtccattttgtcctactttctgtgaaaattcaacttctaaagtcgtttttattatagcaccagagatgaccacatcattttatgtacttcagttgcgtaatggttttgaaatatattgaggagtgtcccacggggaggagaatacatttgggtttaaaatgtttcattcttgaaagaattgcttaaatttaaatagcaaatgaaataaattaagaaataatgacatatttggaataaaaacattgtttattattaaactaaatacatgtggcacacagtatatgtgaattgttgaatagttgttattggtatatattttaatatatactgttaatcttcttataagatgccttgcaaatacaaaatacattttagtgacaagtaaaatttaaaaaatacaatgtatttcaatactattttaaaaatcccaagttctattagcaataaaaaaagattgaactgaaggaaatagagtacatgcatcataagttcccaacgtaacacagatgtaatagataaatataattccattcttgatattgataactaaagtataaaatattcataaaaattgataaaagtgctggaagattgtcttccaaataaaaatacagataagataaatcataaaaaatatatagcaaaaacatatatgtcaaatgtacagcattaaaagcttaaaagcaaatagcatgaaacaagatagcaaatttaacttaaaataagcatacatgctttaagttttccaatgactagagcaatgttcattgtttagattattttaacttttattttaggttcaggggtacatgtgtaggtttgttatataggtgaactcgtgtcacaggggtttggtgtacagattattttgtcacctgggtactaagcttagtgcccgatagttattttttcgatcctctcattaaaaattaaatataatgcttctcaaacatgttaggtacatttctgaaagacactgaaacgagcagggcttgtgaaaaatagggttggaactagacctctggaaatatatgcagccttgtaaacaggcagtatcaaacaaaaacaataacaagcctaaacaataccctataacagatgaaatgacatcttaagaccatgaggaagagaaatacacagtaatttttaattcttctgtgtcatagtaaatttaaaagtgtatcatagagagagagagagaatcagacattacacatacactattcaagattattatagactctagatataccgaataacatatagaaaatacaggagaccgagaacatgttaacttcttgagggtacaatcagcaaagtccaaatttgggaacatgcatagaacaaatgacctggtttctttgactaataatttctaaggactaagtaaaaagaaaacggaaggattaagtaaaaagaaaagagaaactttagactaaaataccttggataatatcaagaaaaaaaattagccaaatgtcctgtatgatccttgtgtggatcttgattaattatgctaattaaaataattgtgaaataattggggaaatttggtcatttattgggtatttgatgatcaaattgtcatttttttatgttgaataatattaaatttgtttaaaatatgcatttttctttcagagattaaaattaaattaatcatggatgtaattacatgatgcttggggttggttttatgataattgatggtcaagggaaattggtgaggacataaatgaagcaaaattggccatgctttgataaccactgaagggaggtgatgggcacgtgggatttcattaaagtgcactacgtactttcatatgtatttgaaacttttcataagaaaatatttaagggaaaataaagacaaaaagaaaagaagaagcatggtagaagtgatggaaggagggttcaagctactgagttttgggacaagggaatactttggaaagtctgtagagaatagctcaaagcacactttacttccaaaacagagcaaatgtccccattgagccagggtaaaaagacattgtgtacaaaattcatatacagctggttgcattcagtaatgttggtatactgaacttggttgccactatttgctatttttgaatgaataaattcatgttacagaaatattcattttagcagaacaggtagtaaataagaagaaagcaatgataataactattaagtccatgtatgattaaaatgaattaaagagtttatgtattctaccttggtaaaacatacaatcttaactcggtatagaaacataaacatttatagctgtctcttaccataccaatatacaaatgcatattattttcaaccatatttatatttattactcaagtacactaaatattttctgatattaatactgccactgctttttaattcaacatctccattttgagtgataattttgattgaaaattttccatgatgtgaacaatgccttcctatttttcccaaataaagctgatggatgatacaatgtctgagattttgtatgtaagagaggtctttctgttattttcttataagaattataacttgactgtctctacattcttggatgattgtatttctctctcagttttgcaatattcccttatcgttttctgaagtggaatgtttaagaaactttgggggttttgttgtttttgtttgtttgtttgtatcagtgacagtaactttcctaatctttttagaattcaaaaagctcagcagtatatactgaacatatgtcctttatcagcttacttgttgcaagaaaaaacaataaaattttattaccaatttcatgattattgattttactcaattttcttattaattgcaagttgaactttcatgattagtaataaatatgttctttgcctctgcctttgggaatgtttctcaatttttgttttctacagcatttatttgaattttttaaagcaccagttgtgttatttattttctgcaagaggagtcaacaaataattggatactagtttagtttcaattcacaatagacatttgattaaaacagtgtggcattggcacagagattgactatttctatattaggaaagccttagcaggatgtgatactgatattgtgaataaaatttcattgactataacaaggtagagggaaatggaatcccagagaagaaccagtagacataggtatagaagcataatgtgcataaggaaccacaagtagtttacaattgctagtgtgtacagtctaaataagatgagaggtgggtaacagcaatgttttaatttgctagggctgccataacaagctaccacagcctgggtggcttaaacacagacaattatttctcaaagttctgggacctacaattccaaatcaatgtgcctgcaggtttggtttttcctgaagcctctctctttggcttgtggatggctgccttcttgctgtgccctcacccagccttttctctgtacacatccctggtgtctcttcctcttcttataaggacacccatcttattggattggggcctcactctcatgcacttattttaaatttatcagctctttgaagaccatatctccaaatacagttgtattcagactgattgaggtttgggacttcaacatatgaatttttggaggagacacaattaagcccataacaagaaatattttaaagtattttagattaaatgacatggagttcgatctttatttatttttaattattttgtggagggaaaacactgtaagatttcatgtatcagagtgatacagtgtctagaagtttgtaatatatttgggaaataatattgtaggactctcatatttattattaacaaaacagtactgtagaggaaacgatgtaatttaatatttacatatacatgtccaaatgtcttatcagagaacattcttaccacaactgtgataggaaaagtaataaaatagccaagatagggttgtcactagcttcatgtcccatttcttaattattattattatttaatataaatgaataaagtatttcagcttattccaaaacaatttttaactagttcttcagatggaagtaggtattacatgtgtgtgtgtttgtatgtgtgtgtgtgcaggtgcatgtgcatcgtgggttatttgctatggtttgaatgtgtcccccaaattgcatggggttggggactcatgaagggactggtgactttataagaaaatgaagagagatttgagctgacacatatgctcttaccctctcaacacgtaatgccttctgtcattttatgacatagcaagaaggccctcaccagatgccaataccatgctcttagacttcccagcctccagaactataagaaataaatttcattttaaaaaaatttacccagtctctggtattctgttttagcaacagaaaatggactaagaccgtgttctataaaattataatgaggttattctgtaattggccatataaaacagacatatatttaactgattcttaatgacctcagattattttgtagattgaaatttacagttctagttttattccagaataaaaatgtagtgttaccatcatcactgtgtgatcatttccatattgcactttatagtctctcttgagtgttgcttggacataggacaacttactttttaaactattctctacatctttaagtgtcttctttcattgcttcattcagcaacatttaatcaagcaccaaaaagtgctagaaaccttctatccactaaagatatggcagtgagcaaaacagacaaggactctgatttcacggagcttatatctaaataaataaataaaatgaatattatcaggttgtggtttaagtgatgagtttttctgtgtttggtctgctggtagccttatcgagtaaattttccataacagatattttacctttttaaaattctataatatctattctgttctttctttagagtttacatttctattctatagtttccatcatgttcacccatatagtctgtattttcctctaatattggtctttaaaatttatagttatttaaaagtccttgtttgataattccaatatctgatatacttctattaacagatttttcttttaatcttgtcatattttaaaactttttcacaagtcataatttttaaaaattatatcctgaacacagtgaatgacactatgcagagactctgtattatgttattttcctgaatagagtgttgagttttatttaagcagacagtcaaattcctagcaaattactatgaccctattgaagctagttttctttttaaatttttattatactttaagttctgggatacaagtgcagaacatgcaggtttgttacatagatatacatgtgccatggtggtttgctgcaccatcaacccatcgtctacattaggtacttctcctaatgctatccctctcctttccccccaccccacgacaggcccctgtgtgtgatgttcccctccctgtgtccgtgtgttctcgttgttcacctcccacttatgagtgagaacatgcggtgtttgtttttctgttcctgtgttattttgctgagaatgatggtttccagcttcatccatgtccctgcaaaggacatgaactcattcttttttatggctgcatagtgttccatggtgtatgtatgccacattttctttatccagtctatcgttgatgggcatttgggttggttccaagtctttgctattgtgaatagtgctgcatcatgccagttagaatggtgatcattaaaaagtcaggaaacaacagatgctagagagaatgtggagaaataggaatgcttttacactgttggtgggagtgtaaattagttcaaccattgtggaagacagtgtggtgattcctcaaggatctagaaccagaaataccatttgacccagcaattccattactgggtatatacccaaaggatataaatcattgtactatgaagcttagttttaagcattatagagtgaacacatttcacttttactcttaaatttaaggcattgttcatactaccagagcatggttcttccttctggtgactagaacgaatgtttggggtggtcaccaaggtgagatctatgctcaggtctcagctgagcaagagttgacctatgttgggcatcatgaagtctctctgacaatgagcaatgtagcattgagcctaggacatctgagtagccctttggcagatttctgggacatccatgcattttccacttctctggagttctgcctgtcaagttctaactgcttcagtatcagaagatcaggaatggagctcactgcttcagctcccccttccctgcattgcatttagaaacgctcccaggctgaaagccggcgtgcacatggtactcacttgtaaacatgcttctatccaggatcccagctctatgatgcttgctttctaatgcctgaaaacagggtttttttttttcatatattttgccaaactttattgttatttacagtggggaataaaaagataaccagcttcttcattatcttttgtactacaattgactactttttaaacataatacaatgttaagattccaaatgggaaggaaaaaactatatacactacttcagtgttttattatcataacgtggaagttaaagtctttctcttttgacttctttcaggcagcacacatttattttttgtgtcagtttctctactgcctagctactttacattttatccctgaaaaaatatttctaaggcagtgttgtttttatttttactggtatcctttggtctggttaacctgattaatttaaaggaaatagcactgagtccagtatttggaactgtagagacagagaatgaaattttcaagtacagatctgtctaacacacagtagagacagccagataactaacgcttatctggaaatcctactctataacaaacatttttgttttattggacacagaatgtaatttgagtcacaattatctttcatatgagtctatattgttattcagatgagttatgaatctgtgattactatttccattgttgaagtattgatgctgtctttttgacctggtgatataagatatgtaggcgacaagggtaagcccattaaagtggtagaatttggcaggttcttgagtaggaatttcaaatcaataattcttctttggaaactgtgatctatggagctggaatgaggtaatttgaacactttttaattctttttttttttttttttttttagttatggtggctaaagaaattgtattctgaaatccttttttttttagtttggtagctaaagaaattttattctgaaataacacaggtcttcataaagtgagacatgtaaatagtacaaaacaagttatattttgtatagatcatgaaatagaaagtatagcttgtatggtttgatttctagtaatgagtcacattgctcatgaaacgggaaagattgccttgccccctggcagggcgtgcgatgggggtgtggtttgcttcttcagtgacccgctgctcagccctctaggggaagcacacagacgggcaggctgggggctccaactcccctgacagtgtctaggggtgaatagtttacagctcttgcagccccagtggctgtgttacaggtgctctcttagtttgcagtttataggtggcttgtgttaaccagctcaattagaccccgttccttatcacaaggacggaggtttttctgtatcccgggatttcttgccttggtgtaccagaagaatcagatcacacgtgggcttgaagtgcaaagttttattgagtggaagtagctctcagcctcagccaatgtggatgccaaaagggagatggttttcttctggagctgggcagctcagtggccccaactttcctcccactgccctggccaaactccatctcatcccacaggtggatggcctgccagcctgccggtgccagctgttgtgcttttctgcccgcaagctctcaactaacagccgcttgtgtgttaacctccaacgtgttcctcaggacatccagccacttctgtgtctccctgctagggtctcggggcttttatagacacaggatgggacgtggcaggccagggtggtcttgggaaatggaacatttgggcaggaaatgcctgtcctcacctaggtccgtgggggtggagccctagccagggacccgcctttcctacccagcacttcacttcccagttcccaatcatttaaagggaccaagctcttcccttcagagtgctccactatcactaatgatggaactaattctttaattttcctaaatgaagaatagatattcatagtacaaaataattgaataggggcactggaacagcaattatttcaccttaacatctttaaaaaaacagctcaagttaccaatgagttgctcctatgggtttaactagtatgaattaattaacagccaaggaagacaatatcacaatacttttaaaattctaaagactcagtgtgtcttctaaataatttaacagaataatgaaaacagtttaaaataaataacatgaccattatgaagtcctaaatctaaaacactacttttaaaataattttacttttaaaaattatttttaactgatacatagtaattatacatatttatgcagtacaatgtgatgtttcaatatatgtatgcattgtgtaatgatcaaattagggtaattggcatgtctatcaactcaaacgtttatcatttttttgtgtgtggtgggaatcagatgcatcttaaaatagttgtctacaattaatgtgacatattttcattttatccaaaagtcattattgaaatattttccctcaaaattaataagcaatgaaggtagaatgctattttcttttgaaaagaaaatatgtgagatagaaaatttgagaagttacatgtgagatcattattttgtatttgttttaaaaataagacaaactagatataaaaaattaacacattaattaatatatttaaacatttcttgatacctctagtagactcttttctaatcacagaatttttattggccacctaatgtcaagatccttctattcgctgttagcgttagagatttcccatgaataaaaagtaattaacaatgttttctttttgtttcagaaaatagccaacttactttctgttttcacaaaatgtacttcttaaaatacaatctttttaccaaaatgatttagtctcggttcaataggaatttacattttccttctttcagaacttcacacttcaaacagattccaatcaatgcctctatgagtgttttaggcaatttgaattgatagttaacttgcagaaaactcttaggatttcttcttgtctgctttgggagatgaagaaaatgcggttctgttgaaatggatgccaaataggggtacctgtgttcaaaggttgtatctctagttctgctgtaaacttggggactgcagactttatttttttaaactatgcttaatggttaaaagcctgaaccctgcggatagacagatctgaatttgaatttggccccagcacatatttggctgcatgattcaagaaaaattaattaaattattagacttattttcctctcttgaaaaatgtttatagtgatcgtgtatcacaataaatagaagaaattgattggcaaataagcatttaatggacatattaatatatttgttatttctgctgttatagctgtttatcagtaaatttatactcgacataataacttctgaaacagttttacccttctcctgcaaccgcccgctagtccatggtattataatttcaaaaacattattatttcactgtgctactttaaaaaatcctcccttttttcaatctatcttattttttctctgaatcattccttaatctctataaacctgagcaggaagactcttaatacttgtttccagtgttttccatattgcttttgtacagtatgtttgctaaaccattgataaacaattttaaatgatgctatagatctacacactaaatgttgaataaaataaaaggcagcaacaattaaagatgagttcaggccatttcatcaactgatgtattgttcatcaagattatattgaacaaagacaataaatgcagtcatggtgacatacactgttccaatctttttagcatttaaatcaggagaaaatacgtcttgatcaagcaacactatctaattggtggggatcctagcatgtcattgcctggatttttgatgcaaaaagagacagactccaaggattaagaattagactagggaatgcaacttggtcatttttttgatttgtggtgattttattatggatacagagcatattcttcttacattgaacactttattgaagctaaggggtgccgcacattgcttgaaaaggttagcctatcccaatgagcaaataggcatgtactatgtcaagaggaggacttgaactttctgacagcctttccagcatgagaaggaagagcttcaagatgtctcacctagaaatccagacgcataccctattatttatgcagcacattttatggaggtagtctgaaactggctttaaatacttaaaaggacaatggtattgtattgtccagagggttaatacttgatgatgtagctgaaatggtttaaatgtgtgtcccctccaaatatcacgttgaaatgtgatccagtgatgtttgagatggggcctattgggaggtgttggatcatggggagggaccactcacgaatggcttggcgccatccccttggtgatgagtgagttctcgcacagttactttcgctggagagctggttgtttaaaagagcctggctcctcctcttcctcctcctgctccttctccttctcctcctcctctttcccttccccttccccttccccttctccttctccttcctcttctccttccccttctccttccccttccccttctccttctccttcctcttccccttctccttctccttctccttcctcttctccttccccttctccttccccttcctcttctcctccctcttctccttccccttctccttccccttccccttctcctcctccttctccttcctcttccccttctccttctccttcctcttctccttccccttctccttccccttcccctactcctcctccttcttctttctctctctctctcccccactgtcactttccctctcttcacttccctgtctcccctctgccttccaccataactacaaacttcctgaggcctccccagaagcggaggccatgctggtgctgtgcttgtatagtctgcagaaccatgagccaaataaacctcttttctttataaattacccagccccaggtgttcctttatagcaacacaaataaacagtaactcatagatttaccaggagtcaaacacttgataagaggaagtataatagtgtcatcaagaagacaggttttgagctcagatagctatgatcagtatcagggcccatcacttactagttgtttgaccttgggcaaaatagttgatctcttaaggtctcatttttctcacctataaaatgaagcattaactcctgccttattaggggatggtgaaaataaagtgaaataatatagataaaactctcacagtgcatggccattagtaagtgctcccaaataagagcctctattatttatagatgttttgactatttaaatggcaaataatacaacatatttgttatcctaacaaaatagcaatctctgttttatgtgttttcatttacttgcaggagttgagaacttccttacatcgaaatcacattacaaacaatgaagataaaaaatgtttattagtactcattgtgtttaatatttcttgattgtttttgttttgtgaagcatcttgctggagacatgacatgactctaaccaaggcttggtcttttaggcatttatttttgtgcctgttctagaacaggagtaataaagacaggcaaaataatatttctaattaggttaattatgcttagtcagttaatcacaaggtgcataaatttatctctaaactgcatgagcctagaagctccttactgaaaaccacacgtttttcattcaaaattggggaaagtgagggcaaaatatatttaaggttttttgcctagatacattttgctctgatttgattttaatagaacaagtctggcaagaataaggccatggtattctgtcagttaattaatggttcctatcagtgaataacatcaatttgatgtatttcattatccttgtaaattagaaggcgctgtttggacctgcatggagatgtgaatggcagggagccacacccattctgcctgatctattgcactcacagttcagctgtggggaccaccctttgtggccatctcagtatctttatgccagattttcatttaaattggcacatttaattgtagacagacatagtaagccttctctaaaacttgtcatttatcctgtttgtatcctaaccttttccatagtataagcggagagtgctatctacatccccaaatagtgtatcaatcctacagataaatgtttgtaacagtttccaagagggtgaaaataaaattaaattatctgaataaagctctcatagtgcatgacatacaataagtgttcccagagtagccactattatttgtagatgttttgaatatttaagtggtaagcaatacaatatattaaattggccattgcattttccttaggcctatctgattaaggaatattgactttttaaatttgttttgcttattttctttgtttgtctcattaactaaatctatattaaaggaatcagtttttgatgtgcttctctccgcccccactaaagtctagtcctccttaaaataagatcaattcagaaaggaatgcctaaaagcagatgtaacattttctgctgaatttaaaaaccatttttctctatataaaacaccttgtgaataaattcattattattaactgcttacagcatgtttatctgtgcctttggcaatataagtaacgccaatctgtctatatgctgatgagacatatggcaaacaaaggcagatataaatttgggtcaggagacacattttagtcttttggacatagagttctgtagactctgctgatgtgaactgggcaatgttgcatattttctggaaggcccaattctgaggtagtactaactttcttcaggctaccatgtaggtctttcctgaaagaaacagtttattccaagtgtgactaatttattcctaattaagctcattacattatggacattttaaatagagtttgatggattcttgagctggcattttgtaaaggtcacgattagtgaattttaagttaatggactctactaaaaaattctactgttgctgatccaacttagcaattaatattcagactgacttacctaacacacttctcagcggtgtgaccttgagtacgttgttttactttttgtgactcacatttctcaaaagtaaactggaggcaataacaatattcctaaagtaagtaattttgactattaaatcaagtcaaataactaatgtaaagttatttgcagtgtcaaaatattcactcagtatgttattcaatgacggtgaaatgtattaatactcttagataagtctttgagatcaaacatacattgttgtgaaaataagaaagcaaagcaaagaagccaatgagcattatagaagcaaataagagcttctagtcaagcacctccatggtctttcttgctttctaggttaaggataaacagggtaggtggaatagcaatgtaggctgagggctgagaggcagggtagacggttccatcatgagcctgatcctgtatggagtgaactccctctacacattctttacacattgaaaataaaagcaaaaacgacgatgacaaaaatgaattactatctagattctagttgttatagtgaaaggaattattgatgtaactggctttcaatatgaaagttttcatcagtaaatcatcccactttttgctttgatgaggattaatcttgcaattttaacttattggcgccaatttttctttctctgaaacttcctatagagttaaaccttcaagctccagtgaagttggctgacatttcgttatttttgtgtctcatcaaattatttaccttgccaggcatttaccacccactcttcttctgtaatttcaattcaaatttattttaaagaacaaatgtcttgcccttgctgatgagaaaagaacattagcggggaaacagaggagaaaaacataagaaactcattagaaaaagaggcatcatttttgtcacaccatttgggatatcatagatttgatggggaggcactgatggaatatccaagcaagtaaatccaatttttagagggtgcaatgctcagttctgcaaggattcttaactctcatctactgaattatggcatcacatttgtcttgcctctgccaagaaattcacttgtaaatatttctaatatatacataccttttaagatagttcaattttttgaggcgcgagaatgtcctctatttcattatgtttatttttggtctctcatgatgaagcgagttgaagctggcgtgcctggatgtgctgcataggcgtagattacatgcacattctcacacttcctactccactttgcttcttccttctgcccctccacacctggctgccaccaccacatgcccaaacaacacaaggaaacagtctaaaaatgaccgagctatgagtttttatattaaaagtgcatggaaagttttgaaatcattagtgcgatgccacctaatactttaatgtatcacagcaattatattttcatgcaaatttattaaatcacaacatattccagacaacctctccaaactaggtaactaaggttagtttgaggtccttaagggggatgtgcgatgcagtgtcagaatggtctctgcgttcaaagagacctgggacaaagtgtgcttccccacttagcaacctcgttaagttatcttacgcaaagtttagctggcacatttgtaacatgtcgatagtgacatttatcaaataggattaaaggggacaggtgtataaatctctttcctttgagaaaatggcaaaaccaaaattgtcttcctagttttatgtgtggtttttacagcagtgacaacaaaatcattgttggctatgtgaacattaactccaggtcacacttgctccaacaggaggcttagcaggggtctttccattccactggcagaaaggaatgatggatagcaggggaaataaaatacatgtgtagatctctgcctcatccaaatatcctgctgaaataccagcacggggggaacagaaagaaatgagccaccaggcaaagagctcaggaaaggaagcaacagtaaatgagaaacatcagtaaatttttagaggctgagaaacagatgtattagcagtcagaggcttagcagagctgagaaagctgaaatccagggcagcagaagaaaataccatttagaaacgagctaatttacagagcagaacccattaaaggctaaggaattagaagctctataagcctcaggatgtggaggcaagagctggggtgaacactgggaggttaattgtgtgtctccataagaagcccttagaccctttagaagaaattcttcttcatctgtgcttaataaaactacccctgtgacatttattcaatgcataactagaactagagggaataatgacagaaggaagggtaggaactaaggtatcttattagaaacagaaattagatagaagtttatgtactttatacccccttccactgtttcactttctaagaatgttgaaaattctttgtaaaagtttagtggctcaaagaaaatacctacagacattgctttttggaagaagccaagtgtaacatttggttcttgcccagtttcctttggttaagcccactagttgaccacctcttgctccagtacacagagatttttaactggctttgtagtgcctaatgaataaagaaagtaactcttaaggaaaaaaaggtaattcatggaaaagaaagcatcaaagaagtgataatatcttccaagagaagaaaaaatctaggcacccacaaaacaaccactagatgctttttcctggaaaacagacaaagaaagatctcataagtgtcgcccctcccccttattcctatgaatgtagaaaaaaatcaagttggtgaaattttttagaaagaacaggcaaatatataaaaactgcagaaaaaaagacaagacaattagaggatcattgcaggagagtccaacatccaaacaatagaagttccaggaaaagaaaacagaatttttctcagaaaaattcagaaccttctatacctatcagaaccttcatcagagccttctatacccaccaccattgaagagtaggcccctaccatgccgagagtaacaaatgacctcctgaggagtttaaactccatcattagccttcaatacagaaactgtgcactgatgtttcagctcacccttccagcaacccacaagtaaaagtggggatcttatactctcatcagcaggggtcaacaaggtatcatagagtgggactaaacagcttctgtagatctcattatttccatgaacgagtgtcaacaaaggaatccagacacctgttctttcctttaccccaacatccaaagcttcaccactatcatcttccttgaatccacagtgacttataaatattattacaccttttcttccttttaatgttaatcatctctcatcttttacactaattttcacaaaggtcaactatcctctgttctactccttttctccattctttcaaaaattctgaaagctttttcacgatttcatctagatattatggctcatcattatcaaatgttatgtatgctcttctctgattacaatatgctcttcctctgtaattatttcaccttcttgctctaacagaattctgagtgttctgactactccaccttctttgcagccctcttaagtggtaacttttatattctacccaagggcatgtgttgaggaaatgtccttattattcctccttgctgttttcaaaccattctccttccctcctccctaaaatcctctgtctttgaatatcatctcattagattgtatcctcaacatgattatcatctaagagggtccttgtctcattctcactgattccttgatgatccacatttttattccctgtcactctttctgacattacttctgattttcttcctgttgattttaagatacacatggataatatttctaacacattggcctttttctttctaagactcctctgcttcagtaatgttacccttcgccctccctcagtcataactctggtggtcgtattctaggatttttcattgtcaataactgcaacccctccataatttcagttttatacatttcttgctgactgcctccactaacatttcacctgacttcatctgacactttaacagtctttcaaccctaccaggacctccaattcttaggtcctccctcatttttattccctaacattctatttttttttctttattcatctgaaattccatggtcaatcactgcagtcacccttgactctctcaatcccattcttctccctggttcttgtcgggtaaaatctcaaaaatgactatgtcagactttctgcctataccatgcctgcccctatgaatgtagctggagttaaattcacagctttattattctcgttttaaatcagaaccaaaaacttcaacctgtttttaaaactgaccagtcatcataccatatgctcaggaatcatactgtattactgtagtatacttcatgcattctcccactctcccaaaagatatttcacatttttttctctgccttctgaacttctaacgtctcttcctctatctctcctctcagctgatcactgtacctcctactttcctttaaaatttgaagtactggaagaaaattgctacacattgtcatctccacatctatctgcaacctatgttagtaatcctatattctgttttaacccattccacagctttattaagcacctctgaataagctagggcatagagacgcaaacatgaatccagcatggttcttgccttcacagagtgcgtggtctcaatatctggtccagcagccttcagggaaggtagaattcaattgtctttcctctggggaaaagacaactttattacctctgccctgttatttactgaaggtttagaactagcaaactcctctttcaacttttatccacctgacagcagagtggagaattaaacagcacataattattcaaattagcaagtattaaattcagcttataataataaagaaaaagagcatggcactgctgattactgcaaatgattaagacttctgagtaagcgatgagtgcttgtacttaagggccggctggtcccatggtgatggcacagtgccatctgctggagtgccagtcctggctcaaaatgtgatccaaccagagaacgtgcttcaagagttgtgtaattggactgacaattctgtttctgaaatcatgtctaattacaaaactactcaaagatttaaccttcctcaagtcagaaaagaggttcaatctgagagaagagacacagtgtcctgatatgaatcataatgaatgtataattttgagagctaaaagggacttttgagatcagctggaccaaactattcaatcattttatagatgagaagagtggggtccagatgtcacatatgacttctcaaaggtgatattataagcatgggatggtgctggatctagaactcttaaatcagttatccttcttccacatgtatattttgttccttattttctacactcagccggctgttttctgttaggtgctatattatgtattatctaaattatatttatatttcttagtatttatttatttataatttttattttactttaagttctgtgatacaggtgcagaacatgcaggtttgttacattggtatacgtgtgccatggtggtttgctgcacccatcaacccatcatctaagttttaagccccacatgcattaactatttgtcctgatgtgctccctcccctccccaccactgacagaccccagtgtgtattgttcccctccctgtgtccatgtgttctcaaataagtatgtatattaaaaacttaacttctttataaatggatacgagaggtgttctaattcaatttcagttttcattttactgatgacagttacctaaggaaacgttcacatttcctgactcctagccagtgctctttctcctatttcagtgttgttttaaaagactatctcaaacacagacatggctggttaattacaaaacaaaataaaacgaacaaaaagccaactaaattgcataccttgaatttctgacagcttataatagcattatttttagtttttaaataaaaattattatagttctgaaaagctgtgctctctcacaaaagccagaatattataaatttagttctccattaatgcctggaaaaattacttcttgctggtgccaaaaccatgctatagtgacattaaatgacaaacagatgtttttgtattgtgttgttcaagaaccatgttaatgagatgaatatacttggaaatttggaaatatgcaatcagatatgtttctatcttactagatcttacttgtaaatgggtttgtggaaataaattcagatgctatttgaaaagatgtgtctcatgaggtaataaatatttctctagtagaaaagcaatatggaaggagaaaaaatacattaaagtaatgtttttcccagccaataatttgtaaaacatatattcttattatatacctttcataggcaaacaaatctaattttaaaactagtgatatgaatttgtttattggacaagtgttatttaattcctatcacatgttgggcatctgcccacaatgctaggtgctgccatcacacaaataaaagagcccaagaactcacggtgtagggatataacaccgtgtcaaccaaaaaaaatcatttgatgttttaagataatagaaaaatccttcctcatcctggataagaatcctctcctggttttccttctgcatatctctgttttactaaagatatctttcatgaaataggctggctctaaacctccaggacatgtttgagacacaaaaggaacataaaacgactttccatttttcattcaatatttgcatatattcatctatcatttatttttacaattatcagggatttatgatggttgctttctctagatcaatctggacataagtaatctttgtaatcgttagcttttcttccactattacagctatttatatctcttgtaacactctttcaagaatcaatgtggtacagtatgctactcattttattaacaaattagagcctctatgaatactttatgatgccagtttcgcaaatctatccatgactagatgtgtccccaaccaaccttttggttaaagtctctttttaacatttgaatgattctttaaatctggtcctcatcttgtcacctgtcagctgttccactggacacattacagtcataagtcttattttaaaaggtaggcagagtcaggcgtggtggctcatgtctgtaatcccagcactttgggaggctgagctgggtggatcacctgaggtcaggagtttgagaccagtctggccaacatggtgaaatcctgtctctagtaaaaatacaaaaaaattagccaggcgttttggcacttgcctgtaatcccagctacttgggaggctgaggcaggagaatcgcttgaacccaggaggtggaggttgcagtgagccgagatggcaccagtgcactccagcctgggaggcagagtgagactccatgtcaaaaaaaaaaaaaaaaaaaaaccccaaaaaacccaaggtaggcagcatcaaaacaaaaaagtaaggtaaaccataatacttaaatacacacgagaccattttttaaccatgaaattgctgagataataattttctaggtagacttctatattttgtttttattgttaagtcaatgtaagattgcaatagaatgcctcttgactggtaatggagatcaatattcaaacctaatacttaaatcccaagtgacaagaagatgactaaaaataacacaggctgcaaaagtctgagtcatataatgtcactgaagggaacaatcagaggtttggtgaaatagtatttttgtgaagcagtctatttaaaatgacctgatggtatttataatactgagccgatcatctcaaaaaatgattctctagattgaataaagagaatgtattcaatataagagccagtggagtatagacgttaaaaacagaggttctggaagaaatttcctagatttgggtgtgggcttttacaactactgactaggtgatctggatcaaattattctgtactgaagtttttccatcaataaaatctcaatcacaataatccatacttcataactttcttgtgaaggccaaatgagttagtatgtagaaatcactcacaccaatgcctaaaatgcccaacaggattatttaattgtattcaccctcaaaattttgcagcagtgtggaccttagcagtagttaatgttttatgaattcatatgatttttaaacataaataacaaacaaatacacaaacatgaaaccacacaagtaagcctcagtgatcctaaaactggaaaacatagaatcttattcctacccatgtgtgtgagctatctaacctgccttagtaagataagttagatagctttcagtaagctatctaacctatcttagtaaaataagacaaaaatgtccttgtattagggatggtctaaggagaaagttcagtcataagtataaaatgttagaaaatggattcgtcactatagaacatggaaatattattatcaacaccattgttaccttggtggaagaatgtagaaatctctcactcaaataacaagaaatcactcatttaatagattacttgtaacgctatttaaaaaccatgtatctttcagttgaaagtacagcactgagtctgtctttattgtattcccccaacaaatccaatggaaatgacaactaagtgtatttgaggaaatgcattcatagcaattcttaaaatgagacaaagtcattggtaactcagggcttttgaaaattttcaggaagataacagatgagatcagagtgacaatctaaacatgaaacaaacacagagagtggctagatggcatgtgaaagtgctctccctgctcagctatggaaaggctccaaactctggataagaaggcactaggcatttggggtggaaaatggggatataatcatgattattaatcaaaggattaactgcagaaatactgccaaagtccttgccctccccaccccatgcatgcacggagtcatttttgcccaagttaaaaaaaaaaaaaatcaccacaaagcatgtttctcaaactgtggttggttaaccacttgtatcagagtcacatgatggtcttattaataattcagatagctgatttgattgcagatctactgagttgaaattctgggagcagaacattagattctgtatttcaaacaaatttctcaagttttctccactacatttggagaaccattgtgccaaagaaatggaaccaccagacttggatggcaaggtttccactagaatgtggtaaaagcctagaataaaattttaattctgaccaaggtggaatgggaaacagagtgaccatcccacctgaaaaaataaaacatcctacaggtttttccgaaattggacatcaggcagtgcagcacagtaatcaccaagagaagggaaacagatgagggaaagcccacaggtgcctcaacttctgcccagcttatttgctgcagaacagggaggcaggtggaccaacatggggccaacgatcaccctgagaagagaagaaagtagggggctggggaggtgaaagtgactggaattcataggccagattgcaagagaggggagaaaaagagacagagaaagaggtagagatgatagagatagagatagagatcgagatcgagacagagacacagagatagagacagagatagatatagagacagagatagagatagagatagatagagatgagagagagcgagggagatttgctccaagggtttccctcaattctttagctgactactcatcggcaaatgtgtgcaaagaaattacctaaggtcagagaaagaagcatctaaaaagagcaaaaggaatgattcccggagctcacatagacccaggaagaatttttttgtttgttttcctaccaggaaggaaaacataatttatagggtgctggggagagtattcagaagtttcttgcctctgtagcaagaaaaattagccctagactaaagttgctctggtcccacctagcaaggtttattagtaagcctcagaaggattaaataattttcaagtagcttaagtgcattctagaacaaagtcaacatttttgtaataattagaaatatttatcacccagtaaattaaaattcaaaatgcctggctttcagtcacaacttcccatgaatatgaagacaaaggaaagttacagagtcacttcaatgagcgaagggagcattttttcaatagatggtgcagaacaattttacaagccatatgttaaaatatgaaccccaacccttacctcaaaccatatataaaaattaaccctcaataggtcattgtcctaaaaataatgacaaaaagctacatgatattcagaagaaaacaggaggaaattttagtgaccttaagtttgacaaagatttcttacacatgatgcaaactgtttaaaaagtcaatatattggacttcatcaaaattaaataattttgttattcatagaaccctgttttgaaaattcagaaagcaaagccatcacctaagataatatgttttgctaatatatagccaaaaaggaactgtatctagaaaatacaaaaaactttattattcaacaataagacaaacaacccaattaaaatgggcaaaaaatttgaagggtgtttcactaaacaagtttatatatatatgtatattacctgaaaaagtgtttagcatcattagttattagagaaatgcaaattcaaaccacaataacatgccactgcactcccagtaaatgggtaaaatcaagaggtttgtcaatattaagtcttggtgaagatgtggagcaactggttctcatatactgctggtgacagtgcacaatgataaatcactttggaatatgatttggaagttcctcaaaaagttagatattcacctagcatatgacccagccattcctttcacacacatttagtttagggaagaaagcttacatccatacaaaaacttacatttgaatgtccatggtagttttattcataataaacaacaattgaaaacaactaaaatatccattggtgagagaatggataaacaaattatgatgtatccacacagtggaatactactcagcaaaaaaggatggattattgatcaacgcaacaacatgggtgaatctcaccataattattttgagtaaaacgagcaagacaaaaaatgtacaaactgtgtgattccacttatagaaaatgatagaaaatgtaactaatttgtggtgtcagaaatcatatcaataattgtctgggactggggtaggcacaagatggagaaatccataggggcatgagaaaactcttgaaattaatagatatcttcattaccttgattgtgggaatagtttcttctgtgtattcatatgttaaaactcataaaatcttcacttacataattttcattcatgttgaatggacaatattacatatttatggctttttcctgagttcccccaccctctatcacaatatggtataaatggatctgcactatgtacgttgctaagctcaccagctcatcagtataggtgatcaagaagtagcatgtgtgttggtaaaacatgtgtgctcctggaagtgtggaataaaccctacgaatatacaagagtctaccacgtcagtaaggtttttagggattcagttgtctgggacatgccaattatcttcttcaaagttatggaaaaataactctcactcctttcaccattaacaaagaaatatagcactaggcaggcctcctaagttgtggaggcaacatatttcaccctttcaatgaccacttcaattaatttgccaatgatataacagagatgacttccatcttggatggatcctagggcaagaaagggcttgtcagcagatccaggctgttgtgcaaagtgccgtgctgtttggctaattcagtgcagtaaagtttgtgctattacatgtaacttaaatggggaaaaatgccatttgggtttatggcaagttccagtagaagaattacagtgtagcaatgtagatctcttagttctggagggaaaaaaagtcttcttatcaggagcagagaactatatatattatttaaaagtcagcttctgtgtggtactgggccctgggagcaactgagtttctgaccatgggatgtcaaatacccatgaaatcagagctattctccagtctactaaatcacaaggggcagcacacccagcagcaatccattttaagatagggcacatccgggattgggcagaagcagaaccagagtaaacagcataggcaggtggtgcagatgccctgcgactgcagactgcagtggcctctacctcagctcacacctaagggtacatagagaacctttgcttgactcctggatgggtcatcttataatgcttacattagggcacacaggaagagtcctgccaaactttaagctatgactgctctctggtcacttcaacctcctcaaactaaaagaccagcagatgaagaaaagggttactatactcacagagatcattgacactgattgtcaggaaaagacgggacttttacttcacaataagaacaggatcaggtgctgcattgaatctccattgatacttcattttaatattgaatgaaaacattcaatagctacagactgagactggcaataaaaaggggctcaaaccttctatagcaacagtggtgccaggaaagagtgagtaaaatgtagaatgggtggtgaaggaagagggtgattctcccttatgaccttaaggaacatcaactgcagtagtggaggctgcagttgtctcaccaacatttctcttgcaaaatctggggatatgagagtcatcagtatcctgtggaatctgtcctctgatgtaaggaactcactataaaaagcaaggataggtgagagacagaagtggttgacctagtggatactgtggtgtcataactagatcccttcttcagcgcagacatacctatcccccaaacacttataatatcggggactggtggctaactactgagtgttcaccggaaaatttccaagggaaatgtcttgcccgagataacacctactcctgagggcagccattggctaatgaatgactatttcgtataaacaaggtcctctcctcttgcatcagtttggaacaactctgaagagccacagttctagtcttcccgtaggatcagccaaagtctcatttgccactggattgtgagccagcccctgtctaaatgcagccatgctcagtttctcccacctgtatcccctgagacgattccccaaagaactgtctgcatctaacagagttggagttggaaaagtctttttccaaggatcccaattcaagacctgcctgtgccttttaaaattaatttgtctcctttccacatacacacagttcatcaataatcagtttcccaaatcaggaaggagtggtactggaaaaacaggaaagtgggtcatgtgacagaaacaaaactggcctgagctaccaatattcatttgcaatattcaaccaaggacttcattcaaaaacattattgatactcaaagactactagacttttgaaggaatgcaccagcacaataaaaagaccaaaatgaataaacagaataattactcctccaggaaagagagctaactgggcaagagaagaggaggctaaacattttaattggtattcttgatctaactgtctttctcccaattaccactgatgttgagtagctttttatattcttataggcaatttgtgtgttgtctgcgacttccttatatatactgttgaataacatgttggctatgccatccatatctaattaagccaaagacggttttgcttgtttgtttttgtccttgtttttttttttcttatttaacttcatagctcacttgaattcttcctctctctttctgctgtcttgaaccaaagttcgtttttctaaggactgagttctttgtgtcatcataatataggagtcatttttgactagttttgatgggaagagtggcttctgtgtttgagcatcaactaagaacagtttcccaatgggcagaaacactaattcaggactctctcactgtagttctattaaatgtcctctcctgcctcttctatttgagggccttagtaaataaccattatcgatattagtgtatatgcttcccacgccctaatacattcttcgctagatacacttgagcgcataagtggtgttgagagtttgtgtaggagacaggagaggcatttgtgtatagtgcataggccctggattgttaggcaatgtagaagtagtcatttgggtacaaacaatgcacaaaatagtggtaacgatgaaatattttagatccagttccgaactaggtaataagaaaaaaaattagtatctctagaaaagatggtgtcttacagtgcacctaatctatattttttattcagtattactggagaggccattcataaaatgcagtgatgaagagggcagtctctgcaggctgtttgtctatgtttgaatcccagctttgtcctttgaggaaaatcacttcacttaacagaacctcagttcctcggtctatgagtagctacctacttcctggggtagaagtttggattaaatttataatacccagaacatagaagccactatgtaagggtatatgattgttattttctttaatattgctagcaaagactcagatagactaatattaataaatcagttttgaaagccatttagaataatgtttaattttgttgtaaattaaagggagtgttttaaaattactaatggtaaacttcatggaaatatcatttggttttatttattctgtgagtataaaaaatgttttaaaagtctaacaatgtggccaggcgctgtgactcacgcctgtaatcccagcactttgggaggctgaggtgggtggatcacctgaggtcaaaagttcgagaccagcccggccaacatggcaaaatcctgtctctactaaaagaatacaaaaattagcaaggcgtggtggtgtgtgcctatagtcccagctactcgggaggctgaggcaggagaattgcttgaacccaggaggcggaggttgcagtgaaatgagatcctgccactgcactccagcctgggccacagagtaagactcttatctcaaaaaaaaaaaaaaaaaaaaaaaaaaaaaaaaaaaaatatatatatatatatatatatatatatatatatataaaattatatttgcaaactgcatcattccaattgttatagatagttaaacacatttaagaaatatgttttccacttctttttcttttttttttagacatggtcctgttctgttgcctaggctggagtgcagtggtgtgatctctgctcactgcaacctccgcctcccgggctcagatgattctcccacaccagcctcccaagtacctgggactacaggtgtgcaccactgtgttcagctaattagaaaaaaaaattctagatacagggcgtcactatgttggccaagctgctctcaaactcctggactcatgctatccacccacctcggcctcccaaagtgctgggattacggctgtgagccacagtgcccgaccccagaaatgtgtttcctagtaagattcttgtaggtggacattgtattaaactggttaatattgtcttaatcctttaaggtttactgcagaatagcacaacagagatatgtttttttctatgtttaatagaccattttaaaacaaattttaaatatgactcaatgcttgtgttaggttagatttaaaacaaagtctagatttcaagctgtagttgtaactatactattttacctagtgaattattccatgctctttgtttcacttgtgagaattgtttgaagtgttgctttgaatgtatatatgtttcctcatctatactaacacactatataaagtggttccttatgagaatggtttgcagtgctgctttgaatgtatgtcgtgtacactcttctatactaacacactataaagtagttccttgggacatacatctccattcacttctcatgaagcgttgttgaagcaaaattcaaaggtggtaaactggctattacagacaactgcattcataaaaatttgaaataattggaggaaaacaaccttttcaataaacctaacccttttctcctctggtttctgttttctcttcacttttcaataagcccttcttaccaagagctgctcttggaaatgaaacttcccaaacttctacacattgagttgttttaatctttacctcaaagaccaccttggccacatgtcctttccttaatcattactacttcttgagtcttatatcaaactcaccatcagctggtgaacaaaggaggaaaattttggtagatcctcagggttgagtcaggaactcattattagcattatgctgaaaaaaaaaaggtgacattaacatagccttatttatattgataaagccttgaataagagtaaaattgagatacttttgctgtgatagccaactgagcctaggggctaatggaaaaaaaaggtgaagctagaggaatgatgataattgttttccttgacagctttgtattaagacattttcctataggagatagtgtctctatctgccactagcactgcctacttgattgctctccctctgctctctgattccaaagggattacagtcatcgacaatatcacttatgttgcctattccagtgtctatgtggattaagatatcagtgcagataatgcctatagttctttttttatctcacctaagtagccggtcagccaaagtggcttggtcttgtgatagcctggtcagtggatcgactctctttctctctcccttgatgtctttattagatgtggccaatcagaggcttttaataatatcccaagaattatatgtgggttttagtgggaagtaaagactccacttaagcttctggttcagagtgcatatgaaaattatagttccagatattattccagctaatgatatctttgtgttctgatttcgacttatattgcttgaataatacattcttcaggaaacccattggaatgactgttgataagagaattgggcattcctctgtttatgctctttcagataatgaaaataattaaccttatatttctaagactttatacaagtttttaagtatgaaaatgtctggaattatatcaaaaacctttggttaatgtatgtcaaattttatgtttctgtttaaatatatgtgtggttggtgattgtgttattccttgaggccagaaatgttcatcagtgtctttgtaggaagtaaaagcaaccctgccatatgcatatatttagtttcaataggagaaggaaataatgtctcagtagaataaaattatattccatgtctttcagataacctgtaaggctaattatgaaaagagagcctagttatgcaagccactaaatgcactttcaaaatagcagaaaagttattacttatttaaatattgtgattaatgtataaattaaatataaacaaagggaatgtttattaccagtagtagggcagtagagtacagattcaataagtaatgattgaaagtacagattctgaagctagattgcctgtgttctcattccagagttttcacgtattagatgactaaccctgggcacctttttaaatttatttttattttcacttatttgtccttcaattctgtcacttgtacaatggggataataaaactacctatattacaatgttgtttttaggattcaatgatttaacatatcaaagttcttagaacaataccagggtcatattaactttgttaaattaaatttggcctgagactgcctctgtacttttgagtttccacttaataaactgcatcctaacctagcatgcaaacaaaccaaaacctggataaggagtatattttttgttagagatagccagatctcagccaatcacaagcagctgagcttcagccaattataggcaaccagctgatcagatgatgtccaaataaggcaaatgcctcactgtaaccagtcaagctattctgtactttacttctgtgttctgtctataaatattctccatgtttcagagtggagctctctaaacttcctttggttctgagtgctgctcaattcgtgaattgttctttgctcaagtaaactctgttaaatatattttgtctaaagtttttgttttaacaactttaaatgaacttaagaaaatatcttcttgttattaattccatacctaaaagagacccttttgttgatgattaccctatttttacataaaaatataatagaataaatgaaaattgagaattataattctggaactagactgagaagaaaaagatgactctcatgtggctattgtaaaaagaaaaaaatcaccgactgatcacacagcaagactttttcaaaaattaaactacttattttttaaaaactttgaattatttttaaaatacacagtcatttactgttcactataacttttaatagaaagtgagaaagtgatagagcaacgatgaaaatttattcttaatgccaatgtacagttgactacagcttattctcccctgggcattctaatatattttgtgataagtatggtatcatacaataagcagattctgtgaaaagctattttcatcatttagcaacatacttttctcattttctgtattaataagcactgaccctcagtgtaatttgcagtagctacatgctattatatcacatgtctgtttactgtatttcaaataatagcaagtaaaaaatcttccttttgtttttgttattagaaagagttttttgaagaacatacttaacctatgcctttgcactctcattagatgatttctttagggtacatttctaaaaatggacatgcagagtatatctattttaaagcacttaatatgagttgccaaattgttgtctatttaaatttgcatatttccatcagcagttatttgagaatgtgtgtccaatgtgcacctgtgacagctttggatattattattcttttttatatttgctaaataaaatgtcattgtctctttgatgacagagtatattttagttttgctgtctttaatttcttatattgtaaatttctaacatagtgtggatttttcccttaaaatgtttaaaaatttctatggtttttaggaggttttccaagagaaacagcatcatcttttcatttgttgtttatattgcaatttttttcattcctgttacttaaacgttttcgtttttaagtacattttaaatcttccagttaatctattacttgtactttaaaattttaggtttcattctcaagttaaaatatttctccactcagcaaatgttgctacaatttattgcatatacctagatgtacacgcacactcacacacacattctctatattagatgttaaacctacttacaaatctggaaaaaatgctactcagtttgataaaacacctttttaatatactgctggattttgtgtattattgttatttctctattattattgtgtcaatggtttgtgcatctctgatttgtgcaataattgagcatcttagattggcataaaatttacttatggtactttcagcacctttaggctgaaggtgggttgaaagtcactgcagagtggcagaagtgaactttttggagtgatgtaggtgttctatatattgaggagataatcattgtatggtgtgttaatttgccagaagtgattgtcctgtacattttaaattggtacattttactatatataattcttcaatataattagttttaaaaaatccaaatagaaaacataccactgtttgtgacagtaggtaagcaatactgaaaattcagaaatctttaaatgattatctagttttggcatcaatgtaatactgatcttttataatgagttggggaatttttccaattttatcacattttaaatgctgattagaggaattcagatattcaaaagttgatactgaaaggacaattgataacgtgataccctgtttattgaaattatttacatagtagcaaaattatcctttctttggaataagaagaaaagaaaaatgaatgagatagaaaagaatattttgtgtacaaaactaagaatatttcaatacagtggtttctgcctgacttcctctgtgcaggagcaatattactgcagagtcctgcaggtatgctgagattgttgtattagattaaatacttgaaatcggtccactggacattcagaaagagagtttttagggatagaaaagaggctgattgcgtactgttgaggcccagttgacatgggacactttgggcctcttcttttataataagactttaaagtgcttttccttccctgcactttatacctggatagattgagataatcttggctattaaaagtggtaatattggctgggcaaggtgactcatgcctgtaatcacagtactttggcaggctgaggcaggcggatctcttgaggtcaggaatttgaggccagcctggccaacatggtgaaacctgtctgtactaaaaatatgaaaattaattggtcatggtggtgcatgcgtgtaatctcagctacttcggaggctgaggtgggagaatcactcgaaccggaaggcagaggtttcagttagccaagactgcaccactgcactccagcctgggtgacagaatgagactccatctcaaaaaataaaaataaaaaagtgatattactttgtcatcattcaatcatcatggcttcttaagtgtttactgtgtgccatttacagctctaatacactttgcatgtattaaatagtttgagccttacaaaccactctggtttagttgggagttcaatattattactaattttgtctctgtatactctgggataaaatatagtgcatatttcttatgagatttatattagtattagacaagttttatagtaatatgcaatataattactagactttaggttacgtttactgatttcactagctatctctatcttttaatttctaattttcatttaatctttgaatacgttatttcatcagtttgaaaaaatatttagagcactcaaatggtattaggggtctaaaaagtcatcaatggactgaactcaaaaggccatttcacaagtttacctctcttgtgaaatgtacaaaggctaagagttttttctgttacaaatggttaggtcaataggttataacattatcaatagtgaaagctttaatactcatcaatcaacaggttattacattatcagatgctactaggattctgcaatcatgcttacatttaaaatattttgaacattttcttagaactttgctttagacaaatggtattacagctgcaaaagtctaaactaccttttgcctacccacagatgcagattttcatgaatgatataaaaatgcagaaaataaaaattgaaagatactactattttgttagtgaataacagaaaagaatgtgctagttacataaagagcctgaaggtatttctagtgctgtcagatgacaaaattgacaactgggagctttggtaggacctttgtgttactgatggcttgcctgcatattttgtagtgacacatttttcactgttctacatggctgtataattaacttacattaaataaatgtatgttttttgctagtaacagttgacattgtttattttgttatccagttaccctggatcttattatagctgctcagatgggaagagaaaaatgatcaatgagtctaagtggaaaaggaaaggagagagaaaaagaatgcaaaaaagaaaaactttgtggagttttgaagaacaaaaagttgagaatgcaaatgaatgaataaatagccaaagagatgattaatgtgtttatgttgtatggtacacactccaagagaaaatgtactttgaaagaaaaagaaatctttcaatgattacaaagttggtttaacaaaacactgttcttattgtcaaaataaaaaccataccttctcagctatgcacaccatttggggtataataaataggttcttggcagaaagaactattgatttatcttatttttcccatgactttcatattacacagggggaagcaatcacacagtggatttctggtgggcaagttcaatcatcaagtgttctcaaacctccaccttgcaaataaaatgatagcatatgaagaaaagtaatacatatcaggaaggcagcatgcagggattgagccaatgacattttgattggtttcatttccttttaaataagtctattttatgtatggatgtagtgtgaaatcactcccagggttggcatcaggaggggaggttttcagaatcagaatattattgctattattaaaattcaaatgaaaggaagaattggaaaaatcatcttcataatcaggaagatttgtaaatttttaaatgtaatattttgaatctggtcttaaatatttttcaaataattatatatttatgtttgttacatcattcacagatattaatagcaccattaattttatgaatgaaatgtactttagtgtctaggaaagagcatatgagaatattaagacaatatgtactataatatagacctggaattcctagaatttagggaagagttacaaagtcctaaaaaccctaagacccggagatatgtaaatattaggacacaggggtaggtctaacagcatagtcacagagcatagaaaagtaggggaggtgttgctcatattaacctgtgttgaaagagataaagagacctgaaacaactgtatgttcagatggaagatggccagattgaggagagaagtggatgtggaggaatagcaacacaacaccacactgttgactgtacccagctaccataactggaatcccactattcctggaacaggtcaagtgtggatagtttactgaagtgagaaaggctggtgcaaattgctggtggtacggagatcaagagtcaattttggatatgttaggtttttgagatgtgtattagatagtcaagtggagatgtcaatagaataattaaatataaaaacctgaccaagtgtagtagctcatgcctataatcccagcactttgggagtctgaggtgggcagattgcttgacgccaggagtttgagaccagcatggacaacatagtgaaacctatctctacaaaaaatactaaagttagccaagcatggtgtgtgtgtctggagtcccagctacttgggaggctggggtgggaggatcgcttgagcctgggaggcagatgttgcagtgagctgagatcataccattgcactccagcctgggggatggacgtgaaatcctgtctcaaaaaacaaacaaaacaaaacaaaaacctggcattcagggaagatagaacagaaatatatgaagtggaatataagtggaatttaatgtctggcactagcacagagtaagagatacacacccactgatatggtttagctgtgtccccacccaaatctcatcttgaatcatagctcccataatcctacatgttgtgggagagacctgttgtgaaatagttgaatcatgggggcaggtttttcccatgttgtctcatgatagtgaataagtctcatgagatctgatggttttataaaaggcaattcccctgcacacactgtcttgcctgccaccatgtaagatgtgcctttgctcctccttccccttctgccatgattgtgagtcctccccaggtatgtgggcctgtgagtccattaaacctctttttctttataaattacccattctttggtatttcttcatagcagtatgaaaatagactaatacacccacctcaagtgcagaatttaagatgtggacaccacaacctcaataattacaataataatattttaatgcaataatttaaaaataaaaattattatgaaatcaataattttgaaacaaaaattaatgtaaaaacttttgttgaaactatacaaaattttaaatttctcattcagactagttttgattacttaaagaatgtgtctagacagagaaaagagtaaattctgactacactctgggacatctaaacgtgttattgtaaggaagatgaggataaaacaatgcttggtattgccactggtttaattgttgccaacttgttgggagaaattgtgtttcttgttatttgaatttgcatttctttcataagtaatgtgatagagcattgttttctattaactgactatatattagttgtgacaaagttttcactgacatactataaaattaattttttaatttataatctgtgacctttaacacatgactagattcatgtaaccaccactacaatcaggatatagaacaattccatcacattttgctactctctgccagtgtaattctggcacttccacctcactgaatgtgggtaatcacattttcttgcttctggaaccctcctggtagcttgagcagcaggtccttgcaacagtattaaatcctatattctgcaaaaatgtcccatagtgataaactttcctttacctaaacttttgttctgttccttttggtctagcacactcagaatccagtctcacctatattttcctggctcctaaacatacatgtcgactgaatcctgaattttcttctcctcagaggtccacttctcccttagcttgtgcaacaagtaatgtgacattatttatttatttcaagaggggaggtgagggcataaccttggggtgggggtgcatggtttcatttagtaggtgaggatctccattatcttcaagctatggggcagcactaaacttcaacagggagcagttgcccatttctgctggcacagagcattaagaggaatcttggacttcaagatttttgagtgcatcaacccatatgctcctgtttgccagggtcctgtttttcaagccagggctttgatcttggcatacagacatgacttgtttgggagcttaacctttgttggagctcttctactcttgaatgctatacctttttctaagcttcttctgcttgcctggtaaagaaagtgaaaaaaatttataggctaaaagaaggccttctgactttctctcttagtttttaattgcctactagttctcagtctttagttattgttttccccctgaaagtatcactttcacttgtcaacaagtatccaattccattgctttatggttacaatgcacctgaaatgtgtaatttgccagatacattgcacctgctaatgcagttccttgacctggaataccaattccagttcactatatgtgaaacttttaacacatgcgttgctgcttgatgccaagtttcacatgtattctattatatctactatcagtgatggcttttctagaaaatagtgtcacctaagcaggataggagctgcactgggcagaatattgttcagtttctagggccgtcagccaaagaaaattgcgatggtgatggaaagtattcattgccttctggatgacaagggatccaaaccaaaattttatatatgccacctactttcttgattcacttctggaaccagcttctacaagttgatttctctggaaaatatgcaggaaatatactaggaatacctttgagatcatctcttgtgggagggaaggaagtaaggaaaggacaaagtttagttccaatgcagttccaatgaagaccccagttgttcccagctgtagttagaacagccctccagaattgagtgaggggcagggcctctgtatctcaatatcaatcagtcatatctagaataccctgggaaggcggtatgctcttagacttgacagctttcttctgctgaggctatgctcaaagcaatgtgggaattgagggctgtctgtctcagtgctcccagcaggtgcatccacatcttggtcattcaggaaggaggatctgaatggcaccatacggtgtccacaaccatagccctcagctttttctgttctgctaagtctgtatgccactttttctattcaccctattgctttactcttagtttctaaagtttggtcaatacttacctcttttactattctttttgtttttttggggtttatatcttaaaacaacaacaacaacttttaaggtgtcattttagaggggtgtcaatagtaaagagaacacatgtgttcaatctgctttatgaacctgaactctgaagtagccttctgataaggacagtgtgaaatatactgtttctatttctggcccatgtggtctcagcttccatttcacttgttccatatccaggtacctgtccagaaggcttttctagaaaatagtgtcacctaagtaggataggaactgcactgggcagaatattgtccagtttctagggctgttggccaaagaacattgcaatggtgatggaaaaaatatggcaagctgagacatgaggaatgaatcagaccttaacacaaacacaatactctggaagcctcttcctccttaacttgctgctcacttcacacacacacacacagacacacacttcttaggtggagaaatggatttcaacttatacatgcagagaaacattgttctgctgtttaattatatcctgattgttcatttattctggtagccttgggaaatatttattatatccatattcaattaaaaaatgaaaaagccaaaagaattaccacactgacatttagaaagcatgtccttatcattgttaattttccccgaaagtaatacagttattatgagctacattatttagagtttggcctgaagtctgttataaaaaaaattccacttggatttaggttgcggtgtatcattttgtcaaaaatgtaggtctgttgctgccttcatttggatgagagctcttatctagtttccaatttggtctagcccatttctctatacagctgacacactcactggggatgattctctcaggattttttgtcagtcaaaaatcatctggaaatgaagattcccttaactctgggaggttggagttcattacagaatgaagctatttgattttcttctgaagggaaagaacagataatgatgaacattgtcactcaaaaatatactgtttcaaaatttcaatacctttcactctacagcagagatcattaagtttagtagtaaattggctatttcaacagtatgaatgttctggtgaataaactaaaatcaataggagttaagctatgtgcttaaattcacaaaataatagaaataatagagattggtgtcttattgtttgctaagttagattggatgattgctcacatcctattcatggttcttgtatcactacagccttttctcagcatttttcccccacagtgtctatcacatagacttgcccactttgagtttccgttaagtgttgaagtagggtgtcttgttttcttcctaatattcccaatattatggcccatgtagtctatcatgatcttttggaatttttgtgaactatttttttccttttcaacttttattttagaatcagggggtgtttgtgcaggtttgctacaaaggtatattgcatgatgttaatatttgggacatgactgaactcagaacccagatagcgagcacagtactcaataagtagttgttttcaaaccttaccttcctccttcctccctcttgtattccccagtgtttattgacccatctttatgtccatgtatccccagtgttttgctcccacttataagtgaggacttgcagtatttggttttctgtttctgtgatattttgcttaggataatgatttccagctgtatccatgttactgtaaaggatataatttcattcttattttgtgtctacatagtattgcatggtgcatatgtaccagttttgattttccaatccagagttgatgggtgcctaggttgatttcatgtctttcctattgtgaatagtgctgcaatgaacatatgggtgcatgtgtctttttggtagaatgacttattttcctttgggtatacacccgtagggaactgctgggttgaatgatagttcaactcatttctttgagaaatctccaaactacactccacagtggctgagctggtttacattcccaccaacagtgtatgtgttccctttctcttcagtcttgctataccctgcaaagccacaggggcagagctgcccaaggctgtgggagcccacctcttgcatcagtgtgacctggatgtgagacatggagtcaaaggagatcattttggagctttaagatttgactgccttgctgggtttcagacttgcatggggcttgtagccccttctggctgtatttacccaatgcctgtatccccatggtgtctaggaagtaactaacttgcttttgattttacaggctcataggtcaaagggacttgccttgtctcagatgagacttgggactatggacttttgagttaatgctgaaatgaattgagactttgggggacggttgggaaggcatgattggttttgaaatgtgaagatatgagatttgggaggtgccaggagcagaaagatatggtttggctctgtgtccccatccaaatctcatcttgtagctcccagaattcccacgtattgtgggagatgactgaattatggggatgggtctttcctgtgctgttctcatgatagtgaatgggtctaatgagatctgagggttttaaaaatgggagttgccctgaacaagctctttttttgcctgccgctatccgtgtaagacgtgacttgctcctccttgccttccatcatgagtgtgaggcctccccagtcatgtggaactgtgagtccaaataaatgtctttcttttgtaaattgcccagtcttgggtatgtctttatcagcagcatgaaaacacttgccaacatttgttatttttttacttttcaacaaaagtcattctgactggtgtgagatggtatctcattgtagttctgatttgcatttgtctgatgatgaacattttttcatacgtgtgttggtcacttatatgtcaacttttgagatgtgtccatgttccttgctcactttttcatcgagttatttgttttttgtttgttaagttccttacagattcaggatgttagacctttgtcagatccatagggtgcaaatattttacaaacagtaaaagttgcctgtttactttcttgatagtttctcttagtgtgcagaaattctttaattaggtcccacttgtcaatttttgtttcaattgcttttgaggacttagccataaattctttgccaaggtcaatttcaagaagggcatttcccgttttttgttttgttttgtattttttttctaaaatttttatggtttgaggtcttaagtcttgaattcatcttgagtttatttttgtacatagtgataggtggggaaccagtttccttcttctgcatatgaatagctggttatcccagcaccatttattaaatagggagtcttttccccattccttatttttgtggaccctgttaaagagcagatggttgtaggtgtgtaactttatttctgggttctttattctgttccatgggcctatgtgtctgtttttgtatcagtatcatgctgttttggttactgtagccttgtagtatagtttgaagtcaagtaatgtgatacctctggctttgttctttttgcttaggattgctttggccatttcaactttttttggttccatatgaattttagaatagttacctagggatagcattgaatctgtaaattgatttggggagtatggccatttcaatgatattgatttttccaattcataagcatggaatgtttttccatttgtttgtgctgtctctgatttatttcagcagtgttttgtagttcttgttgtagagatctttcaccgtcttggttagctgtattcctaggtattttactcattttgtggctattgtaaatgagatttcattcttgacttagctctcagtttgaaagttattgtcatatagaaatgctgttgatttttgtacattgattttgtaccctaaaactttactgaagtcatttatcagctctagcagcctttcggtggaatctttagggttttctaagtatagaatctcatcatcaacaaagataaatagcctaacttcctcttttgctatttggatactttttctttctttctgttgcctgattattctgtctgggacttgagtattatgttgaataggagtgatgagagtgagcattcttgtcttgttccagttctcaagaggaatgcttcaagcttttgcccagtgactatgatgtttgctgtgtttgccatattattttcaataatacgtattattttgatatattgaacatgtttttaggttcattgacacccattctttactctcaaaccattcaccagtaatgaaatacacagcttctagtttttaacacctataacactagttcaagtccccatattatgagttcattgtactctgtgctttatataacttttggaacccttttttaaaattcaacagcacttctctcaattaataattatgtttcataacacaattgatttgattatttgattaattttattcttcccatatctaaactgcaaattccatgaaggtaggtttatatctgtttgcaaaactgcagtactttctgtacctagcatattttagagtatacagaaggtgtgcagtatacttcttttgtataaatgaaggatccactttgctttgttttctttcatataggttttggtaacaccacttatacttttggaatttagactccaagattttttatattcttcattgtttattatttcttcagcacttataactaattatttataattatagctttatttttttactacattttacattctgtatcctcaaaatctttgagaatgtggttcaatgattagaagagacaatattcccttagaaacagaacatagattcaattaatattgccacttttttgtattgtttggggtcggagtaggcaaggaaagtaggaacaaaatctctgtggtgttggaagcctgtcatctttttgtatgtatatcaaaacactaataaggacaacaattttttagtatgacttctgtgccaagaactgtgctagttactttgcatattatgttttatctaattcaaaaataacccagagtttgatgctttcactcacattttacaaatgacacaatttgtctaagtccacacatctaagaagtgagattcagatcatgctctatataccatagtaattcaacaattcattacataccatgaagcaattttccaaagttatatttatgtaaaaactacacaaatctctgtgataaaaatcagtacaatcagtaggatagtaagtgacatctattttgccagtatatacaaatcaaatgttttccttttctaggttttattttatttcttgttgctgctatttcttccagctctctgaggactatggaatataaggttcaattttaaaaaaataaaaaaaaacaaggtttactatgtgagtttacttacacatttcttcatgtcttggctttataaaccacttattgtaaaagcttcttctcaagggagcatgaggatttatggatttatttttcagcatttctactaaaagtgtttattgcacagctaaataagaaagtgaacttttactttggcagaggctttattgccactcaaaagaaagcttttagagaggaactatattgtatttgggtggatcacaggtacttaatatgttttgttaaagttttaagagtctgttcagaaaagagatgaaaaatatcaaagacaatagaaataaaattatgagactatacccttacactgaaattctggactcagtatttatatgtgtgtgtgtgtgtatatatatacacacacatatatatatacacatatacacatacatatatatgtaattgaaattattaaatctttcattcattcattcaacaagtatttattgtccgccatgtggtagaaactgtctcaggtgatggacatatgatggtgacccacacggctcctgtcttcatgaagcatctgttcaattaggagaatttaacaatgaaaatgtgtatacataaatgcatatatatacacacacatatagtaactaaggccatgaaaattaagtatttggtgataaagaattatagaaatacaccgggtgcagcagctcacttcctagctacttgggaagttaggtgaggagatcacttgagcctaggagttcgatgcctagcctgggcaatatagtgaaattccatctctaaaaaacattaaaaaaaggaattacagatagaatctacttgatttagagtagaaagagaatgcagtttcagttaaaccagatgaaaaatgaaaaactaatcaggggaggatctcaaaaaaatcccgggtattattaaaacaaaataaaaaaccggacagcagacacaaatgatgtattggagactgtcaccttgcaggaagggagagtgcgactagtatcttctgaaaaagaggaacagtggcacatgttggggttgttaaagttgatatggttcaagttctgaggtctagaatagcaaaataagaattccatttttattcaagtacactgtgaagttactgaagtgttttaagcaaagtaattacatgatctgatttatattttacaaaaattgctcttattgctaaaatgaaatggaaaggagaggaaagcaaatacataaagggcagaactttccagtagaatgttgatggatggtgccagtgaaggagataattggatgaaatggagtcagaaggagcacagttctatgaaaacaatggactagatccaaaattacagaattctaggcaatgcagcctgagtaagtggcattagcgtgaagagatgttactagtgccttttagaaaacattaagtgggctattactcaagttctcttttgttattctagtgctaattaccccattaatggttgatacagacagcctcccctctcccactctttctctctctctctctctctctctctctctgtttcttcttttaacacttttggttctgcgcccatgacaattgacattttgaactaagaagaaataataatttctatcattcatttttgtaactgtgctttatagatgatttcagacaatgacatggagacaaataaagctttaattaataacaattattcttcctatttctaattttcatatttaaagaataaagaaagaaataaaaaggcaaaagctaactgtttgcattttagttatagtggaagataatgagatactaaggtattttaggttggtattatggaaataggatacatatgcacctaagcctttcttgttcatttagtatactttagaattaaaggaaatttgttgcatttagttgaatttcatgtacctttgaatttcactttgacctaggtagagatattttaaaataaaatataagcaattaacatatttttttctaaaatctgtgcttgttttcataaatctcagttctgctacagatgcttagttggtgtttctggagactcttttcatgtagaataggtttagtcttcactttctgcaatgctattggcatggcattgcatgaaatccaaaaagagtgtagttataaacacatttggcttttccatcaaagggtgatattttcccttcaagagtatgttttgcgctttttatctgggcctgatttaatggctatgtggtaaatattgtgagattacttctcccagttaaaaaacaacaacaacaacaaaaactcaataggatatgatactgttttcaattttctgctttataatccattttaaaaacctgaaagataggaaagttatgaaatgttcataattcattttgttgtgttacttagagaaagtagtaacatatcccagatctgaattctaatgcaacagcagaagtttattggccctgactgatacaaagcaatggccatcatttttgacctatcggccatcattgcaaaatgatgtttaagaattcctaatttgttatatgtaacttttgagtcatagtgaattcataaaacagtgttttataaacactcctaaatgactatcttgctatagatgattacattggtagaatatgaaatgtgattttaatctttttgattcccagttaaaagatcaaatctgaccttgttggccaggcatggtggctcacacctgtgatcctagcactttgggaggccaaggtaggcagatcacttgagcccaggagttcaagaccatcttgggtaacatagtttagacctcgtctctacaaaaaataaaaaaaaattatctgggcgtggtggcacacatctgtaatcacagccactagggaggctgaggtaggaggatcacttgagcttgggagattgaggccacattgagctgtgaccacaccactgcactccagcgtgagtgacacagtgagaccctgtctcaaaacaacaaaacaaaacaaaacaaaacaaaacaaaacaaaacacgtataaccttgcctaggaatggaaagaataaacattttgtaccttatgggcttagtttattatctatgttgagtggtaaaactaagtactttaaactttttgcaatcaaccatcctaacatgaattagatgttattatctattcactatgttctatttggccagttgatttgcatctgttaatctatcattccgatttttaggaaactttgatttttttcaattaatgtcgtgtgtcatatatatatataatagcctatacataacacaaatgtttacattaaatagcaaagctaaaagtgaactcaccacttagattaagaattccactagggttttaaatagaatttagcaagtttaatgaaaaacaaagggccaaaaataataataaattgcctaaaaaggaaaatagactgagaggtattagccatcatagataacaatatattttgtaaaagtataatgattaagacaaagtggtatggaaacaataaaagaccatgttatcttctactcttagtttaaaagtttaatacatttagaattttatcaaatgttttgtataatgaaatgattgtacacatataaatatacaattagtaataatatggtgaattaatacacttccaaatgctgaatcaattttgcattcctggaataatttgaatttgatagtgattcattaacttgaaaacattgttggattttatttgctaatattatagatttcttattattttgcatttgtgtttgaaatggtgttaccatttctagcaccattagtctggttgtggtataaatattacattaaccttgtgattggaaaatcctttatcttttctattccctgaaagatttgcatgagatttttttctcccctgaatgtttggtagaaattacctataaaactcttggtacccacgttcatatgctccaggatctctgggaccttgaacatcatttgggttcttcttggttccttggtgacacttgtctgccacacactcagcctcacaaacgtccttcatggaaaagtttatgaaggcaggtacgcatcaaagggctgtatctcccccagagaacacaggagatagcaaagaccaggaaatgttgcaagaggaaacagatgtcagtagaaaagtgaggcatttctcagaggaaagacaggatggctgccgtgattccacgagagaaagtgctgttttctaatacaaagcaatctctatcactcctccggagaatgtagctgttgctcccggcaaaaaggcagaatcctcatttgcaatgaggccattctagcccaaatcactttctctctaatccctttttatcttttttgtttgtttgtttcatttccttcatttctatcttttatgtctcttactatgctttcctggaataactattcccacaagagcaccttgtaatttagctttcattcggagatgttttgtctttttctttagttctttcatgagttctgctagtttccactgtatattatctaactgttgagttatagctccaagtgttttagccatattttctaagtgctttcttatttttgctttgtgatgtctccttgtagatgctgtggctgtgcacctgtttaatatatactattggaagtgtttggaaatatgcataaacccataataccatcaccataatcaagatgataaacatactcatcacctcaattttcttgtgtctattcgtgtcttgtgtgcgtgtgcatgtgtgtgtaagaacactttacatgagatgtaccctcttaaactgtaaagtgtgcaatgccatactgttaactagaggcactgtatcgtacagcagatctcttttaaatttagactgaaatgtgacattacagtcttctgtttgtgatgacatttttagggtgagtcttctttggctcttaagctttgctgtattttttttcagtaaagtgtctttgtacaattggtatagttttatttatttgttttttgttatcaacgttttagtgaattggattttctagactagctgttagcagaaggatctctgtaaggcagggaggagttaaagcactgtactagtctcctagggctgtcgtaacaaagtaccgcaaacttggtggcctcaaacagcagaaatgtgttgtctcacagttctagaggctaaaagtcagaagtcaaggtgtcagcagtgccatcttctctctgagtgttctaggggaggaattcttccctgcctcttctattctgatagttgccattaatctgtggcattccttggccagtgtatgcatcactcccatctctgcctccatcttcacatgtggccctctctactgcttgactctgtctctatgttcaaaattccctcttatatggagactagtcagattggatttcaggaccattctaattcagtatgacttcatcttaacttgatgacatctgcaagactctttttaaaaataaggtcagattcacatttctgggcagttacgacttcagaatagttaggcaaggattggggagagtgtggtacagtttaatccatagcaagttctttcctggttcctctgctcaagggatacctcttccattgataaagtgattaacaattactttaatattgttgccttttgtgggcagatttcctctgattctacagtcttatgttgcttcagggggtgcttctaccaattgtttttatctttgactgctgcaccttacagatattgcctgtgtattccaaggcaagttcttctctgttagaacagatggtcttttatctgtcaccttgtcctctgtgcactttccatgttttgttttccccaatgtcctaaggcttcttcctatcctcattgtttccagatctcaaatggtattgagagagggagacttttttttggtgggggtgggttgggggtcgtttttgcggatgttttgtgattttctcaataggataactcagaattcctagttcttttgttgttgtgattttgtctgctcccttgctacccctttgagctttcccatgacatttctgctgctttttgttgtttaccattaatttgcacataaagttttttctatctagtttcattgaatttattatatataggtagatatttattaagttcccatagttttctgtacagatttgctttctcccccacccccgccctccggccagttttgctttgagaaatcatctattggcctaatcattgtcctacttcctttttgttttggtcatatttaagtacattctagcgatctatatttttaccaaatgcatgtaggtgtttatctatcaatcattttaatttggggagagatttattgaattttctgtctaagaactcatgtcttttatcagttctcaaaagttcttagccactattcctttagacactaagggatcagaagaaagaacctgtaatcacaaagtacaactcacacccattttattcatgctcttttactgttcctttgattgagtattagtctttcttactctctcctctgtgtttcttaactccccctttttccataatttctatttgtgacacattctgggttattccttcagcttgatcttctactttacgaattctctccttggcctctttgaatctactactaaatatcttcattcagtatcaaattgcaactgttttatattttattcccaaaattatataggttttattcaaatatttatggtcaaattttgcagttttctgttcttttcttatttatttaattttccaatgtaatgttttaacatcataaacattattttatattatttgtttgatacaaaattattaattacaaaatctgctatattttgaggcttaagttataatgtttgttatttttcctaatatttcaaggtatattttctgtttagtgttttgcagtttctcattatgagctaatgtgcctttaaatattgtaaaactctggatgactatttgaaatctatgtttaaattacagttttatcaaagagtaattttatttgctttttccagatgcccaggtacacatttttggctatgtttttgctggtggtgatcatggaggtggcttttgtttctttcagccataaggctagtgagaattttttctcctaattaaagtaaatctggaggcatcatgctacctgacttcaaactatactacaaggctacagtaaccaaaacagcatggtaccggtaccaaaacagagatatagatcaatggaacagaacagagccctcagaaataacaccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatggattaaatacttaaacgttagacctaaaaccataaaaaccgtagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaatttttgcaacctactcatctgacaaaggactaatatccagaatctacaatgaattcaaacaaatttacaagaaaaaaacaaacaaccccatcaaaaagtgggcgaaagacatgaacagacacttctcaaaagaagacatttatgcagccaaaaaacacatgaaaaaatgctcaccatcactggccatcagagaaatgcaaatcaaaaccacaatgagataccatctcacaccagttagaatggcagtcattaaaaagtctggaaacaacaggtgctggagaggatgtggagaaataggaacacttttacactgttggtgggactgtaaactagttcaaccattgtggaagtcagtgtggcgattcctcagggatctagaatagaaataccatttgacccagccatcccattactgggtatatatacccaaaggactataaatcatgctgctataaagacacatgcacacatacgtttattgtggcattattcacaatagcaaagacttagaaccaacccaaatgtccaacaatgatagactggattaagaaaatgtggcacatatacaccatggaatactatgcagccataaaaaatgatgagttcacatcctttgtagggacatggatgaaattggaaatcatcattcttagtaaactatcgcaagaacaaaaaaccaaacaccgcatattctcactcataggtgggaattgaacaatgagaatacatggacacaggaaggggaacatcacacaccggggcctgttgtggggtggggggaggggggagggatagctttaggagatatacctaatgctaaatggcgagttactgggtgcagcacaccagcatggcacatgtatacatatgtaactaacctgcacattgtgcacatgtaccctaaaacttaaagtataataaaaaaaaaaataaaaaaaaaagttgggcttgtgtttaaggattctcggggaaaaattatttttaagtctctctccagagccaatgctgatggtttgcaatatccccataatcttctgccaaaaagtggatttttcctagtttatccactaagtttgtcacctttagttatcctgctttatgtactggttcatggatcaaagatttaaatttggacttaccctaggctttttcttctgatccccttaaatgacccatgaaaagctgttatggactgaattgggtccccctcaaactcatgtgttgaaacccccaatgtgagtgtatttggagatcagtaggccttcaaagaggtaattaaggttaaatgagatcataagtcctaatgcaatgggactgatatccttttaaagaggaagagataccagagatcctaatctgtttctttgcacatgtgcacaaagggaagaccattggatgacatagcaagaagacgctgtctataagccaataagggaagcttcaccagaaaccaaccccaccaggaccttgatcttggacttctgccttccaaaactgtgagaaataaaattctcttttttaagccacccagtctgtggtattttgttatggcagcctgagcaggctaatacaaagctcaagctctaggcaattatgactgtttagatgttccagggaaacatcaagaatctaggatggtgaataaaatctctagattcattcttctcctatttttttccatggtgcagaagatttatttgactacggcactaatctaaccttatgttttgaaatattttaaaaatattttgttcagcagttttgttcagtaagtgttctatacttcaagggtttctttgaatagaaatgtcaccctactgctggaaactaaattccatttcatttatttttatttacatactatcattttaattttggcacttcaaaaaacttattattattttggtgaaatgaaggcagtgtaaaatgtgtaaaacatcatgttcaagccatgcttcttcacttacattttatatgttctctttaagaaactttaaatacataatggaaaaagatgggatacattacgggaggccgaggtgggcagatcacttgaggtcaggagtttgagaccagcctggccaacatgatgaaatcctgtctccactaaaaatacacaaattttgtattgtattgagtgcttgtaatccaagctactcaggaggttgaggcaggagaattgcttgaaccctggaggtggaggttgtggtgagccaaggttgcgccactgcacactctagccttggcaataaagcaagactccatctcaaaaaaaaaaaaaaaaagtgggataggtgttacacccatattgtcagtaagaatatgggagagtaagaaagaaagcaactagatcaaagattcatagcaaatcacttggtggtggtcaaattataaatttctgctcttcccactgctatatgagtgtcctgtcatctcactatggacaattttaaggctgattcattctgtatggactttgtatctgacattttttctgtatcagatattgcagcaaaacttttctgctattcaaaaccatctacaaaacctactctgtgcttctaggagtttcattatttcagagacctagcactgaggtgggtgtgttctaatgtctgggggaaaagcaagaagtttgataattgctgtcagctttcttatttcctgtcttagaaattgagaatactgatttgtctgggatttttgcccgcatcaagtttctttctgcatccttttctttcttgttctcattttttatatacttttgctccaacagatgaatctgttgtaaaaagtactaattttttaactatgagttcagaggttatatttaaactattttaataatgtattataaataatttcacatataaagtgatataaaacaaatactgatctattaaatagccatctaaagaaattaaacatcaaaatacaaaagagaaatcgaagagaactgaattctgctctaattgacactaaaataaagataactaaataaaaaattcacgatgacctttgaaagtatggcagacagacagtgggaaataagtcactttagtttccagcccaaattaaagggtcacagaacactggaattcgctgtggtcattaaaccgctgcaaattatggctcttcaaggaaagcacacatcaaagtcatcttctcatgcttttaaagaaatgctggtttatgaactattattaacattaaatggcaagtcagtgtaggtcacagtaaggtacagaactataaaacctcaaacagcggttttctattttgtgtttttaaagtatttgacagttactttatggattggtgctttaagcagcttttatgcctacatagatttaaaagggaggttatggaacgagcatatgtgactgtgacattcaaagtgaatatatatcagagacacagagacgcccaaagctcttgtcatagggcatatagagaacatgcatcaaagggccctatgtacatccatgcaaaaggccaagttaatttttacacttaaaggcaggttctaaggctaatagcacttccaaggatactaagattttgccttcctcttgcattttcctttgccttggaaaatggaaagataacttcaaattaatttatttctttactttgcttatttatgatacctttccttaaattgtgaaggtcttttgtctatagtatccgtcttagcatgattcccagcactatctttatgcaactaggttattggttggttttagttgctgtactttaaaaaacccaggaattttagaagaaatctttggtacttaattaaaaaaaacgaagggggctctttttgtcaaaattctcctcatttatctctctaccattactctcaatcctgttgaaaccattctccacgtcaccataactatggatttgattatgttatccattttttaaaaaactattatttactgtcacgataagataaagtatctgtttatttatttttctgtaaaccacttccttcagatatgattgacatacacaaagctgtacatttttaatctgtagacctcagcgagcatggagatgagtgtacacccatggaactgttaccacaatctatattataaacctatccatcacctccaaaagttgcctctcaccctcttattattatttaatgataaggacagttgatataaagaatgatcctcatagcaagtttttaagtatacaaaacagtattattaactatagccactatgctgtactggagatctctaggtcctatttatcccatataataagaaactgtatcatctaactaatatctcctcgtgtccctctctcctctgccactggcaaacaccatttcactctatttctatgagattgactattttagatttatcacgtaagtggtatcatgtagtatttatccttttgtgtctcccttatttcatttggcacaatgtcctccaggttcatctatgttgtcacaaatggcagaatatgcttatttttcaaggctgaataatttccattgcacgtatatgccatattttctttatatattcatgcaacagtgagaacttaggttgcttacattcatttctttggtgaccaaagcttcacatgatcagattctaacatttagtttcccttctgtttccatgggttctgcatctatggattcaaccaagagtggataaaaacatttgggaaaaaaaggatagttgcatctacactgaacatgcacagactatttttcttatcattattttctaaacaatactgtaaaacaactatttacataacattaatgttatattaggtattataagtaatctagaaatgatttaaagtatacaagaggatatgcataggttacatgcaaagactacaccattttatataaaagacttgagcatctgtggattttagtatcatgatctcagaggggaggtaatttcatggtgtgtcctggaagcaatctcccatggatactgaggaatgagtgcttacaggaggggtcttcaaaaagtatatggaagatgcttattatgaaatatccatgcataaatttcaacttttttgcaccaaaatttgcactaacttgttataacatgtatgaacaggatgtagtttgaggcattaagaaggataaaacatcagtttgaaaagagaccttatcagagcagcatgaattttgctaaaattgaagcaaaaaaaaaatcatcaaatttatggtgaagcttgggtggaggaatggtgaaatcattgatgttttatgaaaagttaatagggacaaagccccaaagaaatcagcagcttacaaatagataactcattttaagaagagatgagatgatgttgaagatgaagcccatagcagcagactatccacatcaatttttgaggacaaaaattaacgtcattagtgtcctaaatgaagagaacaaatgattaacagcagaaacaatagccaacaccatcaacatctcaatgtgttcagcttacacaatttttatggaaaaattaaaggtgaggaaactttccactcgatgattacaaaaccattctgcccagatcaactgcagacaagagcagagctttcaatggaaattttaaacaagtgagatcaagattctgaagcattttttcaaagaattgtaactggagataaaactcctgctgactttaccagtatgatcctgaaaacaaagcaccctcaaagcaatggtaagtaatgtgacagccaggtgggaggagatccctgaaaaaagtccaactgacttggacactgggaagagtgcacatgggatgcagccacagaagtccgtgccatttgcagcagggagaagagcctggtcctcctcttcctgtgcaaaaccagagattcaaactgcaaggcaggaagcactatagcagggactctgtccttttggagagtccctgtttcccccttgtattccttttcacccaataaaaccctgctttactcatccttcaaactgtctgcaagcctaaattttcatggctgtggaacaaggaccccgtctttagctgaactaaggaaaagttctgtaacatttttggcacccaacatgaggctcaagaagtggtgagtgaaatggggatgcaaaactcctcactgtggtttctaacccttttcatcctcagacttctgatcttatgggaaactacactcaaaccccccgtcactcccagaagttgggggccttttcatgcccttttctttccttttttgagatggactggtgagcagctgctcaccacttcctcctccctggtggggttgggacgcatggcccaagggtcctgcacagctggctagctggttcccagccatgcgccactgcatcctccctctttccctgcgaagggtttcagcttcatctgatagtaattaaacttttttccctggtgtaagaaccagttgcataagaataataggttcttctctcaggaatccttttccttaccccatcagcaggtaacttttaacgttctttccttttagaaaatgctttactagaacaggcacccctaactatcactgtttatattttctgcaaagttttggttgtgaaatcaggccatcttgtttacatcctgggggcatggcttgtaactctggtggcaaggttttgtttagcagtcctgccttagagaataggttcctttctggtttgatatctgcatgttttcctagacctgtctcctaaagaaccccaccaggaaactgggttttctcctgcctgtctctgtgtgtgtgtgtgtgtgtgtgtgtgtgtgtgtgtgtgtgtgtgtgtgtgtgtgatgttgtaaaaaggactctaattgattcggcctaaagaaaaacaactacttggattaaatatttttaagggaagacaaaagcttttgtacctttcagttcacatgactttaatatttaagaaataaaaacaaccttaaaaattattggtaaaaggcaagtgtcattaaaatgtaaataggtgggatgaataatgcaggtcagatgcaagatttactaaatgttttaaggttaaaaactgctttttgggttttgaaagctatttgacttcacaattggtaagacctggggacatatggaactaaccacacccttaattaagaaggcaaattttggccgcagttagcatacaattaaagcaacttaccaggttttaccttaaagttaacaattgctaggagttaccattacaatgtgtagttaaaactactgaaattagatttacatgtaaggtgtgtaagaacagtaaaatgtgttttcttttcttttttttttgtaaaaggttataagaaggcatggaaatgtaaattttcgcctagggttaaacaattattttaaactagataagataaacctgaaggttcaaactagtggtaggaggattgtggagattaatcttgaagaagaggttctctgtgtgaacatattgactaaattcaaaaaggcattatgtagtttttctgtaaattgagcattaaaataaaaacacaacaaggttttcttaaggttgttaagttattgttaaccatggagataaccaaacttcgtcaatcgtgtttctaactgtaactatgctggacattttgctatttatggacaattgttttcttagttttaatccttttcaaaagatggtttataatgagctataggactctgacaggtgctcttaaattcaatttctgattgtatatgggacaatcaggtttttgataaccttagagattgtaatattggaataaaggaaaatgtacaggactcataaagagctaaaatgttcatgaatttcaagcaaaacaagagttaactaaatggactgaacccagaaagctgaagcaaactttttgacttttgctcagaatattgctgatccttgttttgtttttcagagtcaaggaaactttattttgaactatttacagcttttaataattaagcaaggtatactcctgtaatcaaaatttggagtagtttgtttctctctgcctggttcctctagaatttgggaactatttgtgagtattcttaacttatggcaatatagttgtttgcataattgcagtaagaatccatttttcttttgcaacaggacacagttggaaaaaatggttattttaccaaggccttgactggaaggctatgcttccctttaggaaatcaagctcaacttgcagagccaataaaagcccagtggggagactggcctcatacccttgcctacacagtccctgtacagggtttctgacctatggtgagtaaagaatgtcactttctaacaggtccaggatcttaaagtttatcttgggactttaagaggaaaggatcacccacctcacaggtatttgaggatacaaacccatggccaggcttggctttaaaaggtcttatctaagactccctgtggaacaaacttccataaaagccaatccaaaaggcctatgtagaaataattattcttgctgtactttatgcaaataattaggccaagtataagactaaagtctcttttacaaacaattcagtcctatcatttttttttttttttttacaaaaatgaggactggagagagagaaattatgtttcaaaacttcatcagttgtttttatttttatgtttttgcctacatcttagactaaccctgcttgttcctgtgaaccaaccagcaatttccagctgcagtccagaaaaaacaagaggggtgggtaatgtaaaaaattttgatcgatagtctagttctgagtaattatcctgtgaatcctgccaggtgatgggaataaataggatgcccatcactcagaggtttccttttgggaaagtaagaccaagggagctaaccaaagccaagcaccaggcacccaaatcctagcaagcatgactatagccaccagttatctgggtgtgtcacaagacatcttcccgttttggaggaggactcaattcaacagtttcaccttagcatttgccttatgataaggagtccatgcaaccccccgagacacatttttgtcccaaactcaattccaagcttcgggtaaaagccctaggaaggaaagctggatcaaagggatccagaggcagacaacagaagttaaaaggcacagcgcaggtgaacatggctaattcctgccaattaagccaagcccaagcttcctgttttagggataaatgccatgctagtatccatggcataaatgagttctagggaattcaaggctactgacaacaggggagatagggcgtacatgggtaagagcagatgattcctacccccatacctccctgattcatcggtgtaagccactttgacactcaaggggggacatgccaaggtcaccagaactcgaggatggaaggatggaagagggaaagaggacactcttccttctctccctcacattcccagggtatctactaggaagaaatgagaaactgggatgcctgctctcctctttctagatgggtagccattcatcttcagtctccacccatttcaaatgcatcctgaacccctggagctcctttgaaaaacaccttctttttcctctctcctcctgtcctctctcctcctgtcctctcttcactgataggtaattgtgtctccatactacaggttactccactcagatgtatccttcaaactagaaagaactaatttcccaaaccttaaactggttggtttaagattgggttcagaggtgctgggcatggtggctcacgcctgtaatcccagcactttgggaggccgaggcaggtggatcacgaggtctggagttcaagaccagcctggccaacatggtaaaaccccgtctctactaaagatacaaaaattagctgatcatggtggtacatgcttgtaatcccagctattcaagaggctgaagcagaagaatcgcttgcacccaggagttggaggtagcagtgagccaagatcgcaccattgcactccagcctgggtgacagggcgagactccatctcaaaaaaaaaaaaaagaaaagaaaagaaaagaaaaaaggaaagaaaaaaagaaaaaaaaaagattgggctcaggggaagggaatccagaagcccaacatgccagcaaaagagtaaagttattttgcctgtcaggttttggcctccctttccctgtgcaaactggtaaaaggcctcaggatttttgagctgccattaccctttcccgtttgacacatgttttgacacgtttcctaataacgcggtttgtctgttcttgccttcaggccatcaaactccaatggtcatgcaactggagactctgacaatggcctcttctgctgggaacccttagatagacctctgagggagctctggctgccgtttctccactgtcagcaagaagcagttaagatcagtcttcatccttatccttattctagtggccaattagatgtacttcgttagagtggggaatgagacagccacgtgggagggatccctggcaaaactccaactgacttccacactgggaagagtaggcacactggggtggaaccatagaagttcctgccgattgcagcagaaaggagctgcaatcatgtgtgggacgtgggattccaactgcgaggcaggaagcactctagcagggactctgtccttttgtagagtccctgttaccccctgttcttccttttcacccagtgaaaccctgcttttcaagctcttcacaccgcctgtgagcctaaactttcatggccgtgggacaaggagcccatctttagctaagctcaggaagagtcctgcaacattaagacgtggaagtggtcctgtgaaagcaaaagtggaccagtcaagagcaaagatcgaggcaagttttttgagggattttttgagggttgctcaagacattttgcttgtcaactttctgaaggaccaagaatgataacatctgcttattatgagagtgttttgagaaagttagccaaacctttagcagaaaaattgggaaagcttcactagcgagttttttgcttgtttgtttggtttttttgagatcgagtctcactctgtcacccaggctggagtataatcaccccatttccgctcactgcaacccctgcatcccaggttcaagccattctcctgcctcaccctcctgattagctgggattacagacgtgtgccaccatgcctggctaatttttgtatttttgtagagatgagtttcaccatgttggccaggctggtctggaactcctgacttcaggtgattcacccacctcggcctcccaaagtgctgagattacaggcatgagccactgtgtctggccaagagagtcctttactacaacaatgctcctgctcattcctctcatcaaacaaaggcaattttaagagcattttgatgggaaattgttaggcatttatcttacagtcgtgatgtggctccttgtgacttctttttgtttcctaatcttaaaatagcctgtaagtggcatcaattttacttcagttaaaaatttaaaaggactgcattgacatggtgaaattcccaggaccctcagttccttaggtaaggactacatggctggcatcatcacttacaaattcacacatgtcttgaacttgatgaagcttatgttgagaagtaaagcttatatttttatgttttaattcaatttttccacaaactttttgaagtcctcttgtatttctagcgtgtccccttttccttctcacatctttctctcccatattatagcaactttgagcttcctatcatctctgaattaagagttcttattagggagctatgctatttctgttatttggaggacctttccttaatccctctttgcttagaaaactcttactcatccattcatatagctttaccgtgaaaacttttatgattctccagtatggggaattagagaacactgtgcactttgcttccctacaatgctttcttcaaaacatcataattggccttttcctggttttatattacgtattacctgccactttgcttgtctcatttcccatcttataaatgcccttaagacaggactcacatctttttttttttttgagaaggactcacatgttaattacattttctagcatactcttcagcacacactagcaacacaatgcatgcttgatgactgaattataatcattgattacttcaccccataaaataacagatgaagaaatatagaaagacagctgtacacatatagagcaatcaagtcaattatatatttattcattagaagattctgttgttaactgttaataatcattttcaccagtcaattggaaagtctatgtcagcagaactaacagaaatgttatttttaattctcagctatctttctcctagtcaatttagtcatttagcaaatgtcaagacctttttttaaatattcatcatttttagggttaagcaatttggcatctatgcagtcctttttcccataaccttgttaccaagtgataaattacaatgagagagagccctcaatctaattctgccataccaaaaatgtgttactataatatgttaacaagtgggcacaaacacagtcagacactgaagtatagggagattccattctgcgcctcaggcattccaactaatcccttgcacagaaagtgcaggaaggtaggcatgactactgtctagtggccagagtccatacttataaatgaatctgacgattggacctccatcgattggagggatgcagggactctgaatgtagaaggctacaaatgatggtcttaaaacctccatgtttgctggacttttatttcattccatgggtgaaaagtaatcatgcctgacagtgttaatttctgctgaaagcaaactttatgctatttaacactcctactctctggagtttctgattgggcttcttcaaatattaactgacatttgcagccaaacaccacaccatttatccagaagtattattaaaataaaccatttcacaaacaaaataaggacattttttattatcactattttaaccctgtgttattctcctatccatctgcacctcactttaattcatgaacaaaaagaatctttggtatcaaggataatattaaaattagaaagaaagccacttggtctttgtccttatgttgtttacagaatgctccacgttggggtactattttgaaaacctggcattttttgattacatgtaatctgacttgttgaggatctagagtgcagaaatattgtatgcatgtaaatggtgaaaggaagaggtttttgtctccttggcaattcatccccattatcagtctacctaaaaattgtctcccgccattacatagaagcactttgtactttgtaaaataaactattgcagatgttattaaaataaactgttatgcagaccatatgaggatattatttgctgcattatcaagttctcaacttggaattagtgactgaaatcatcaaagttgtttattgcatctctttctggcattgctattattattatttgcatttattggtcatttatataaatattatgaaaacaatattgtttatttgaaaaacaaagtatttattcttcatttatttggtaaatatttataaacagaggatatgtgaaaagaacatcccacaagttaaatgctttttaaaagagaaaacattttctacttcagatttgctggagaaaatgaaatactgtgttttaaactcatcagtatttttgagcatagaaatcgctctataaatctctctttgaaaaaggaaaatataaaatcagaaatgttagtcagctttaaagcaaataaacagatttaattaagaggaaattttgaaacaaatctcacaaacttaaaatatctttgtttattcagatgtgttgcacataacttctgttaacaaaacaaacagattaaatgtccatattgctaggcaaagtatgtctgttaaataaaggtgttgaagtaatctgttaaatgttaaatttaactctgaaagattaaatagtaggttgcttaggtcagaaattcaataaaaaattctctaagcattctcttgctatcaaattgctttatttatgtcatggaggtttaatctttagagctatgacatttccaaaaaatatatactttgctttgtttgagaaaaaattgcattgtgccataacatgattttcataaaagtttaaacaatgtcttgaaaaagtaaagctaaaagtttattaagcccaaatataaccatgtattttatttatactttgacagatgcctacagaattcaaagtctaaataggtaataggtacagcaggactttgaataagattgtttcatccagggttttttcactagaatgtgaattagattaaaaaaacaaacaaaaaaaacccatcactttccagccagggcctctgtctgtgtggggtctgcatgctttccccaggcctgcctgggtttgctccaggtcctctgatttcctcccacatccagatgtgcctgttaggttcatcagcacatctacacagtcccagtgtgagtgagagtggtgtgggtgtgagtgcgccctgtgatgggatggcatcctgtccggggcattttcctgcctggcatcctgagctgcagggataggctctggccacctgcaaccctgaactggaataattgggtaaatcatgatcttacttgtttttattaatcattcttaaatgtatgtatagttcacatttgtttcaatgtcagaagtgttttgggtctttatttagaagtttggtgatgtttttgcaaccagaaatatgccataggaatttcacttttgtttggatcaaatagcctgtggtcaaattggtttccttatagttattttgcttaaaggaacagtttccaagaacctgtagacaacattcagtgaggacatactgtagttggtacagtgtatcagatgcttccaagggaaaccatggttggacatacagattttggagttatctgaactgagtaaataagtgactgaatttgtcaagtcaaaaagtgtagcagagaagagtccatggccaaggaggaaattttattgctatttcttccttcccagatagtatatggttgcatcatattataaatttaaacatattcaattaataagtagtttctttaagacgaatttggagctactgaaaaccagtttggagtatatagattctatagtcatacaaccgtgctacaaatactttaaactgaaagtatagtcacaatgatacaaagacacacagaaaggttgcaagcctattaagagtcagatgagagtctgaagttgtgaaagtacgtaaatgatatgtgtatttaggttaacagcaaaggggtggattttgattatgaaggcgaggttatcctgaaacctctcatcctgcagggagggctccaggagagtgaaagtgcccaagtccttttaaggcctaggcttgaaactggcatactgccacttccacagcaattgattggccaaagcaagtctgattcaagaggtcgggaaacagattctagctgttgattggaggagctgcaaagtcacatttcaaagaatgtttatataaacagggatgaaaattttggccaatttcacatacatctacaacatgaagatcctattaaagaaaaaaaaaacagatgaaaaacacattgattagtgtctcccaaattttaatatgaaaaagaactattttggatatttattaaaattcaaatccctgggccatatcccataatatgatagtaggtctagttttctagaatcttaaacaaagctattcatctccctagtgattttgatagagatggtctaatgactctccagtgatggagagaaagaaattttatactggagtaatgaagagtgaattattacaggaaaaaaatagttaagcaggtgaaaactgttcaaaggttatccccttcattcgttactacagattgagtattccttatctgaaatgcttaacaccagaaatgtttttggactccagatgtttttggatttgggcatacaaaaatacttgtgaagccatcctaccatcaagataattgaagtattgtcacctaaagagttccttctcacacttttctaactgcttcccccagctcttcttggatccactgatctactttctatcactacagatgagtcggctttttctagaagtttacatatgtatgtaatcaatggtatgtattctttactctctggcttctttaatgtatgattattttgaggcttatgcatgtttttgtatgtatcaatagttcattcctctttattactgtgtagtatctcattgtgtggatataccacaattgatgtatccattcaccttttgatggatatttgttttatttaaagtttttggcttctatatatattcacatacaggtttttgtgtaaagaagttctcatttaccttggtttaacacctaagagtaagattgctgggccatctggtcatatggtatgcttacctttctaagaaaccaccaaactgttttccaaagtggttgcaccattctacattttcatcatctgggtatgagagtcccaagtgctgcacatccttgtcaacatttggtatggtcagtctttttaatttcatgcattctgctcagtgtatcttctcattgtggctttagtatacatttcgctgataattaatgatgatgaacactttttaaggtccagaatttccagatatatattttatttggttaagcacttattcagatcttttgcccattttttaaaattaggtatgcttttaaattttgtttcattttttagatttttaagtattctttatatattctagatataaggttttttttcagatatgtgggttttttttgtttgtttgagacagagtcttgctctgtcacccaggatggagtgcagtggtgtgattttggctctttctgttattgcaaaataacaaatattaattttgatgaagtccaatttatcatctcttaaaattttatggctcatgattttgatatcatatctcagaaatatttgcttaatctgagaacatgaagtttctatctttgcttccaaaagttttatattttcaagtagtatattttaagtctatgtttcattttaagttaatatttgtatatggtgtgaggtgtgtatcaaagtttttgtcattgcattgttttgttttgttttgtgttatggtttgagtgtgtccctcaaatttcatgttttagaaacataatccccaaatttctgtgttgattgggggtgaggccattgggaggtaattaggattgcataaggtcatgaaggtggggcctccatgatgggactggtggctttacaaaaagagggagacctgagctgatacacactctcgctctcatgccttatgtgatgccctctgccatgttatcatgcactaagaaggccctcaccagttgccagtgccatacttttgaaccttgcagattccataaatgtaaaaaataatattttgaaatagatactcactatggtattttgttggagcaacagaatacaaagtaagacattttacttgttttttttattttcttttggcataattttattcactcgtttagtactatttgttgaaagattatcctttatccactaaattgcctctgtaccgttgttgaaaatcactcggcatatgtgaaaacctgtttttgagttctgtaccattaactgatttgtgtatctttatgcctcactattttgattaatatagtttctagtttgctgagagtttaaattggaaatgactatgagatttcatccagtcctttttatgaatatttgcagggtatatacatttttttaaatttaaactcttgttatggtgcaatgcattaattgattttcaaattttgaaccattgtactctggagaaaagaatgcaaatgatattcttccgttagcaaagaattactttagtgaaatatggttaattgtgttcatataactgaagctcagcagggtgtgtgcctaccttatactatttaaaataaatttgagggcattttgaatacttttgactttgctttattatttatagcaactaagtactaaaaatgcagatcaacatggttaacaagtttgctacctgaaacaacaatttcgaatagatgtatatgtattctattcaatctagttaaaactattgttgttttataccctacagagaatttcgttaattatccctaaaatttttgtaacacagattcaatttaggcaatatgtttcatagttctgctgttctgctaaagacaaatacagaaattataatcagaaggcttaatcagctgtggcaaagtacaaatgaggcaaaaccatagtacgtttatttcattatctaaatttgcaaactttgcctcaacgtttaaagaaaaacaacccaattaaatcagatgaaggataaacagacttctcagcagagatacttcaactgagctagtataatatgctgcccattataaagtagtctcttacagatattgattacattattcttttctactgttgtaactgagttagaaaaatataattcagcatcttatactctctgtaaagaaatattttttcattccatttgtgtcctccagataatgcaatagtatgtctattataagagtattttattatttttgttatttcttttttaaaaagacctcatcaattaatagttaatcataattgatttatacatctgagaaaacagaatagtttaattggaatgttggcatatggcacaacaaagttttactatcatttatgtagccattataaagtgatttttggattgttagacttacaaatttaaaaaatgcaatcaatgagtgtgagaatggtaaaataagggtttcattaaaaaattaatgtaagttattttaatgaattatccttttcttgagaaagattttcataaaccttattaagtagttgaatcaggaaatatgattactgagcagctgcaattcagaaaattaggtgagtgctcaggttcttgaaccagtgtgtgatgggttagggcagatgaattgaaaacttctcagaatcagggtcctgactcaggagaaggggaaagcaggaagcagaaagaaggggcaggccctgagcatcctatacccttggctgagacatgttttcatctcattccttccaggcctgctaaactgttaacctaccacccaacagagctcttttgtagactagtaattctatctaagctctcactggtaattaaatgcagaattagaatagagaagaaaaagtcaatatttacaaagaatagcagtgatatgctaattaatattgggtcatatctgaggatatttatgggaatgagttttgaggtggctcaactaaggaaatgtgaacatattttagatgagaataagtgcttccataagtgttttaatcatagaggctacattcaatgtgttagttctaatgagcatgaattataacaatggtctaggttgttgtgcaaacttaaacctattattgaaccatgtgaaagcagattatccatcagaaatctactggtatgatatagaagcaggaattcaaaggcttcagggcatggaaagacagaacaggtctcattttgagtatggcatgcatctcctaattatgaccattgagaggattccaaagaacttcctcttaacaaaaatttaagaaatcatttatttgttaaaagaaatacatcctctttccaatggaaatgcagacgggagacaaattacttaaagaaagctctctggtctccaaaagaacaggatccttctgagcattctactaaatgccctgtgaattgtaaggtgtttcctctggctggtgggaatgggaactaatctgtatactgttggctcaaatctttttgtctgtttccttccccagcctcaggtagcttcctcgtatacctgtgctgaacagtgctgtcctgaacactcgtgagggctcttctgcaggtctagggagctgtttctccatgcagctctctcctctcctatccgctgccctgggaactctagtctggtctccacggactctccacaaaaatctccatcccttccacttgtgctctccgttcctgccctgtggtctggaaactctcaaagcaataaacgagagcactcaaaggacacacctcatttgcttctcatttctaagagctcacattccttcattgcctgatgtgcagtgtcttgaaacctgtttcatatattttatcaagtttttttttagttgtttttcaggtgggagagtaaattggtccctatcactctatctcagaagccgaagtctccatagtttacttaaaagtgtgtaaacttccaagtatatggaattgtccagatacctttctattattggttcctagtttaattaccttttggtctctgaacaccttctgtggtttcctttattttaaattgctaaggtttaaaagtttgttttgtggcccactttatggaatattgtctatcttggtgaactttccatgtacattgcaaagaatgtatattctgctgttgttggctggactgttctgtaaatctcagcgtattagtcagggttatccagagaaacagaaccaataggagatatttatatacatagttggatcacataactgtggggctgacatgtctgaaattcacagggcaggctgcaggctggaagttctggcaagagctgatattgtagtttgggaggcacaattcctaccagttccaggggctttcaactaattggatagggcccatctacattacggaagataatttgctttacccaaagtctactggcttaaatgttaatcaatctaagatctaccttcatagcaatatctacactggtatttgaccaacatctgggtgtcatcacctagccgaatagacacataaaattaaccatcactgttagcggtggaagacatccaagttatccaaagttacctgtggtgcatctgtgtgagttggcagcaactccagtccttgcctcctcagaagaaagaatttgactgaggggcataaagcagaagaagagactgccgcaagtttcagggcaggaatgaaaatttattaaaaggctttagaacagtaaggaaagaaaagaaggaaagtacaacttgaaagtacaagaggtcaagctgtgcacttggtttctcaagggccaggcaggcaacttgagaagtcaagtgcatagcctgacctcttgacttggggttctataggttggcataactccgggatcttattgggaagctgctgatcagtttcgagtgttttctacctattaggagactgcctttctgtggtgccagccatgaccaattattactttagagaaacggttaacaaccgcctgaccatcacctgatggttgcccaacactcctggtgtgtgtgttgtggggagccctctcctgccttgctccaggctacctactgtaacatcacagtcaggtccagttggcctatgatgttcatgactgctaaatgcttgctaattttgtctttttgtcctaccaattactgatagagaagagtctccaaatataattgtgctttgaatatttcttcttcagctttattaattttacctcatgttttttgaacttctgttttagggacgtacactgaggacatttatggtttttggtgaacttactctttcatcattttataatgctcctccctcgtaattttccttattctgaaatttactttgatcttaaaattacggtagcagttttcttataatttgtgtttgtatcgtgtatctttttacatccttttatttttaacctattcaaatcattgtatttaaagtgattgtattggagatagcatataattgatttttgccccaatctgataattcctgtattttaataggagttatttttgatgtagttagatttatgcctaccattttattgttggttttatgtttgtctgctctgtttttttgctttgttttgactttctgttgaattattgaatatattcattatgacattataatttatatattgtttttgcctccttctcttcgtactatttttaatggtgtctttgtgatgatcatcccctttcacagtggaataaaagctaatattttaccacctttaagaaaaatcataggacctcccagttggggtctccagctacccctgctggtattctccctgacggaggcttcaaacctccctgtgacagagtttccacagggaggggcagaccaccaccgtctttgccattccagaaacctacccattctggcctttgggctttggagtgttcgaggtgacctatgggccgaagaggaccctcagcacggacagttgttctacaaaaacatggcaagactgctttttaaaatgggtccctgctttttaaaataggtcccattcctcctcactgggtgggacctcccaaccagagtctctaggcacctcctacaggtgcattcaggctggcaacaggtctgtacttccctgggacagagcttccagagggaggggcaggctgccatctttgttgtttcacagccttcaccattgatacttccaggtactggaaaacttgaggtgattagggactggagtggggccccagcataccacagcaggcctgcagaaaagtgaaccaactgttaaatggatgcctgttcccctatctccttactgggcaggttctcccgccctgggcctgtagtcaccgccctcccagagctattgagctagtagcagctcggcaactctctagacagagcccccagggtcagctgaaagcttgtctatcactgcctctgtagtggcattgcccttgccaccctcggactaatgaagaagcaaagaccctaagggtcttatccacattgccaacaagcggcaatttacccaaggagaggaggccagtccatctcccatgggactcccacatacctcactgcttgttattagacaggaagcccttggtttgggcccatagcaaaggccctccattctggggtgattgcactgagcaattgtggacctgcgtctctctggggtggagcccccagaaggcagacaaaagacccttggccacaactactaatagggtaccttcctctatgcctgcctctgttccttggggaagaaatataaacactgagattgccccagagctgcagtgggcagccctgaagtgccaagccatgatctaaagccagcactcaagggggagaggaacccacattttcggaacattgagagggaacacggctgcaactgtgaggaaacaggggagccacacaattaagcaagagtctaacaaccaaccaacacacctaagtatcaccagtggatcacaccctaaagctcaacaccaaaaatacctggctaagatggcccctctgaaaccaaagacaaaaaactccaaataaagaccctgcacaaagcctgggccctgtaaaaaatatcaagaaatgaagtctattgactgtaatcaatctacatagcagttaaaggaatacccacatgcagaaatgagaaagaaccaacacaaaaactccagcaactcaaatggccagagtgccacatgtctgccaaacaactgcactagttctccaagtgttcttaaccagcctgactgggctgaaatgaaagaaatagaattcagaatttggataggaaagatcatcgagattcaggagaataacaaaacccaatgcaaggaaactacaatcacagtaatacaatacaggagctgaaggatgaaatagccggtatcaaaaagaacccaacagatctgacagagctaaataacacaagagttttacaatgcaataacaagcattaacagcagaataaaccaagctgaggaaagaatctcggaacttgaagactggttctctgaaataaggcagtcagaaaaaaaagaaaaaagaataaaaaggaatgaacaaaatctccaagaagtatgggattatgaaaagaggccaaatctttccattattgatatccctgcaagggatgggaagaaagcaaagaatttggaaaacatatttcaggatattctgtgaaaactttcccaacctttctagagaggcccacagtcaaattcagggagtacagagagcccctgcaaattatccccaagacaaataatcatcagattttccaaggtcaaaatgaaagaaagaatgttaaaggcagccagagagaaagggtacatcacctacaaagggaacccaatcaggctaacagaggacctctcatctgaatccctacaagccagaagatattaggggcctatattcaacattcctaaagaaaaatatcttcaaccaaaaatttcatatctagtgggccaggcatggtggctcacacctgtaatcccagcacttgggaattgtggtggaccacttgagatcaggagtttgagaccagcctggccaacatagtgaaaccttgtcactactaaaactacaaaaaatagccaggcatggtggtgggtgcctgtaatcccaacaactcgggaggctgaggcaggagaatcccttgaacccaggagacagaggttgaagtgagctgagatcatgccactgcactccaggctgggttacagagggacactccatctcaaaaaaaaaaaaaaaaaaaaaaaaaaaatcatatccagccaaactaagctttctaaatgaaggagaaataagactcatttcagataagcatttgttgaaggagtttattaccaccagacctaccttacaagagatcttgaaaggagcactaaatatagaaagggaagactgctaccagctaatacaaaaacacacttaaacacacagtgccactgtaaagcaaccacacgaacaagctaatataataaccagctaacaacaaaatgacaggatcaaatctgcacatatcaatactaaccttgaatataaatggcgtaaatgtcccacttaaaagtcacagagtagcaagctggataaaaaaaacaagacccaggccaggtggtggctcatgcctataatcccggcactttgagaggcctaggtgggtggatcacctgaggtcaggagttcgagaccagcctggccaaaaaggcaaaaccccatctctactaaaaacacaaaaattagctgggtgtggtggcagacgcctgtaatcccaactacttgggaggctgacacaagagaattgcttgaactggggagggagaggttgcagtgagctgagattgcaccactgcactccagcctgggcaacagagtgagactctgtctcgaaaaagaagaaaaagaaaagaaaagaaaagaattatctagaagcatcaattgtaagaaaagactagaggtgagtggagcaacaagactcctgtaatagtgaaaatggaaattatgacaattaaagagtagttgcagcatcactgccaacaggagggaaagacccacttgataatttaggagggatttagaaggaatcaaagacacctgcaaaatagtgaatctgggtgacttacagaataaagaagccattaatcgctttgaaagatgagggagacatgagaggttcactttgaatatattgcttgacagctggcaggttatgtcactccatgtgttccacagatattagacaaagcataccttatctggagacaaggtttgactggataaataggaagggtccatctgtgtaatagaactattttagaatgtaggaatagataaagtatcaaaggaatatatggagattaaaaaaatggctcctggaatcagtaatgtgctggttttcaggagttaaaaaattattgactcgggtatatcctagtgaactgacaaagatacattgttttaaatatataaaaactattaagaaactatattcttaatgccaaaagcagtaatgcagatactaattagcattgtatttaggaaaaccactcatgcatttgagactaaaattctaatctgttacatcaacatacatgactttctaaagctctcctggttttttttctccccaggagaatctttctgcctaggcatattcaatcctcagttgtatccaagattcctgtgtcagaaaaaaacaacagctcaccatcttcagctcacttaggaagggtctgcccttctcagctatgttattttatctagttattgattccaaaatttcctgatttcttaaatatatgttttttatatataatggtaatggtattggttttgaggcacattgtgacctttcagataagggaaacacacagccagctgcataatcaccccaggacttgactgggagcccttttcagagaacagcatacgaagaaagtcactgaactggacaaaacaatctcattgagccaatgaaggaaagatcagaattcctggctgcttacttgtttggaattttccagaaacaaggccctatagagacatggcatccagaaggctgcatatggatccctcatgattcatctgccgcaggttctgagactgcacatgtgcagtgtgtgactctgtgaggcctacagtagactgctgtggagatgaaagttctgcagaggcagcagaggtcttcagagccagggaacaaggaggttctggcttaccccaagcgaagagacctccttgattcccttggacatgccactaagattgcagaatactcccatattagggtcaagaccatgacctagagtaaaagacagaccttaggacaaaagactaaacttaagtaaactagaactaaaagaagtaactccaaacctgacagaatcgagtagatcaatacataatttaaattccaggaaaaaaattaacaaatctttacaaagaagtaaacatcatccagaactgatacaacatatcattcacagtatctagaaagtaatcatacaactgccagacttgtgagaaagagtgaaaatatgactcatcatcaagaaatatagtagtcaacagcagccacaagataacccacatagtaaaattgtcagtgacagaatttacatatatatgtaaattctctctatatattctctctctatataaattctatatgtatatattctatatatgtaaattctctctatattctctatatgtaaatatatacatattatatatgtatatgtataatatctgaaatgaaaagttcataagggacttaagcagaatttgaaggctgctaaataaagagtgaattatttctatgataggtaaacataaatcattcaatctgaagaaaaacgttgaaaaaacacacatttctacattagcttttggaaaagtgtcaagcattccatacacaagtaattggagtccttacaggagagtagagaaaaagtactgaagaaacaatattagaagaaatatggatgaaaatattctaatttggttaaaaaaacccatcaacatgcagacgcaagggctcagcaaaactcaagcatgttaaatacaaagcaagccatgcctacatccaaatcaaactgctgaaaatcaaacaacaagagcaaatcttaaaaacagacagaataagacacttcacacaggacaatactgataataatttccctggtgtggctttggaaataaagacctccagaaggagtgaagtaatatgtttaaagtgttagaaggaaagaaaatgtaaatcccatattctacatccagcagaagaatcctttaaaaatcatgaagaaacaaaagtagagagttttcattcccaatttacctgcactatagagaatgttaataggagctcttcttgaggtgaaatgacaccagatagcaactcaggtacacaggaaggaataagaaacagcatataaaataagtacatggataaatgtgaaagacagctttttctttttaatttctttaattgccaactaactgtaaaaagataattatgtaattttgttgtggaatttataatacttctagatgtaaaacatatgacaataacataaagggcaggatacatgtgaaagaaattttgctattacatacttatcatataatattaattccaagtagtttacaagaagtgataatgaattgtttaacccttagggtgagaattagagaatagttcaaagatcagaagcaattaggaaataaattgaaacattaaaatatattcaattagccaaagggactacagaaaacagatgagatatgcaggaaacaaacagcaaggtagtagatttaaacccaactatacataatttattacatcaaatgcaaacctactaaaaattacatatgaaaggagattggctggataaatatcaaaactcagttatatacaatctaacagaagaacacactaaatgtaaagacatgttgcaagtaaagggataaatatgaatatatacacgttaaactcatagttataatgtgcattctaatatcagacaaagtagtctataagacaaggaataataccatagataaaatgagaaaataaggccgggtgcagtggctcacacctgtaatcacagcactttgggagcccaaagcgggtcacttgagcctgggagtttaagatcaacctgggcaacatggtgagacaccgtgtctacaagaaataaaaattagctgggcattgtggcacatgcctatgggcccagctactccaaaggctgaggtgggaggatggcttgaccccagaaggtcgagactgcagtgagccatgatcgtgccactgctctccagcctggatgacagagggagaccccatctcaaaaaaataaataaataaataagggaaaatacgatgttttataaggataaaagggtcaattcatcaggatatcataagaatttttagtgtgtatgaagacagttcttcagaatgtaaactgaaacaaaaataaaaatttaaaaaaagaataaaagggagaaatatacaaaatgaaatctctcctggatattttaaatttctatatgtataattgctggaacacatatatgaaataaatcacagaaatacaaaagatttgagcaatgctactaatcaaattgatctaactttcaaatataaaatatgattcaaaatgactgaagtatacatattctcttgctgtacacataaaaaaacactgaaatagattgcatggtgatctataaaataagtttcaatacattttaaaatgaaattgtatgcaaaatgttctttgatcacaatttacttgttaaaaatcaatagcaataaggtgtgtagaaaatctacaaatatttgatcaatttaaacaacacacttctgaatgacacatgcctagtttgctctctgatatcttcaaattgtttttttctgccaaattttatttagcttttatagttgttttcagatagaagactcatctaatagaaaatattttaccatatgaatatgttcattggcttgatttaatcattctacattgtatacatgtatcaaaacatcagatggtatcccatattattattattattattattattattattttaattaatttattttttgagacggaatttcgctgttgttgcccagactggagtgcaatggtgcaatctcagctcattgcaacctctgcctcctgggttcaagtgattctcctgcttcagcctccctagtagctgggattacaggcatgcgccaccacacctggctaattttttgtattttagtagtggcagggtttctccatgttggtcaggctggtctcgaactctcgacctcaggtgatctgccagcctagggctcccaaagtgctgggattacaagcatgagccatcgcacacagcctattatttttaattagcaaactgtgatttgctatttaaaatagataaaataaaacaaaacactaattgtctaccctaaactaaactacacatgtagaacactactttgtctgcgatttatcatagacctgcactcatacttcatagatggtaaattattcctatttatctaaatcacttggagtggtggcttggccttcaccaaaggaaacagaaggcagagaaagaacaaacttgtaggacgcaacgattttcacaaaagtcaccacaaaaggatagtgatttctactacaacctgcccttagtatgtccccatgcattgatgcccaccctgggaaaatgtggattcagaatgtttaggttatcacactagctacaatcatctaagagagagttcatagtactcacgaaatttcaagttcatagacttaataaaatctctattctttacaatccagttccattccctttggatctcatccctgacccactattaaaatctattccaaatctctctctagaaatttgtccaaggaggagaaagagatcttttgcttcactcctaattatagattatcttttgtaaatcgtcgattttctattatcattagcataaggaggaggcctaatagaggcaattggcaatgtggctttatgcagttcagtctcagaccctctacgctgactcttcagtgcatgaaaggcaagcccactgcagtctccccaccttatcttatttgcttgtcctagtgtagcccttgacttgatgggtgcagcatactttatctttattaactaaatctaatatctttcccttcttcagtatatagagtttccttctcatcaataccaccaaagaggaaccatattttgtaagtctttgcatcccacacagagacctagcacatagtagatggtctttcctaaaatcacttttgaacatttactatactgggtttttgaacagaaattttcaccaaagctcagaatacctgtatacatataaaataaaatgattgatgcaaacacaaaaatactccatcataaacagaatcaggaagtccagcatattttctaaaatcctaaaattgtaaaaccgtagaatgatttagatgcttaaaccatataaagaatgatgactatatttaattgcatgtttgtttctcctatgttttcctttgtgaaatcactaagttctaaaaactctgtagaaaagtgatttcagctttatatttacattggtaactcaaggttaaaaatgcatttccacatttgtaatatctacagaacctatgactatatatagctactgcctcctctaataataaataaaacagtcatatattgagtagtatctgtcagattgcaattgtaagacagcctccttgaaattgacttattctcatggacatctgattaatttatttacttctatttcttctgcaatactattcaatactatctttagtgtttaataattcattaccagctgctcagaagctattgattaaaaattggatttggaggttaccccatgaaaagcaaaggtatgttcagatatcttaatatgtaaaataatatatgttcataaattctagactctttaaattggctattctgtttcttgaagcaaaagtatactgatataatgttaattatgattattataagtatgactaaatgtgagaaaaagatgagctaaattgttgttatgtctacacaacagacccaagagaatcaattaattaacatatttcaaaataaattggggaaattattataacttgtagaagcatattgcaaagttttacacattcacatgtaatgttactcactacatgtgtatgtgtaattatgaggacagaaatcatatgttttttgttaatcattaaatacccagccaccctggacaacaaagctggaaaacacttagaaatatttgttggatgaatgaatgaatgaatgagcagcaaagctttagagttgtttgaatgctcagccagagaaagtctggacactgagaccctgtacctttatgcttgcagaggggcccacatttccccagaaagtgatggcacttcagctgtgctgagagactgcaaagctccccaatcctgcaccaggcaacagatgcccccataagagctgtttctacccctgcttctcacagccaggccaataacaagagttcaatcccaacataactgaggaaggttctgagcctgataaaaagggtggagattatacatctcaagggctgcaagattatccagcatgtgctggcagaagccaaactcctgtgattggaatttgagtgtgcctgatcagaggtcagactataagacagataagcaacaatacattgacatagagatcctgttttcagagcgcatgatttaatatactggtaagaagcccaggaaatgaagcaaacgcactgttagagttacctatacaagtctggaataaatggcagccaactcccagtgaagtacaaatgcttgagttgccccaacagacagtagaggatgagtaaagaggcagagggaaatgtgcatgctggaatggatatatatatagtacacaaggccagaaggtccaccagaggtttatgttctaaggaaaggtccaaaagacacaccattcaccaaggccatagggaaggcactggaaacaggggaatcaggtgcattaaattcagagggagctcacctgtgcaagctgaagataagacacattaggcaatcacagagctgggctcattaatatccagaggcaggtgaggtctcaaagaaatagaagccaggtggtgatggtacttacctactgggagctaagagttctcattaccacagtgaatggcaagttctggaggtgcagccaaagggcttggcccacaaagagctgtggtggttcatagagaatggtgttccttggggaagaacagatcagcagctaacacggaagaacagagcagcaaaaggctgagggtggtcactacataagctctgcttctaagacccctagacgctgcatgaatgggcttcagtacctctctaacctactcttcaattttattcaagcattatatgtcagcatacacttagaagggttaaggcatgagggccccttatgaggttgtatcaaagacatacctaaccataaaaatgagcagtggttaatgaatatttcactaacaaacctaatactgaaaataatgctaatgctaataagctaatactgaaaaactggaatttttctaattttgtcccttacaccaaaaaataacacaaggttatgtttggctattaatattgagtaatgcttttctggaggtgctagtcaagaaattgaaaatacaacttaaaagaggaataactatgttttataaataagagacaaatgtaatacaggtgacagaagaagtataattattatttgaagacgatgtaattatctatctgaaatattcaagagaattaactggtagaacaatgagaaggtttagtaagttagccagataatatacacttgctctttatagactttatatttttaacatggctacttttctaattcagatcacctcaactcaaataaacacatttgttagaattattataagtctttcacctgttatgactttctaacttgctatttaactttttttttctttcttttttttttttttttttggcgatagagattcgctcttattgcccaggctggagtgcagtggcgcaatctcagctcactacaacctctgcctcctgggttcaagggattctcctgcctcggcctccctagcagctgggaatacaggcacctgccaccacgcccagctaattttttgtatttttagtagagacggggtttcaccatgttggccaggctgatcttgaacttctgacctcaggtgatctgcccaactcagcctcccaaagtgctgggattacagaagtgagccaccatgcccagcctatttaactttttattctgggtaaatattaaacattaataaataccactttggtatgtattaagttaatcaaatgtaatagtatatttgctctcctttgaatttttattattataaataccatatgatgatcaatttgtgaattcctagaataaattaattggattaatttggaataaattaattattcaatttattgctggttctacttattttaagtaagggtgagttgaaatattcttcatcttaactatatttttcagatttcagtatcattatgatgatgactatataaaacaatttgctatttttaattttttcttttgaccaatttttttttttttttttttttttttgagatggagtcttgctctctcactcaggctggagtgcaggggtgagatctcggcttactgcaacctctgcccccaccgggctcaagcaattctcttgccttagcctcccaagtagctgggattatataagcacccaccaccacaaccagctaatttttctatttgtagtagagacagggttttgtcacgttggccaggctggtttcgaactcccgacctgaagtgaactgcccaccttagtctcccaaagtgctgggattacagttgtgagccaccatgcccggccctcttggctaaattttaacgtgcatcagattcacatagaatgcttgtcaagaatgtagatttcaatacccagaaactttaccatagtaggtcttacctgagccataggaatctacacttttagtcaacaaactagcaaatttgacgtaggtaagtcagagaccacatttagagagacagcaaatggtgtgatacagtttaaggaatgttttaaatttaagttggagagttttctttgaggctgtttaggtatgagagttctttctctaaaaggtgtcagaacaataactccatatctctcttactcatatgtgtgtcttcacaagtcaattttggtaattttttactaataattctttaattcattcaggcattcaattatactaacatagaggtacgcagtattctctcatgcttctacttatgtctacgactagctttcccctgatggtcctaagtttgtgcatatgtactttttctctcttttaccataggctagttagtggtttaataatgtcaatggttctttttacttaaaaaaaaaaaaaaaactactacatatatttatcctttcttcagttacttcagataatgctaggatccggttaaaaatcatgctatatttttcctttacctgatgtataatgagaaaagataaaagaggaatattttgaattaaatttattgtatatccctattcatctctaacatatgtgacttataccaacaaagcacattaaaatattgacaaaacatttcaatgttagagtctaaacaaatagctgaaaaaaacccagaaacaatgatttctctactactggactccaatttaaacaaacagggttatatttaatttttcctccatgacaatagaagcataatctctacggtgctaaattctattacctttatttatatatttcagactattattcaatatctcattttgaaattataaaaatggatttatttttagcaaactatttttcatctttgtcagtaaacaatagttcaaattttttaaatttgccataattgtgtgtaacttgttgggatttgtacttatatgaaatgtagtctaatttgatataggtatttgacaaagaaaactttctacagaacattaaggttgaaaagtgctcatgggagacagtgatccagaacataactgcttacaacctgcaataaaaatcacaacttcacattaagtaatcaggagtcagtgaacagctttcaacatttaaagagtgcccaaactgattatcacatgttaggaagagaggtgaataaacaaggggcctgaggacagaggttcaagtttccttctcttctgtgaactaagctgcaataaggcacttgtattatattatcaatgaattttataaaatagtacttacttcaattactgtgaagaatttttaaaggatgcataagaaaataatttagcatacggtttaaacacccttaattcaaatattacttactgcggacctattatgaacaagacacttctgaaatgtgagaggaatacaccagtaaacaaaacagaaagaaaaaaaaaaaaagggccaggcatggtggctcatgcccgtaattccagcactttgggaggccaaggcaggcagatcacaaggtcaggagattgagaccatcctggccaacatggtgaaaccctgcctctactaaaaatacaaaaattagctgggcatggtggtgcacgcctgtaatcccagctacttgggaggctgaggcaggagaatcgcttgaactcaggagacggaggttgcagtgagctgagatcaggccactgcactccagcctggtgacagagcatgactccatctcaaaaaaaaaaaaaaaaaatccgtctacacttgtggagagtgtattctaatggaactgaaaatttattatgcacactaatatatttggattttatttctgcatcatatattgtgctatctatttactgtgggttttctttgcttcttttggccttttttcattctttctgctggattatcaggttttcttttcttcctttatcttctgtctactgatggaaagtttcctgttcttctagtggttctctgcacctgattagaacactctgtgtgctgtatcacttcatttcctctttactacagtgattttgtttttgtttcttgtcatgtcatggacaatttctttttcttgtttttgagcaacggtatagtgtgtgtgtgtgtgtgtgtgtgtgtgtgtgtgtgtgtgtgaaataaactcatgtttccacatgtattcaatcatgcgtcttcacccagaagtccgataatgagtcagcataaaatggtcttattaaatattgcttaaataatgtaaatctcctacttagaatatttcagttgctctctttcttgcataaaattacttctaaattccatagtttggtcccggaggcacttcatatcatgacctctcttttaaacctatctccccttttttcagtctatgattactttacctaagctacacagcatcattcttcatcctccaataaccttccagctttttccctctactcttctgcttatgccatttcctttactgactatgctcctatactgaaattatttcttggacttgcttaaatgccatttcttttccattttcatgattgctctgtatagttaaaggagaagttagattctcctctttctgaaatactaatagttttcagatattttctggaattaatcgatccttagctagtgttgcaattatttgtgttgtttattaggttgtatgtacataagacaactgtatgagcttgttctcgtacgtacagctgcatgctccttcctcatttctatgaagctttcttgtttccccagttcgtttatgtaaagatgttcagtatagttagaatgtagagtgtaagtaccatagtactaggggaggtcaaacagataagcagtgaaatggttggcaagaaatttataatttttgttaagaaaattgcaaactctttgaaaggttgttagtgcaggagtcattctcatattttaaaaaaacttctgtgtcaagaatttgagtaatgcaatgttagagaagcagaaactagttaagttgcagtaatttcttgcccattggagttatgcaagactgatgtgggaggatcacttgagattgggaggttgaggcagcagtaagccgtgatcacaccactgtactccaacctgggcaacagagtgagaccctgtctcaaaaaaagaaagaaaaaagaaaagataagagaaggcagaaaagaaaagaaaaaaaaaagaaaagaaaagaaagaaaaaagaaaggaaagaaaagaaaagaaaagaaaaaacatacagagagacaccagggctagtgtgcacaaagggataagcatgtgaagaggcagcagcaacagggcagccatctgcaagtcaaagagagaggcctcaggagaaacccacccagctggcaccttgatctccgggttccagcctcccgaactgtgagaaaataaatttctgttgtttaagctacccagtctgtggtattttataatggaagccgccaaaacaggaaagaggaatcatccattcctctgtaaacagaagtgagggagtttccttctgatgccttctttgtttccagtgaagcagagtaaaacttctgtaattatttaactagttaaacttttcacattctgtattccctacctcctataattcatgagggtggaatctcatctatgtttatttcattttttttctccacagcatctctagtgctaggaattctatctggcatatagtagaaaccaaataaatctttttttttttttcaaatgaatatttgtgagtaaattgggaagtggtgagtcagaagtctgagaagagtagaggagtagtatctgataaataaaagaataaagctacccagaacatacagagcatttctgactgtagttgaagattggagaaacatgaatttacagtgggaccagattacagagttctgtgattttttctatacactttaaattgccttaagtgtaaataatacctcaatagaaaaactgattgctcttcaaggatttctgctcccattacaatttccaaaattaaaggatacaattacaataaaaattttggattcaatattataataaaattatacttcattaggttttgatttatgcaggtaaagttcaacactccttaaaaaaactttttatataatacaattttgtaagactctccttgcaaaacacgaataatgaagatttaaagtaatttttatagttattattcgtggagcaaccatgaattttctagtagtgtctataattcacaagggttagaatatttaagctgaaatgccttttaaacatgacagaagtgataaaagtttttttttaacagatattgggtcctatgaaagagctacattaaaaaaaactgaagatactgatttgatatgtatacaactctaatgcactaatagtatcaccattttatagatgagacaggtaagacaaagacaaaagaatttgcgcaggttcacactgttaataatatgactgaacccaaatgtgaatgtagcaatctagctacagaatctgttctttaaattactttgctcttccatgggctctgattttgggttctacaatgtgggtacaatctttaaaattaaatgcaatattctttgggttcttaaattaccatctgcataggaaaaataagggaaagttgcttatattttgagaaagttaaggtggtaataacatcatatcaacaattacattagaataaatacataattatatatcacatatattttccctattaggttaattcataaataggcaacttctctttttttttttttttttgagacacggtctggctttgtcccccaggctaaagtgcagtggtgaaaacatggctcactgtagcctcgacctcccaggttcaagcagtcctcctgcctctgcctcccaagtgggtggaagtacaggcacacactaccacacctgactaatttttgtactttttgtagatatggggtcttgccatgttgcccaggcttgactggaactcctaagctcaggtgatctgcccactctggcctcccaaagtgctgggagtacaggcttgagccactgcacccagcatcatattgaaatatactgattcagcttgcagcaagatggcagaagcagtagcatagtttgaaatatccctaaatatatgtttttaaaaacagagtaattaaatcagtaaacaaacataagctccacatgtataacacaacaaagtgatagtatgtccttaaaaactcagacaattaaaacatcataacaaaaaagaaaacatgaagattgtagcttttaatccaactctataatcattttaaatgtgaatgatacaaacacaccagttaagacagaaattatccggtcatttacaaaagcaaaatccaactgtatgctcctataagaaacttattttttcagcaacatggatgtggctgaaggtcattatcctaaaaaaattaacacaggaacagaaaaccaaatactgcatgttctcatttacaagtgggcactgagcattgggtacacatggaattgaagatgggaacaatccacactggggactactgggagtggagagagaggaggcaagggctgaaaaactacatattggatactacgctcattacccgggtgatgtgatcattcatatcccaaacctcagtatcaagcaatacactcacgtaacaaacatgcacatgtactcccagaatctaaaataaaagtcatacttacaaaaaagaaacccattttaaaataaagatttagatacatttgaagtaaagagatggagacatatacaccatgtaaacatttaaccaaaagaaaaatgaagtggatgtattaatttcaataaggtagattttaaaacattcctgtctcagataaataagcttcttccctatatcataatcattctgcctaaagaattttcttaacctaatagaggatatctgaaaaatctacagctaacctcatacttaatggtaagaggcttaatactgtcctaagatatgaacaaagcaaaggtgttatttctcatctcttcaatttaataatgcattagaaatcctaactgtgcaataagaccaagagaaacaaaaagtatacagtttgaaaagaacaaatttaaactatttttattcacagacaatatatttgtttatgtagaaaatctaaaagaatccattaaaagtgaaaaatcctagattaacaagtgagtcccagcatacaaagtcaatataaaaaaagccaattatttgtattcctatatattagcaatgaacaatcagcatgtaaaatttaaaaatcaatgccatttataataacacaaaatgaagtagctaactataaactgtgcaggatttgtatacataaaactactaagcattggtgaaagacatcaaagaaaatataaacaaaaggggcaatatatcaggttataggtcagaagactacatattattaagacataatttttcacaaattttatctataaattcaaagcaatctccaaatctaagcaatctttattgtagatattgataaggtgattctaaaatacattggaaaggcaaaagaaatagaatagcccaaacaattataaacacaataattgattttagaactcatacagagctcacattaccaatttaaacacttataaagctgcataaatcaaaacagtgtggcactgaggaaattggagttaataaatagctaatcagtagatcagaatagacacatcaggaatagactcacacaaaaatagtcaaatgaaattaacaaatatgcaaaggcaattcaatggtgacaggatagtttttttagcaagtaatcatgtaacaattagacatccttaagcaaaacaaatcaaaaccttgacaaataactaataccatatacaaaaattaaaacaatatgggttaaaaccctaaatgtaaaatgtagaactataaagggtctaaaggaaaatacagaagaaaatctttgtgatctttgggtttcgtgtttagtttctgatacaatatgaaatgcatggttcattttaaattagaaacaagctgcaaattataagaaattaagagaacagtaatgaatatggttgtaatttaaatcaagatagaggaatcttttgcctgaggaagtaacactgtcaatggcaagacctggccattcccagtgtgatattgaagaaacagagaaaaacaaccgccactaataataacagcaaaactccaacaaccaatagaaaacaagatttttttttctatacactctgttcaaagaagtgaagtagctcaattcggtatgattttcaataaaatatggttaagataaggaaatcagcatgaaaaggctttagcctgccaaaaataattactggtaattaatcttcagctctatagacaattttgtgtaatatgcaagtttctcattccctagtaatatgcagatcacaaaattatactgacagtgggaattagaatactttttgaaagctacttagagttgacttcctgttcaatttactcacctcctataggacttgaacttaatagaaaagcagaagtcatttgatgaatttcatcttattgctcagagagtttaccgttatcatcacggcaaattgaatgcttcctcaaagactcatctgctgtgtttttaaacaatacttttatctccatctaattcctcattacagtatacctgatctttggaattttgaatgtaaaatggacatgtaacttgcataaatatcagtaagagtaaaagatgttcattcttgtgactatgaaccaaaaataaatagaaaaatgttttcttttctttattcctagttattgccattgatatgctttagtattctgttatgttgctgccactatagcaggatgtttatttttcttttgagttttatttaattgattctgaagtcattgtcaggaattgcctttgattcagaaggtgggagtatttctgctttgattcctatacagtacactgaaaaaaaaatatttttagaagttatcaaactcaagaaaaatgagaaacatcaatgattagttctggagaacagaacatcaatgattagttctgaaaatatatgcaaaatagatcagaaggacgtactatctgcccaggttaatccaaatttgtggagaaaaccatgctagatcttggaaataagactttccggacattcataaatttcataaataaggtagaacaatcacttgtttatttaactgtatgctaaaatcaaaggaatggatgaaaatctaagaattatataactcagtgatgcttaaaaattggtgaaagtggaattttaagtgaaatcatttgtatttgagtagtagcaaagtccctttctagatatgtgatttgaggaagtatttaagcttaccaaggttagttttattatctgtaaaacagcgataataatttatggttcataacacttactggagttttaaaaagataaattatctaaaatttttacaagtaagatagtcatgcaaattactgtccaaggactgtggaaagtgaaagggggtcctattaattatttctctagggagctggacataagccagaagtaacataattactttaaagcactggtgtcatttctaggtctggttctacatactagatttttatcttgataatggattctttccttactttattcttacttttcttgtgtgtctcatatatttggattaaggttaggtcttgtgtgtacaagaacagtagacaatgaagtcattaatattcatgcctaaaagcctaaaagacacacctcttcttcggcaagatctttcatgggtgggcttgagccaatctggtcgggaattgatccaggtttgagttttgttttgggggtaactatttccagtgcacagcggactacaaatcccttcagcattggattgctgctgccttatgcttgctttgagacctgatatggtttggctgtgtccccacccaaatcttattttgaattgtagttcccataattcccatgtgttatcagagggacccagtgagaggtaattgaatcatgggggtaatttcccccatactgttctcatgatactgaataagtctcatgagatctgatggttttattaggttttattatttatccctttctacttggctttgattctctcttgcctccctccatgtaagaggtgcctttcaccttcagccatgattgtgaggcctccccagccacgtggaactgtgagtccattaaacttctttttctttataaattacccagtcccaggtatgtctttttcagcagtctgagaacataataatacacggcctgtaataattttttttctttttcttattttagaagcagttttgctctttgtcaccgaggctggagtgcaatggcacaatcttggctcactacaacctctacctctcaggttcaagtgattctcctgcctcccgggtagctggtattacaggtgcgcaccaccatgcccagctaatttttgtattttttagtacatatggggtttcaccatgttggccaggctggtctcgaactcctgacctcaggtgatctgcccacctcagcctcccaaagtgttgggattacaggcgtgagccactgcgcctggtcataattttttttcaatgttcctgctccactctcaactttcagcagcccttacacgcctgcccccactgaggagatttctgtccatgtcccttccccttgaccactcaatagactgctgttgttacttagttcaacagttgcagtgggaacaaggggtcccttctactccagtttctgtcttaggcagtccctatgcatatggacatctgcagtggggttttctcagtgtctttctttcttctgccaataaaactgagctttgtatcaatgagggggtctcaggtaggaatatgtttgctggcactcctcctgtgatagtagaaccctgtgtggtatcaatgccaggtcataagctcaaactgttttcattcttcttgcctcacctactatcatctgaatttttgtgtccccccaaaattcatagtttgaaacttaatcaccaatatgatgatgttaggaggtggggccttagagaggtattagatcatgagggtggagcccttttgaatgggattagtgcctttataaaagaggcgctagagagctgccttgccccttccaccacatgaggacacagtgagaaggcaccatatatgaaccagaaagtagcactcactagaatttcctggtggcttaatcttggatttccgagcctctagaaccatgagaaataaatttctgtttatcataagccacccagtttatggtattttgttatagcagccaaaatgaactaagacaccaccaatggcagatggattttggttttaaacctttttcagaaccactgaatacttgctttgtgccagttagtcaggagttttttttttttctttcattagtggcttacagctctgtttcaaatgaaaaacaaaggaagcatctgggaaccaagcaaggtttcttccctgtgtgtcgctgagtggagtttctcagatctcctattgtacccccgattttccttgtaatcactcatgagaggcacatgggaaagagctggtgaatgagtttgggttatctttgagtcacagaacttcagcgatactaacgcttgctagctcatatttgacctttaagtgttaatttaagtttcagctgttttcttcctgctgactttgacagtgactcatctttcttctgttctctgacaaaagtgaaacagtctgtgtgccccatgtctctcctggaagcctagaatcctttagaattgagtacacctgtttgtctaacctcagttttctaacaggatcaagaaaatttatgattggaggttgtccagttttttctaagcagcagcagcagaacctgtctactggcttttagctatagaagttttgcattatttttgtgttttctgtaggaattacaatataattactgatcttttcacagtctagttagagttaacacatttgcagccacaacattttaatatttttatcatgtagagttcaactacatatattgaaaactccaaagactgtggtataatattcttatttaaacatttatgtattttaaacacatttaaacagtaaagtagacttatattttcccagattcttatcattcccagtggtctttattaattcaccaagattccaagtttttatctggcatcatttctctcagcctgaagaccatccttcagaatttctggccgtgtgcatttaccgatgatgaattcttttgcatttctttgaaatctgaaaatgtgtttatttgtgattctggaagaacagttttcttgactatagagttctgtgtaatttttttcttcagtactacaaagatgttctactatctttttgttttcatagtttctgagaagacatccataatcatttgaatcactgttccctttgtgtaacatatcctttttttccgtgcatttcttcaagattttctctttatctgtatgagcaatatacggttaagtttgagctttgcttgtcgagactgtaaatttatacttttccacaaatttaagaatgtttccgtcattatttcttcaaacggtttttctgcccccttctctctgttatctctccgagtccagaatggcccaaagttaaattttttcatcttatgcacaagctctgttcttttgttttcaaacttttaattttttcttctttatattgaatttctattgatctattttatattaatttactctttcctttgttatttctattccatgagtaagcctaggttagttctttttatttcaatggatttttttaactctaaaatttacatttgttgtgcttatcttttcactcattataagaaatttttccttatctctttgaacataattacaacagcttcttttaaagtccttgagtggtaaatccaatgtctgccccatcttgggcttgccatttgatgatcatcttctccttgagaattgatcacatattctttcttcttgttataccaaataattttggactataatcctgatattgtgaatgccatggtttggaaattttgagctctactatattgatacaaaagtgctgatgactttgttttaatagacaattaacttagttagactcacactgaaagcatttttgtctctgctttatggcaagcccaattttgattcaggattctttcactcagcctcgtgcatcatgattgggaaattagccagataattggtcagaatttacatacagaatttggaaataggaaaggaagagaaagtccagcttttatcaatcatccttaagatttggttatgtattaaaatgaaaattccatgcactgcacataagtctcacataccactagacaaaactatgtctgaacctggatgtaaaagtagaaggataccagatccatttgggctaatctggggaagggaacacaatgtgctttcatagtttcttattttaaagaaagtcacaaaactgtcacaataaaaacccctataccttttacctatattctatcatagttaatatttttaattttatcctctttccctaaataatatcatgcataagaattttgctgaaatatttgagaataaactgctgacatcatgacttaaatacttcaacacatatcttctaaaaacaaaaaattcttttgcatagctatcatgcaaatataaaatttggtaaattttatatagatacaatattgcactttaatttccagtctatattcagagtttatcagtcctcacaattgtatcatttatggctgtctcctgtgtcttgattccctgcttacttgagtgcaaccgttaatgatagtactaagaaacaaaaataaattctggacaaatactaaactagattcaaccccaagaaccaggactatgctctaataaaatcaaaatagctctttacttgattcattcacctctcagttattctgccatcccccactgcatcctgcttacttcaagtaatttgcttttttaatcttcagaccttgatttaacaattcatttcatggtcgctgcttatgctcttcttcctagatcaccgagattagactttcagatcagtacttcactctactggtttagatccccacatcttctgagaaggtttggctctgaattttagcttctcaggaagttcagagatctattttttagtaagaattatttcactgttatgaaatgctcttttatttcttcaaagggacacatccatcaatatcttaattatttaatttcatgttttaatttttattttaattgacaagtacttatcaatttcatgttttaaattttatttttaaaaaattaaaattaaaacataaaattaaaattaaaatacttctacatattcatgggcacatagtgatgtttcaatacatataatggatgggggtctaatctggagagttttgtatcctcttaagaggttgttgatcataaacaggagtttctcacacagtaaatttataatatagtattcattaacatctttttctcatttccaagtttatagtccaaggatgagttcttcattgtaacaaatgtaacttgtgttaaaaattgtgatctattctacctgtgtgtagatattatatcctcccacagtctagcaaaccaaagctaccagagtgttatggaccccaaatgtattctctaatattatttaggtaagttgatttaacctatgtcttcattcaggcaaatcaaatatatttctcaagaggcaaaattagttcttctgaaacctcactaaacatgggggccttcaggtgatcaaggtataattttacataaaagaattttcaggaaaatcctccaacgtgccttggtattatctattatgctactatacattcttgtgatgttactatgtattacattcttacttatatttcttacatgatatgccttagtttagcatttcttaagtttaagaacataagcagttctatagtacattacatgaaatatgaatagggaccatatttaatgatataactaagggacatagtttttttgttgggatcacaagtattagaatccagattccctgatttcaagtctgttttaatctcctatcagcttaaacatcacaacggtgactgtatagtatctctgactgaaaatgatggagacgtttcatttcattatttcatttgtcggattttttccgtgactttttctgacacttgtttcttgcacaactcccttccttccttccttccttcattccttccctccctccctccctgcctctttctttctttctttctttctttctttctttctttctttctttctttctttctttctttttctttctttctttctttctttttctttctttccttctttctgtctttctctctctctctctcttccttcctttctttttttcattctttctttctttctctttccttctttctttctttctctccttttctttttccatccgcctgtcttgctttgatgtaattaccggaaacaaagttctttcttttcttttaaattcttttcttttttttccttttttcttttatttatttatttatttattattattatactttaagttttagggtacatgtgcacaatgtgcaggttagttacatatgtatacatgtgccatgctggtgagctgcacccactaactcgtcatctagcattaggtatatctcccaatgctatccctcccccctccccccaccccacaacagtccccagagtgtgatgttccccttcctgtgtccatgtgttctcattgttcaattcccacctatgagtgagaatatgcggtgtttggtgttttgttcttgcgatagtttactgagaatgatgatttccaatttcatccatgtccctacaaaggacgtgaactcatcattttttatggctgcatagtattccatggtgtatatgtgccacattttcttaatccagtctatcattgttggacatttgggttggttctaagtctttactattgtgaataatgccgcaataaacatacgtgtgcatgtgtctttatagcagcatgatttatagtcttttgggtatatacccagtaatgggatggctaggtcaaatggtatttctagttctagatccctgaggaatcgccacactgacttccacaatggttgaactagtttacagtcccaacagtgtaaaagtgttcctatttctccatatcctctccagtacctgttgtttcctgactttttaatgattgccattctaactggtgtgagatggtatctcattgtggttttgatttgtatttctctgatggccagtgatggtgagcattttttcatgtgctttttggctgcataaatgtcttcttttgagaagtgtctgttcatgtctttcgcccactttttgacggagttgtttgtttttttcttgtaaatttgtttgagttcattgtagattctggatattagccctttgtcagatgagtaggttgcaaaaattttctcccattttgtaggttgccttttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgattaagtctttaatccatcttgaattgatttttgtataaggtgtaaggaagggatccagtttcagctttctacatatggctagccagttttcccagcaccatttattaaatagggaatcctttctccattgcttgtttttctcaagtttgtcaaagatcagatagttgtagatatgtggcattatttctgagggctctgttctgttccattgatctatatctctgttttggcaccagtaccatgctcttttggttactgtagccttgtagtacagtttgaagtcaggtagttgtgatgcctccagctttgttcttttggcttaggattgacttggtgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgtttttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacaacaaagttcttttaaaagaattattccagacaaagagcaagagtacaatgtgtatcttccaggatacttgcccattggtttatatatgttcttatgtttgtggagaatatctttcttgtgagttctttatgatgatcaataggtagaataaactgtgactaagaaatttgttttggccaggagtggtggctcaagcctgtaatcccagcactttgggaggccgcagcaagtggatcgcttgagtttaggagttcgagactggcctgggcaacatgatggaaccccatctctacaaaaaattagctggttgtggtggttcgcatttgtagtcctagctactttgaaggctgaggtgggaggatggtttgagcctgggaggtgggggttgcagtgagctgagattgtgccactgcattccagcctgggcaacagagccagactctatctcaaaataaataaataaataataaaatgaaattattctaataacataaattaggatctaaatccataaaattgtaatcacagagttatgctgttacagagtccacacaatgcagatcctccaaataaaaaacaaaaggctttaccaatgtttcttagcctcatccatacctcctttatcctagaaatttgcctcatgctcatttccattttagcccagtgtcttcagttgttcacgcattcatttagtgagttaatcagccaaagtgtcaaacactaaaataaaataacatttattttacagatgctgataaagattctactgtatgtcagaatccatgttagatactggggatacgaagagaaatcaaacaggatcccatccccagaaaggagacagacaaagaaactgatggttgaaacggcaaatgtggagagttgttcagggtgccataggagcacatataggtaaacttaacctagggatactgcaggcaggattggaagtgagaagtaacacttgagtggtcttgataaacgagtaagaaattagtttggtgaggaaagctagatcgctcatggggaaaacagcttgtttttcaggagcatgaaaaccccagagaacagggatacaaagtagtcccatggaggggtgtgggtgttgccaaaaaatacaatgaatgtaataaaccagggtcaaacatgaacgatattcaaagaaactggacttcatcttaagcaacagaatgtcaaaataatctataagtagattattctttatgatcagccagttatttaggtagaaaagagccagcactgactcacaggtttctgatgtagacaacagatatggtttggaagacaagatgttgggtacaagtttgtttatactaacttgaggtgaaaatttgtttgttctgagcctttttctggatggaacataaagttttcttaaatattttttattttgttgtagtggtgacctcatgattgtcttctcatatctttcccagctcattggagttttaggttgtgctgtatcattccttaatagaataaaggttgtttgaagaatttgagtcaaaacacgaactacatgaattttcaatggagggggaatgaaaaccaagtgaaagattttcaggatgggaagcactgttttgatagtgatatctaggactgctttattaatgaaaatatgtatcaagtgttgtgtgtgtgtgtgtgtgtgtgtgtgtatgtctatgtgtgtcattcaggtgctggaaacacagtggtgggaaatgattcttgctttcatggagcttacagtagagtggagaaatagaccttaaccatatgtttatgtaaatacagtctatcctcattatttgcagattctgtatttgcaaatttgtgagtgctaacatttatttataatcccaagatcaatactcactgaacttttacaattattcacgggcatgtacagaggggcaaaaaatgttggtggctgccgtgcacactccaggctgatgtcaaacaaggtgacactctgagtaagcattttgtttcagctctgtgcaaaccaatgttctttttgtggcctattttgtgttgcatttgttttgcattttgtgctttttttggtgattttgttgcttaaaacagtgcccaaccctagggctggagtgctgtctagtgtttctaagcacaagaaggccatgttgtaccttagggagaaaatgcatgtgttaggtaagctttgttcaggcatgagttataagcaccaatgtgagctcaatgtcagtgaatcaccagtacatattaaataaggtggtaacaagcagagcaagtgtagatgttgtccagaaacacatacaaaacaaggttatatattgatcaattctcaaaaatgtgaccagaggctcccaggaaactaactctgtatttctcctaggaacaattattcagtattcactaactcagtgttggtggcaacttcatagaccataactaccatggataatgagaactgactatacatataaaattacaattaaggtaagtgcttttcagaataagcggttggtattaggtaagtgtatgtttttgtttatggagaaggcagatatagcattgagttaggttgtccgggaacatattcctgaggatatggtgtggtgttagagtataaaagtagaatagggtttaataagattaaaacagagtggatgtgtcatcccagacctatggaacagactccttggtgagaaagcatggtttttatcaaggacctgaaagaagccagtgtcactagagcttagcattgagccataatcatcaagagaggtctagattatacaaaaccttataaatactcagtctaaatactaaaaagccattgagaggggcaactggtggcaatgataaaaataaaaagtagtttttatttttgaaaaacatttatctagcaaagaataactcagagatgacagcttagacaactgcaaaggcagaagacagaaagggaggagattaaacctgtatttaaggccatctaaggaaactgaaaggtgtttctgtgactggacagacagtagctaaagataaaataaggccagtaactaaatttaacagtttgactcaaggtgacaaagtggcagcctattctaacacgaatgagaagaacaaagataaatcacttttcatattttaatctcatttggtgaaaaatccactttatattcaaaaagtaggaacccatttttcttttttcaggagtgaaatgagggttaatccacaggagaataaacaattgtggcctcatagcatacgagattacttttctttcatggatagaatataattaaatgcaagcagtttttaatggaaagagtggaaaacttttatttgcctaatttgtggaggtagcaattattgttggtttaatcctattttaggatattatatgcatattatctcttcttttttattttttttcagaaagacaaataccttcttcagtaccttatttttatttttgctttctgagattcttggttatatgttatggcttttaaataaatatttgtatgattcagaacaggtcacttttttgactcagaaactaatcatctgagaatggtttttgaaaatcatggatttatatagtcagaaagttctttaaagattaccaaaggcatatcttcaattttagagaggagtaaagtgaagcccaaagcgatgaagtgactttgaatcattgatttgtagcattcctttaaccagaccatgtacctccatattgcacaactcctgcagggtacagcctctgagctcctgcaaagctgccctgtgggacttcaggttcctgcttctgagaccagggcacttctacaataggtggttttcaagagccaccttattaagttaaagcacccaactgagtcattatcctcacaaaaatccataatgtaatatttgctttacgctttgtgagatcagcacttagatatatacatgctgatgattctcagtatgtatacaaaggcagttttctgaaaactactaaatttctgagccgtaaaataaacaagcagagtaagtgtcagtggccattaattatctgaagtcctgtgaaacttcgacatgttttaaatctctgcttttagaaatttctgagttttaaatttcatgcttcagccatgccggtgatgagaaaaggaggctctgctttttgtcgtggtgtgatggatgctgacttcctagagtgcagaaggtgttttttttttttcagagaagaggcaattatttgcataatagtctttgccaagcactctgccttcctttgagatgaagaacatttcaaatattgtacaattaactgtcatcagctactgtgttgtgattcactctctctgaaagaatatataacaaggacatggaaataattcccgaaacaattcacaggtttgagatgcaataagaaattcaagtatcagtcccaaagtggcaagcagaactttagactttgttaactgaaaaagtaagtgattcatagagttggggaaagttattttagaaaaaaatgaaagcaagagaaaggaggcaagtatactattttcttcatctttacagatgacacagttggatatcagttataccagttttgtttttgctttgcctcagaaatcttcaataccaacactttaaaaaagcctaaaagtcaacttggaaggagctatttaaatagagctactaagtccagaggcaagtcagatttcatgtgaagtttatagtttttctttgctggttggattttccaatcacatgctatgtttataacagcctttaaactgctgtatttcaggttccttcaggtcgtctacttcaaatcttccatgtttgtccctgaaacttagttctcatgtgtggttggagtatttggccacctctgtggtatcatttgaaaaaaatggaaaaatacatgaaattttgatatatcccaattaggcctggagtttatatgccataagattcactcttagagagcgtatttaaattaaaagcattttctacatatcccgtagacatacacccaagagggaagtatcttaaccatggataatcaataatgcctaaatatgcactaatttatcaactaccctttacagggacattcagtgaaaaaagaaactaaattatccagaaatcacttctttacctctaatttatccatcttaatggcaataatgctgccatgtctttttgtctctgttcctcccacagtataattgtaggtttttctccaaactaatgtatcataatgtgttttcaaacaacataaatcttgtctttagcagtgaatataattaagtagaattactttccataagctgatatcactgaatgtaaagacaatgacaaaatactttctatgttgaactaaccatgcgtggatcttataaaacacttttctctggatatccgtggtgtcttttggccctaagtaagttaaaaagggacttttgatcttctcctttagcctataaactttccacaggtggagactctgcagattactgaattaactcatttacactttaatatttaaaatgttaataaagtattggatgaacatggctaaaagatcaaatagtagagaaaggcatatctgttagtaatgtttacaaatatgagtaacacaaaaccaactaactacaagaggtttaaaccatggagatgttcttttattttcttcttatattgaggactcaagataggtaagtgtgaggttggactggtgactgtacacagccatcaggcccagattctctttctgctgtgacatacccatcatgtcatcatttgtcatcatgtccttcacttattgtaaaaagtgacctttaggctggacgcagtggctcatgcctgtaatcccaacactttgggaggctgaggcaggcggatcacaaggtcaggagatcgagacagtcttggccaacatggtgaaaccccgactctactaaaaatacaaaaaattagccaggcatggtggcacgtgcctgtaatcccagctacttgggaggctgaggcaggggaatcgcttgaacttgggaggtggaggttgcagtgagctgagattgcgccactgcactccagcctggcgacagagcaagactccatctcaaaaaaaaaaaaaaaaaaaaaaaaagtgacctttaatgcctacagctaaaattcctaggtcatttagggtcagctattctttctatggattctatattgcagaattccaaaaatctatgtctttatccaaccaagaaaggcaatgaaataatattgggatataagaagggtttgagaaaggaagaagcataatgcgctaaatttctctcatacatctgttgttaaactctgtgaaatatttgaaaagatttattctgagccagatgtaagtgaccatggcccatgatacatcctcaggcagtctggacaacttgtgcccaaggtggttaggctaccacttggttttatatgttttagggagacatgagacatcaatcaaatacacttaagctatacattgctttggtccagagaagtgggacatcttgaagtaggcattccaggttatagttaaatttaaaaattttctgactggcattggttgaaagagttattagaaatagaaaggaatatctgggttatgataagatgttggggagaccaaagttttatcttgctgatgaagcctccaggtagctaccttcagagagaatagaatgtaaatatttcttatcagacttaaaggctgggttgatgtcaaattgctggtctgctattcctgaattacaaaagggaagacagcataatggggcatgtccagctccccgcttcctgtcatgacctgaacccgtctttcacgttaaatctggagggccctggtccattatgggtccatttagatggctgcagggcaagtggaagggcttcaaattttatttttggtttacaacccccagaccaacaatttccacttcccattataaaataagatccatccacaacctgattcgtctgtaaattattttgattttgccttcttctctattaacaaaaatgacatttttataacaaataatgtaaccacccacggggttcttcttgcccaccgtatgtaaaataaagaccatggcactgcagtaggaaagagtttaatagacataaggctggccaagccatgtcggaaatagagctagtactcaaatcatctcttccaaagctcttaggttaggtgtttttcaaactcaatttggggaaaggggtgggggtagcttggcttgctactgattgattagggcagagatgaaatcatagtgggtcaaagctgtccttttgtgggctgaatagcttctaagtggggccacgagagcagagttggtggtccaggtggagccatgggtgtgagacatgcaaaaaacctgaaagacgtctcaaaaggccaatttacaatagtgtgttgtctgcaggaataactggggaagttgcatttcttatagcctctggaataacggctgacaatctttcctgcctgtgccttagcaggactcaggttcctctcctgcccgcggcctgatgacctcctattctcttttaacaagctggtgagttttgggtaaagcctatttatcatttaaactatagcctaaatgtcttccaaggttagctcagcccagtagcctaggattaattaagggaaaggcaagatgtggggtgggttagctcaaatctcattcacagtcataattttctcagtgatatcatttttgcaatggcagtttaataaggacatgcctgaagcacagtaagatccacattcctcgcaaagtctagctcatcctggtgtgtcttataataggactgttgttaatattacactgactgctttctctcagctccaccttgctcagccacaggcttcctcacttgggcactcgggacatgcccagggtcttcggtttgctttttcttcagactatcttgttcttccccattgacatttcaattgctattctctcacttccttcaggccattattcaaatgttgtttctcaggctttgcctggctgccctttctacaattgccacacccccaaactcagcgctttccatcattcttcttcccttgatttattaggcaatatactgaattcttcatatttacattttttcacctaattttttttttttttgagggatgggatttttgcctctgcattcagtgtggtaactctggtacgaaaacagtttctggaacttgggaaatatgtattcaatttcttcaatgaataaaggtagcctgagggatggaggggttgggaaaactgagctttgtttcaggatctcagatggaaagctaggtgaaggtggcagagcaaccaagatctgttgctgtttgtcctacatgtggtttccctttttctcgttttctatctggaattgactattgatgtttcatattttttttctttccactgttgagtattatgtgtgtttaggggaggcttagatttattttggataaaaaaaaatagccaggattatttgctatggagccactgtctcacaagctgaattatgtgggccagagggaaaggggagctggctttgctgtccttcatctttcctgtttccctacccagcttctgccactgtctactcaaaatagaagctaatatgagcaatgtcagagcttcctccatgaaactcaatgaaatgattttaataatgagatcaacggcaagctttagaagagaaggtgcatatattcttgataatgttaaaccaagtttagcctaaagctgcctggtatggttaggctttgtgttctcacccaaatctcaccccaaattgtaatccccataatccccacatgtcaaggatgggactaggtggaggtaattgaatcatgggggcggtttcccccctggtgttctcatgatactgagtgagttctcatgagatctgattaagcatctggcattttccctgctatgtgcttccttaaagtgtttgattatgtcacatttagcataagtgactctattttgttttggtctggtctgttggggcctggtgcatgaactcagaccaaaacaatggcctcccataatttgcttaaaaactgccccattttggtcaggttcttacttaggtgagagtgtgaccaaaacttaggaccttagcaccactctctgttaccatcattttgcgtttctggtctcagcatgtaattcacaggttatatgcccttatggtcacacatttctttcagctcttgttactccagttgaagagagaccatttgacattctagagatggctgcatgcaaacatttaaaatttttgagagaatacagtgcaccaggaagactactattacgactatcaggagaataataccaagagtttgcagtatgttctttagccagggttgccttaaaccaaaccaagagaaatcaaatagatcaaagaatgaactagacaaagaatcaactcactttaagtagtctctttgttaatcgcctataactgattctttatactatcccatgtgatgaatttctccatggggaacaagaagtgccagatacttctctgtttagccagtaagtagcttagagcaattctattatttagcataactttcacaagataatttcaagtctgttgtgtagtcacagcctttatactaggatctgctacagagtctatcatgagggataaatcgccttatttactccaatacgtggaaaaaaggacctaacaaatgaagccattctagaagagtgaagatcctctggcaatattgtctttaacccatgatgtaggttaagaggagtggaccaatgttctgtttctgactgactatgaagctatatatgtaccattaaaatttctcacatacattgggtcttcatcttccatctatcaaggtgtaaggttatccatgtataagactggttgcaaaatccttcacaaataaaattataaccctatgagtgcatacaaccaatccccttttcacttttattgttcatagaggcataaacaaaggaaaaaaaatgaaagataagtgtcgtatgatagtagagaagtcttgctccatgatcgtcagaaaaagttgtttacgtcatggatgccatcttcttttggggagaaacttccctggttagctttaccttaaggtttccaatagctgtacagttccaacagtgtggagggacccttctgagttgtgagattatgaacacaaggttaaagatcccaaagtattgcttcaatgtggatagccagggcaatctttctgtgatgttctcagaagagccagtctttgggttctagattgagaagtggttgattgttctcagtcagtgaaccatgaaaaactttctttacctggtgaaaatacactgtggcataatgagctactattacaacttcagccctctttcatgagaaagctttttttttttttttttttgatggactcttgccctgtcgcccaggctggagtgcagtggcgtgatcttggctcactgcaagctccgcctcccaggttcacgccattctcctgcttcagcctcctgagtagctgggactacaggtgcccgccaccacgcccggataattttttttgtatttttagtagagatggggtttcaccgtgttagccaggatgatctcaatctcctgacctggtgacccgcccgcctccgcctcccaaagtgctgggattacaggcgtgagccaccacacctggctgagaaagcttttatacaacaagaaaacatgcattgaaaatgacaattgaaaaaaatccgtctataaatgattaaatggcccatcaggtagcagaattcacctgaagttttgattttcctctcaggaatatgagtttgacaagccaaactttggtcataaactattttagcaatttaaaagtctgaactccaaatatctgagatagatctcagtcaatttaggaagtttatttcatcataattaaggttttgaacgtgtccagaggaggtcctgatgacatgtagccaagctggtcgggtcacagcttggttttacacattttagggagacatgagacatcaatcaatatatgtaagatgtacattggttccatccagaaaggtgaggacaactcgaagcggagaggcggcttccaggtcataggtagataagagacaaactgttgcatatgtttgagtttctgatgagcctttccaaaggtggcaatcagatatgcatttatatcagtgagcagaggggtgactttgcgttctgcctgtcctttgtcaacaaggaaattccttgtgaggtaggtatatagctttttcatcttagtagtttttgtttgtttgtttgtttgtgtttttggaatagaatgggaggcaggtttgccctaaacagttcccagcttgacttttccctttggtttagtgattttggggtcccaagatttattttctttttacagaagtcaccacaccaatatatatatttaatctggattattttatgtttctatgacgagccataaaatgcagaacttttaataacaaaagctttaaggactcaggaaagacaacgcagccatcctgattttcaatgcgcccatgcttaacattggacttatattctcttgaataccagctgtttctccaatttaggtggagaacactgttaactgatgatttagcataggtaatttgacttaaaccatggaatttattcaaattgtatatatttagcatggaaatctgtcaaagtattttcttgctattcagttaaatttgtcctgcttggtttaccagctttataaaccaatcagtctcttcattaaagttccaggaattcttacccagtctaaacgatatgattctaaagttattagaaacctttactgaagagtgcttctcagggtactttcatcctctcattaacctccttaaagatactatattctaggattttgcatgcttgtgaagttttcagaaactgaatcacaattaagttatgaactgtggaaatgactataaataatcagttaaagacatagttgacaaggaaatttggttatttttgtggtctccagtaacttaacatagtcaccataattacgatcgttagcacatagtgagacatattagaagtttagaaatcccatacaattttggaacatatattaataacaatcatcaatatataacctgacatatttgtcaaatatgtcaaaggtttaaaacatttgatcaaaataggatcacaggttactgtaaaacaatagccattcattcagtcacagtgataattgatttttttaaacaaaaacttgtattctttgataaaggagactcagacagttttccaaacaatcaaaagaccttttgatttttcctttttatctttttttctttttgcaatttacacaaaaggttaataaaaatattttactctttttaacactacacataatttttgttcaaaagagaaaatcaagttttacctgtgtattagcatattattaatactaaaactaattttaatacaacctcattaattaagttaacaaagctgccatctttcaaccacacaatagttccataaaccctttgttttacagttttatccaactttttatattcatcttgcttcatctattttttcactccttcagtttgaaacctttaagttacttcaaaccagacaaaatttttaacacacatttttatgccttcataactttcctcttcaaacacatatcttgcttttgttcatatactttgtgtatacaaaagtgtttctctcatatctggtagtgttacaggaaaggggtcttaatctagaccccaagagagggttcttggatctcgtgcaagaaatatttcaggctaagttcatacagtaaagtgaaagcaaatttattaggaaagtaaaggaataaaagaatgactgctccacagacagaacagccctgagggctgctggttgcccattttttatgattatttcttgatgatatgctaaacaagggatggattattcatgcttcctccttttagaccatatagggtaacttcctcatgttgctatggcatttgtaagctattatggcactgatgggagtgtagcaatgagggcaagcagaggttactctcattgccatcttggttttggtgggttttagccagcttctttactgcaacctgtttaatcagcaaggtctttatgacctgtatcttgtgccaacctcgtatctcatcacgtgacttagaatgccttaactgtctgcgaatgcaacccaataggtctcagcctcattttaccaagcccctcctcaagatggagttgctctgactcaaatgcttctgacatttccctgctcccttttataagagaacccttaatcctaagggttgcagagggatgaagttccatcttctgtaacttcatcaggctgaataggggtaatgatattcctgcctatctattatgggtattttattcctgcctctcatattcagggtagcgaggagcttagtcacaagtcatcagtatggtgagggccattcaaaatccaagtttcaacaaaaggcactatctgaaagattaataagtgttcaatttaagaagatattcagtaagcttattctgcatttttacacaaagagtacaacagcaatatattttaaaacagtaaaacaaaataagtaaaatttctcaagtaaactgaattagaaggctttccatgaattggtaactgttggaaccaagctgatatggggttgctagctgattctaatgggcccagaattagaagactgatttagatttttacattacccatccctcttgtttcttctgagcagcagtcaatcactggttgggtcataggaataaccaggattagcctaaactgcagaaacaaacttaaaaacaactgatgagactagaatttaatagcaggtgtacatcattcttgaaacataatatttcactctccagtttcccatttttactaaagataaatcatggtaagactgatttgctttattatacttggcctgattatttgtataaagtgcagcaagaataattattttttacatagactttataagttggcctgttggaactttgttccataaggaatctcagataagactttttttagagctgagtcctgccattggtttgaaccctcaaatacctacaagttgagcaaatctctctcctcttggggttccaagataacctgggggttcctgggcctgttagaaagtgacattctttacttatcacagggcagaaaccctgtacagggactgtgtaggcaaggtatgaggccagttccccaagtggctttcattggctctacaagtcaaatttgattccttaaaggaaagcatgccattccagttaaagtctccataaaataaccagtttctccagtttgtgtcctgatgcaaaataaaacagatttgtattgcacttaagcaaataaccatattcccataaattaggaatactcacaaatagtttccaaattttggagaaagtaggcagagagaaacaaatatccttcacattttgttcacaggagtatactcaattgttaaaagctgtaaatagcttctattacttcagtccatgcagttaactcctgtcctgcttgattcatgaacattcagctacgagagttctgaaaggtttttttctctatctaatgtcacaatctccaaagttatcagaaaatcctccatttaaatgtacctgttgaagtcctatagttgattataaaaccaccttttaaagaggaccaaaacaagacaacaattgtgtgtggattataaaaagtcttaggacagccactattaaagccacaaacgataaggaaatttggttattagtgtggcatacaaaaatttatgtaacaattgtatttattaataacatacactaagtcatatcagaattataggagtttcccattattttggatcacataccaataacatatttatgcaaatatagcccaaagaaagccaaacaccatttcatatttggcagtgcttcctgtaagatttttatacccaataaggcaaatttcatctctacactaatgtgctatttgtgttaaacccaaatcttaataaaaccttatagacaaatgtatttaatcttaatcagcttgaccatgaggtaagattttaataaatcttttataatcctttaaaaatgtttgttaaacagcagattacaagcaggtgttagctctaagaaaaacctgttgtgcttttattccaatgtccgatttatcaaaaaactgaataatagccctttaattttagccaatatgttcacacagataatttcttctttaagattaatatttcacagacctttaacaacttgcttaaaccttcagctttatcctaacttaaaacaatcctttaactctctaaacttaggcaagaaatctgtattcccatgttttcttgtaatcttttaccgaaagcacattctacttttcttacacaccttgaacataaaactgtttcttcagtagtctcaattatatgttacaatgtcaactctttttctttttctttgagatgtagtctggctctcttgccaggctggaatgcatacaatgttaactcttagcaacttttatttttagtgaaaaacctggttagtaagttattctaattatgtaccaggtgtggagcctaggacccagacagaagtgcagataaggtttgattctttccagcatagctagtgagtgtggctagttccacatgtttccaggccttatctagaatctaaagctccaaagtaggtaaaatgaacaattttcaaaagtcaaagaagcagtttatgaccttaaagcacttggaaaacctaatatctgacccacataatttagaccaaatgtttacattttaaagatatttttattttaccaataactttaaaactgtctttattttccaaagattacttaagtcatgtgaactaaataaaaagtattcatgttatacttttctgatcaaatatttgatgtaagctcctattattaaaccatttaattaaagctcttttatattacacccacaacatatataaatacatagataaaataagataaaggattcattccctaagccaggaattgaaccctgatcctgggccgccactgtgaaaagagaaatcatcaccacatggttacaaggtcaggctccccaagacatacaagacaagagggatatctcacccagttttgtgtttagggacctgcagcaaaatttatacctgaccagtttcctgggccatcttgaacagtgggcttacaggtgtcctaagcccatgttccatcctacaatacccctctttatgggagaacaatacggaaagacacacaaagcacaccagattcactatagcttacaactagcctcacaagtccttttttccattaatctaaactttacagaggagataaacaatggtttttgccattcattcagccagtttgcacacacacaaaaagagagagagagatgagacagagagagaggaagcattgcttgaggcagggtggggaaggcgaggtactcagggaggccagagaaagacccacccattgcagtgacactgaaaagttcaggcggctgcttgtcagtagcaaagggatattttccagcagtctcatcagctcttgagtttccccttttagggaggaaaaagctccccgtgtcccatgatcctatatgtgcctaatcctgtcacccacagccctgagcaaagagttcaaggcagattaatccaaagagaatagcacttaacatttcataatactaaacccattcttagccaaaaggtactttactgaaaggggcttctaaccccctaaatcttaaaagggactctaaccctcctaagctgggcctttaacccaagatgggtcaagtgtccttgacttttatcaagagtggcctctaacccactctgtctaaggagagactctaactcccctaagttgggcctctaacccaattccatgctttacctgggtaccccaccacttacccaaagttggccaatcagtgctgtagtctatttcctttgggtgggagggtttcttcagtatcgtcccttcagagttcaccagaaagatgttactggcccctaccacttaccgaaagttagcctttgggtgggggttttctgcactatagtcccttcagtggtcaccagaaagatgctacaggaaaggagtcccaattcagaccccaacagaaggtttttggatcttctgcaagaaataattcaggccaagtctgtggaagaaagtgaaagcaagtttattaggaaagtaaaggaataaaaaatggctactccacagacagagcagtcccgagggctgctggttgcccatttttatggttatttattgatattttaacaaggggtagattattcttgcctcccctttttagatcatatagagtaacttcctgacgttgccatggcatttgtaaagtgtcatggtgctaatgggagtgtagcagtgaggacgaccagagatcactctcatcaccatcttggttttggtgggtcttagccagcttctttactgaaacctgttttatcagcaaggtctttaagacctggatcttgtgccaacctcctctttcatcctgtgactgagaataccttaactttctgggaatgcagcccagtaggttttagcctcattttaccaagcccttattcaagatggagttgctcaggttcaaacacctctaacagtagtttttaactcttagtaacccttatttctagtgaaaactctagaaagtaattttgaactgttttatatcagttatttgtagataaaaaccattttataattttttagaaagatagttcttcaaattattcttattatcagatctaaatatatttacttttctatactacatagaaataatatgccaaggtatatagacttaaatgcatgtttaataatgcatatttcagtatcttgaacatgactcatcttgtgatttttttattaattaatttaacataacatgactctaggattttaaattactgaaaagaatttttgaagctattaacagaggcagcctccctaatgtctcctcccagtcattctaggtcccaagaagccatgtgtcccccatgaggactatgaaggtcagggcctgagtctatcaggacagaagccagagctgtgaagactatacttggaggatccaactactcccacaatagccaggaggcaaaacagggaaagcagaggaagaaggggccatatcgggcttgtagctggtggtctagacactacgaacgtgtctctagatatcatcatggccacctatccagatgcctcaatccagagactctaagccgaagacataagctcacagtcaaatcaagtgagtatctaactatatttaactgataattatcaagccatttctattttaccaacaaattaaaaactagctttatttatcaaatatcacatacacataacacatacacatacaaacaagcagaagcagatcttatagctttttccagattttaaatagtttttattttctctatttggtgtatcagtctttcaattatctgtttcatttccctaagcaattgttaactaggcaacaaatttgcatttataaagggacaactcttaggtgaaacaaaaaacatgtatatttcataagcacagagctaagattctcggcctaggtattgattcatcatttgctcaaaccaagggaaaagaaaaactgctcaagtaaaagttcacttaagatagccagaaaagttcgttaaacaaaggcattacttattacttagatttaaaagaatggttagaatttctattgtacttaggcagacatccttaaaaattgagatttcttttatagatgtaaatttcttttacaaaagagtttcaaagtagccaattaaattccagaaaggtgcattttatttcaatatggtgttctttttaacatagccactgtttcttagttaaaattactgagttcagcgtggaacccattagggaatagagtcaagaaagcatcctctatgccttgtctcccccatggataggtctgaacaagaagcaaacctattttacctgagggcctaacttttaaaaatatcttatctaggatagctttcttgccacctttagggtggaacagtggctaagcaaaggttagcagttttaatttttcttatctattagtttcttaagctttttatttgccttttgtaaaatctttaaataaaaatattgaaatctttttagaagcttctgcatatcaataggtacccctggatgagactaattcatctgggagtcctcactttcaaatgcatttcttcagtgcagtgttatttggaaccttgcatagtaacttatctttagtaagatttcaccagttctataagactttgctgcttctgaggtctaatacttatgcattgtgaaaggaaaataaatattgggccccccaagtcactaagctaaagggaagagtcaagctgggaactgcttagggcaaacctgcctctcattctatttaaagtcactccaaagctcactgaactaaatgcatatctgattgcctcctttggagaggctaatcagaaactcaaaagagtgcaaccatttgttttttatctatctatgacctggaagctccctcctggctttgagttgtcttgtctttccagagttaaccaatgttcatcttatatatgttgattgatgtctcatgtctccctaaaatgtatgaaaccaaactgtgctctgaccaccttgggcaaatgttgtcaggacctcctgaggctgtgtcacgggtctgcatcctcaaccttggcaaaattaactttttctaaatcaactgagacctgtctcagatattgtgggttcacagcatgtataagccagaaggtactcagttcttccaaaactaagggttctatctttacctgaaatattggctttggatatcagtttcccttaatcaacttggctaataatttttttcctatataagcatgcaagaaaaatgaaacaaagaggagaacagaaaaatccccatgaattttcaaaagtcatattttacaccccctgcaatattgccatttactaccagtttctttctgaccgagtcagacataagaggcctataactggatccaagccagttaattatcagattcaatctcatcctggacctagtcagtttctattgtgacttccaaacccagtttggctcagaaatttgctcgaagacattggagaccccaaaacacaaatccgtggagcttcagaatctaaaagagaacttgccgtgatccccagtcgctatgagagggaaatggccacaatggtgtggacaaaaagagtcaaactctgtaaaatattctaagagatttattctgagccaaatatgagtgaccacggcccatgacacagccctcaggaggtcctgagaacatgtgctcaaggtggtcagggtacagcttggttttatgtactttagggaggcacgaggcatcaattaaatacatttaagaaatacattggtttggttcagaaaggtgggacaactcaaagcagggagcttccaggctacaggtaaatttaaacattttctggttgacaattggttgagtttatttgaagacctgggatcaacagaaagaaaatgtttaggttaagttgaaggagtggccaggtgcggtggctcatgcctgtaatcccagcactttgggaggctgaggtgggtggatcacctgaggtcaggagtttgagaccagcctgaccaacatggtgaaaccccatctctactaaaaatacaaaattagctgggcctggtggcacatgcctgtaatcccagctactcaggaggctgaggaaggagaattgcttgaacctgggaggtggaggttgcagtgagctgagatcgcgccatgcacttcagcctaggcaaaaagggtgaaactcttatctcaaaaaaaagaaaggtaaaggattgtggagatcaagttttactgtgcagcgggagttctcggatagctgacttcagagagagcaggttgtaaaacgtttcttatcggatttaaaaggatgcctgtctcttagttgattattccctggatctggaaagcaaggaaggggaaaaaaaggcgaggtggcagagaaggggattctctgtagaatgtggatttttcctacaagggatagctttgcagggccatttcaagatatgtcagagaaacatgttttggagtaaagtattttgattttcttccttgttatgccagagtcagattggaaagtaagtcatgatatacagagttaaataaaccccatctgatgagaatttatggtttgtagggcctgactccccagaccacttagataggaatttgagcaacataaaaaaaaaaaaacagagtttagtccttgttggtgggtatctcgcttagtcactcagccctcctgggggtcattagatgctctactttggagcccacttctgatgccatctattaaatgaaaaaacttcaggtgaattaaatttaagacttttatttagcaaggaacgatctgcgaatcaggcagcctcctgagccagtgtaggctcggagactccagcccagccacgtggtggaagatttatggacagaaaaaggaaagtgacgtacagaaaatggatgtgaggtacagaaacaaccaaattggttgcagcttggtgggcgtttgccttatttgaacacggtttgaacagttagcccttgattgcccaaaacttggtggttggcacaaaagtaggcttcagtctgtttacatcttcatttaggttacagttcactatgtacagagaaacctttaggctgaacataaaatacgtaaaaaggcagctttaggctaaacttgatttaacaatataaagacttgaggcaaagatagtcccacaacttgctcaagaccacagaaatatgagaaactcagaataaccctcaagtactcgggctccagactggatgctgttaacctcccccagactctcatgtctatattgcttttggcctatgacttttttatgtgtgtgcatgaaattgtgaacttcttttcagtgataatctcgtactcttattttatcacactttttagttccttgggaatagctcttgagtacggccataccaccatgaatgtggctgatcttgtctgatctcggaagctaagcagggtcgggcctggttagtacttggatgggaggaatacgtcttaaattttataaacaggactcagacatctatttttatgcttatttttaaatgtcttgataaaatgttatactactattacattcttgggaaaaatctcacttggtttttttttgtgttatacttttaatcaccagattttgtttgctaaaatgttatttagaattttgcatgtatttttcattggcctgtgattttttctttttatataacatctttttaaaggtctttattaatattacactcaagtgttcttctgttttctatgcgctgaatccaagcagttaaaatccatgggaaatatttttccttgatattttctaagaactattcatgtaatattatattgactgctcactcagcccctttccctaaagcctggtaacacaattaactcatgattccccgataaatgctattttctcattcctccatttttatctatatgtaaggctcttggctttgaatttggtttctatctctttgtttggttaagttcatcttggtaaaacagtaacactctcagcatttgttctcagttctgtgagttagagttgataaactttctcagtaggacagacacatattttgctcaatgtgtgttctccataaatgcagatgaggaaggagggataattagaggaaacagaatgagaatctcaaccatttgagcccttacacaattctatgataaactacaatttgtatattttctgagtcatgtgaatttgtcataaaatctattacttcttaattcacaaaagttccttgttttatttaataataaaggaggaagtttaaaatacccatttttatagagtcatgtgtatgtggtgtataagtctttataggaagcatgaacaaaatataatacaacagttttgatatctggggatttgtaatataagtgactttttaatttatagaaatgtaacaaatttgtaaacaaacaaaagtcatttcagaacaagcttaaaaatctagtgatcctattaatttactgaaagaaactagtaccattcatctgcaagacttatatagataacatgtgttcattttcttggttaaatacttaaatatggacttgtgaggtttcattagaaactatcaaattatattccaaagtagttgtagcatttttcactcccttcagcaacatttctccccacttagtattgttatgatactggcaggctgggggaggttcctgaatgccaatgggaccttgagcccagggtcgtacgggctcttgacaccgtcatgagaatgaattcaagggcgagtcaggaaatagtgaaagtactggccggggcggtggctcatgcctgtaatcccagcactttgggaggccgaggcaggtggatcatgaggttaggagttcaagaccagcctgtccaagatgatgaaaccctgtctctactaaaaaatacaaaaattagccgggcgcggtggtgggcggctgtaatcccagctactcaagaggctgaggcaggagaatcccttgaacccgggaggcagagtctgcagtgagccgagatcgctccactgctctctagcctgggccacagggcgagacttggtctcaaaaaaagaaaaaaaaaaaagaaagaaagtacagagatttattgtaaaggaaaaagtagacatttaagaaaagagagtgcagttgtactcaagagagagacatgcacaagtgggttttacctttctgggctccttcaaccaaggggttgaatattcatgaaaattcttggcaaaggtggagatttctcaggtctgtggtgccacccatttttaaccaaacatgagtgttctcagaactgtcatggcactagcgggtgtgtaatgagcatataataaggtcctaggtgaaacctaggtcaaatccagcagcatgttgggtcagttggtcttatccagcttggtccacaccctgttttcgagggtcttatttgcccttagcctctgcagatatttcaacagtttccctttgctagtcatctgaaactgccacctggaattttctactctcctgtgaccaccttgatttattcctgtctcagtatttgtaagttttgctattccagtgggtggcaaaaaatacttcatttttgctgtcatttgacttcttggctgatgaaagatgttgaacaccttttcatgtacttattgggcatttatatgtgctaccttaagaactgtcttttaaaactttttgctattattattgaattacttgtgtttcatatttgtaggagttctttatgtattattgatacaagtacttagaagatttaagtattatgattgtattctcccagtctgtggattaacttttcatttcctaaatggtaattttgcataagcaaaaaatttaattttaatgaaattcattttattactttgtttctttaagatggaatttttgatgcatcaatttgacctgccaacagtttttagtttttcaaacactaatctaagtatcattgtgagagtagtttgccgatgtgcagatataagtaagggagattattctggaaacttttggtgggcctgctgagtgaatcaactaggaggccttaaaaactgggcttaggtaggagagaaggaataaaagtgagagagaaagtaggggagatagagagagagagagagaaagagcgcagaagaaattccacttgtgaacaacagcttcctatatgcatggagttcatcctcaccatcttcctttcttactgacagctttatggattttggattgtttaaccatccattacaattgtgtaagttaattccttgtaataaatcatctatctatcatctatctatctatctatctatctatctatctatctatctatccacatatcctgcaagttctgcttctctggttgaacccagcttggttcattaatgtctcctctaagaaattattctctacctccatattacaaagtcattctcctatattttcttctagaaactttatggcttcagcttatacatttaagcttatgacccatcttgaatttttttgtgaatattgtagtgtaattttttccctatttgggtattcccttttccagtaatgtttattgaaaagtctttgttgttgatactgaattaccttgtcatcactatcaaaaattaatttatcaaacacacgtgagtctacatctggagacagtattttgtttttttctagtttttaaactttatttctatcatcatgattactgtagccttatagtgtatcttcaaatcatgttgtttaagtcctccaattttgttggtcgtttttttaagttattgaccattctaggtgttttgcatttgcatataaactttagaaacagcatgtcgaattgtacaaatgaacaatagaatttaaactattcctatatatatttataaaaataatataatactcttaataattttataactttatcctaaaatatttcattacaaatctttgatttttacaataaatcctatcaactttcagtgacttcatataaattttgctaagcctcaaaaactaattaatagattgctgaatcacaaacttcatacatataaatgcctttgtggcttttctcctataaaaattcaagtaaattagctaagagtgaatggagtgaattgagagtttctttttttaatgttgggaaccaccttagaaccagctttctccatgtgcttctccattcgattttttgaaactagttttcctactgcagtttataatttaaattaaattgactaagtatgaattttcccgctgtgcccttctagtaatttctttgatattaaaattatgtttgccacttggatatcttcagggaattgctctaaaaagaattcattggtggtaatgtccaatatagcatctatgatttttgctccaactaattttattctactaggaagacaatcgtctttacaactgcatacaaattagaaagcaataatttcaaatgtctatcatcacatttttatcttaagcaagtcaagtaaattgttggcactaacgtaagctccatataaggtaggatttttgtgtgttttatctattgctatatacctaacacttagttcagtgcctggcacattggacaatacatatttataaaagaaatgaaaaaattgcaccctaatatatttcaaatgttcaatatttaagtaattttatatattattatttcaacaaaataaaaattacttaaaatttcatgagacagaatgcagaaaccaattggcaataattttatttacctttctgagctcatagctagacttcctttctcattctgtcttagattaataattagatatggtaatatgactcatctctgtccaatgaaatgcaggcagaactaatgaaatcactccgagttgaagagaatgaaatagagaaaggcagaaaaaaagcaacttagacttgatcattattcctaggaaaaaaagcaaaacacctttaagtttgattattggcaaatgaaactgatttaaaatatacacatcagaagtgttaagcaattaaagaaatgaaacaatttttcaaaaagctttacccattcaattctaaaacaaattttaaatagtcaaatatgcaccagtaggaagtaggccacgaaagccgtaaaactcgtaagcagggaaagttgccaaaaccaacttcagatgtgtccatggagaaaaatggatgcaaagaaactcacagaaggtgactccatgggcctcaagagacatggaatctcattcctttcagagagcaggaatatagtcatctaatgaactgtgcctgcatccagggtaggggaattccataaggctcgctgaaatatttccaaattatgatgtccagagaatactgtgtgtttctgatgcttcctcttgattgagtttttattgctctctttgtttttgctccaacattgtacattgggtgtatgaaagaatagtagtgggtggctttcttatttttaatttctagattgccataactcaggggcatatttggagccaaggggaggaggtcagtggtaggcctgtacacctcagaagatgaagcttaaggcttgggaaataagtcgggctgcattttatcagaagaggaacgaaataagtatgtggttactagaaaagaatgtccagggcagtgtttgtttagttgttcacctacctccttcctcctgggcatgtagctacaattcatttcccagcctcatttgcagtttggtatgtccacatgactaaattctgaccaatgccacatctggaaaataaaaataacttacatgattttcagctcctttgttcatttgcttgttggatgttggtactgaggacacctttgaaagtcacacaatgaatattgttcaagcctccatcaatctgggttcttgaattgtcaggcttaacacccaccccctcatgccatttagtcttacataagtaagaattaaactttcgtttagtgactgaggtatggaagactatcaattacagtagtaaaaactattataatatcgaaaagataacaaatatctttttgaagtttgtctcaggttgagttatctgtgaagtggaaccctgaaaaagaacttgaatgcaaatagtttatatgggaggttattgcagggtgcaggtgatagggtagtgggggtatgaggctgtggatgaaaaaaaagacaacttagtgtgcattaatcaggttactactctactccctgtggtgacttctaggacagtgtgtggaatacctctcagaaataagtaacccaacaggcatgaaagctgtgtcattgcataagcccttcttgtagagacatcaagccattggtctgtttagcctgtgcctatgcatgcttgccccaaacatcctgttatgggatgagttgtgttttccctaccctctccaaattcatgtgttgaaaccttaacccttactgtgattgtatgtggagacagagcctctaaagaggtaagattaaatgaggtcatataggtgggaccctagtccaatatgactcatgtcctcagaagaagagaaagagaccctagggatgcacatgcatagagaaaaggccatgggaggacacagagacaaggtatccacctgcaagctgaagagagaggccttggaagaaaccaactctgctaacaccttgatcttggactttcagcctccaaaaccgtgagaaaaatcctgttcaagccactcagtctgtgcagccctagcaaactaatacacctactcctacagcccaagaaagcacacaggctgagaagcacatgtccttatagtaggaagcatgagaatgcaaaggatgagtgaggtgctgccagggccgactagagcccccttgcaatgctcagagccactagggtcccatgttaagttcaggatatcctgataattggtttttcaagtggtgtcttcttgcagttatcgaaacttacagcaagaggatggtagaccaagcagcgttcaccacttctgcatttggtgctgagcgttagttgatatttatactctccctcctctgcctgtgttctagattcccctcagccacacccaacagttctgttctgctagtggagcttgcttgcttgcaagctgtgacctgcacccacgatgggtctgacttcgtgctgaccatgcctttgtgacatcatgattgtttccattgctcattttggctgacaccaggcagaaaattggcaagagatattcagtaaataaccagaattccagacaaactccacattccttctctatgtaattgtgcctctgaactcatgataataagaatgaattacttctgcttttatattaactcctttctttgtctgctggtctatcaggatgagtggtccaaagcaaccaagtaacaacatagttactacctggtataagtgcccacctaccttgcaagaccgaggcaaccactaattctgcaggcccacagatattgggataggaaacaatttcctgaatggattactagaagttataatgaaaggtgccatccctccttctatcctttggttcctggtccatgtggaaataaacaaagaccacacaagtgagatcaagccgagactctttattcacagatttttatagcaggggaggcagccaacatcactagaatccctaaagttggtgaagactcaatggcaggcaggggaacaggaaagttttataacagacaaaaagggaagatttcaggtatcctctgaaaagagtgttggtagggtagctggagatgggctaactagaatcctatgtgattggcttgggtaacatatttggccttctctagttgtcctaagttataaaggtggcaaaaattaaggaagctggaagtttttaactaagtcctgattgttttgggctgattgttacagagcttatttggcttcctggactggttgctgcagattatgggtcaatgtcctgtttttatatatggtctagccattgtccattcacatatccagtttatcatccatgtattctagttagtggggacaaagcaccatttgatggccatcgctcaaaataggaaaatgcacctttgagaatagagcaaaaactttggaaagtgtcatccccaggccaacatcgtagctttttttttttttaattaaaaaaaaagagagagaccaatatgactcttacaggcagagaggttttggttgatatggtcaatggatggatcccactgccatatgttcactgttgtgctgctttttaccataaagtgagtcttttaggtttaggcactattctatgggatttcatattcacagatcagatcccctatgagcccttgaatagtggactgccccaaaagttgcagtcttggaaactactccatatatgaaataggtatcaatttctgtaagaacaaattattgctatgtgtatcaaaaacatttctacgatcaagaagatgaatgttaaaaataacaatgagatctattatgtgttgtaaacatttctttctttagctcatgaacacttctttaattaaaatccactgacagagcattaacatgaacactaaaatataggtttgtattaatgaaaacaataaaacatctcactggtaaattaactgatcacgaaatcattctgactgtatcaacatggaactttaaacttcttaacacataaaaaagacatgttataaaaaacacaaatatcttttgaagtttgtcttaggttgagttatctatgaagcagaacctcgaaaaagaaatcgaatgcaaatagtttatatgggaggttattgcagggtgcaggtgatagggtagtggggatatgaggctatggatggaaaaaaagacaatttagtgtgcattaattaggttactactctatacttttatactttataacgaatatttaaaagccatatacagaaataaacacatgcatatgtaatcatacttagaaagacttgacaacacacatgtccaccagcaggttccttaagaaaaatgccaccttggataaatgtcaatgcatttatatacaaggtaacattgtaagcaactccctgactttctaagaaatagtgcacaacttcttaaaatacctcatacacaccttcatattcgtttattcaaaaattgtcaaagatatattgcaaaaaaattgtattttttgaaatagatattatggggaattactgctttgtgaaatacagtttgggaaatattcatccaatgtaaagcctgttggctggtaataaaaaatgtagaccctatttgctctttgtttgtattttttcatacataagagagttatttaactttgtttccttaacaggagttgggaatgattgcatcaaatctctttactcagtttttttttttacatggtaaaataatagcaaggaaagaaaattgaataaaatctaaatactcccaacagactattgtatttaacaaagagaatttttattgattttgttgtatttttattccccaaaatctatcactggcttacaacaattatttagttatgctgaaaaatatatttaaattgattatgtataaatacagatttgcttatagtttctgctgttattttttgtgaacttagaaatgttaaaaatgaaaaccatgggatttctgaccatcttcattaagttataatttacatacaataaaacacactgatttagagttcgatgactgtgacacctgtgtaaacccttccctctatcaagaatactttttccccatgactttcattacccactcaccccacagcactccctcctacccaggaagccactgttatcatttttatcatgttgaaacatgtatatgtgtttgtatcgcatttctttcactccgtataatgtcaataagattcctccatattgttatatatagctgcaacacactcatttttcttgttgagtaatgttccattgtaataatataaccaaattttgtacccattcactgttgatggacatatggatttcagtttttggccatgatttccactttttgatttttgttatcaataatgccatcataaacatttgctactgaagtcccctgtggacattaatttcatgttataagaaactgaaaaaaacagttgttcaaagtggaagtactattctacactcttactctcaatatatcagggtctcaagtgttctacatccttgtaaatagtgttttgtcagtatttttaagtttagctattctgcagggtgtaattggcacctgatatggtctggatgtttgtcccctccaaatctcacgttgaaatgtgattccccagtgtcggaggtggggcctggtagaaagtgtttggataataatgaatccctcatgaatggtttagtgccctctttgcagtaatgaatgagctcttgctctgaatttaagagtggttaactctggttgtataagagtgtggtttttcccatccccccactctcttgcttcctctcccttgctccctcccttgccatgtgatgtcctgctcacacttggccttctgccatgagtaaaagctccctgaggcctcaccagaagtgaaatagatgctggtgctatactttcagtatagcctgcagaactgtgaacaaattaaggcccttttctttataaattacccagcttcaggtattcctttagagcaatgcaaaagggactaacaacagcatctctctatggttttagtgtgcctgagggtattatcatccttagaagattttggccctgggcgtgttattctaagtgtgtgtgtgtgtgtgttttcatgaacaaaactttaagattaaaaaaatataagataagttggaatcagggactttgaagtaaatatgtttaaaaaaaaacaaccagcagcaaggaacatttaaataatgatgagatgtttgttcatccaaagtaatgtatttataataaaacaagaaagtaaaaaagaatatgtatttatagtaaaacaagaaagtaaacaaaagttgtaggaagaaaaaaaggaaaatgagtaaaaagaaaagttacaaaaccaaactacaaagaatttggtagtatataagctgactatataatttattgtccaattagggtactctaaagagtgaaacggggctttaaagaatggttaaaattagataatttaacaactttttttgatcaaaataattagttttattatattggtgggcctataaaatatttttatgaaaaccaaattttaaaacattttaaaattttaaaaacattttttcaaaaaattaacaaatctgtacacattaagcaacattttagaaaatatgtaatattgagtatctaaaaataacgatgtacaaatttcaatattgaaattcatccttgtgatgtggaatatcttaatttgtgagaataatcatttgatagtgttcctacatttaattaaatcagcttatatcctatatcaaatttgaaggaatataagaaatctttgaattttgtcacacctacatttggcaaaataatcagaatataaattattatttggtgagttgtctgatacacatgtttgctaaagacagagtctgtgaaacaagaccaaaagacagatactctggaaaaatttaagctataatatttatatatttacatgacaagtttataactgacaatattctctaatagtagttgttctacacattgcaattctaacatatatagtggcaatatttttataaagcatatttgggtccaaagagatgaactgattaaagttgataattccaacttttataaccacaaaacgtgactttgaagaaagggatatacacttttgtgaacaactaagaaataataagagcatggtaaaacaaaaaaaaacttcagaaataaccagggatatattaaaagcagatatgaataacaaatattgacatatgtatgtacattctattataatcaatttctttacataatatgtaattctcaaattttcaatataaaatagttattttgaactaaactacttgttattatgttttaaaaaggattttctttttcaaaattgttttggaatagtattttaaaacatccatatttaaattgtcaggaaataataatgttttttgagatgagttcttgctatattacccaggctggacttgaattcttaggttcaagcaattctactacctcagcctcttgagttgctgggaatacaggatcaagtcactgtgtctggctaaataacataattttgtgcaattctccagtatatcctttggtatggcttggacctttgttgccaccaaaatctcatgttgaatggtaattcccaatgttggaagtggtgcctggtgggaggtgactggataatgggggggcagatttccccactggtgctgttctcatgacagtgagtgagttctcaggagaactggttgtttaaaagtgtgtagcacttccccctctcttccatctactccagccatgtgaagatgtgcatgcttcccctttgccttccaccatgattataggtttcctgaggcaaccccagccatgcttcttgtacagcatgtggtagcatgagccaattaaacctcttttcttgtaaattacccagtatcaggtatttctttatgatggtgcaagaatggactaatacatccttgttgggcaatagacttatagctgttaaatgatgtcagttcttctgaaataaatacaattcaatacaattctgaccagaattcctataggaacttttgtgacacttaaactgcttttaaaatttatatataatgctaaaaaatgcattactatatattattgtaggtctaacatgatttaagaccaggtgacgttggttcatggatagaagaatagatgaatggaacagaatcaagagcttagcaatagaaatatgaatccgtggaaatatggtgtatgatgtccctggcattgcaccccaatgggaaaaatgtatcagacaataaatatttccgaaacatgggaaacaaatattatccttatttcacaccctacagaaaaattccatgtgaatcagaggcttcaatttggtgaggttagcactatgatttcagaataggaagataattcctaagctatatatttctattcacagaccataaaggaaaagattaatgcatttttcctgaaggaaaatattaataaaagtttccatttgtcaaagaacagcataaaagattaaaaagagcaaagagtgggagaaagtacttacagcacagcttctgaatattaaaagtagagaatcatcctactcttcaattagaaaacttcattgttatgaataggtaatttccagacaggggaaatgcagggcatactaaaagcacatgacaaaaaatctgacaaatctgaaaattctcagaaagctggggaatggacaattgtcctgcactgctgagaaagtgtaaaccgacagagtgattctgaagagaaatctgtcattatttagtgagattgattgtatatataccagatgatgcagctatcctattttatgacatataactcagaaaaactatcacaaatccccagagggacagacatgagtatatatttatcagatcattagttagtgggctcatcagacaatctaaatggctacctgtatccatttgctagggcagcagtaacagagggtcataaactacatgggttcaatgatagaagtttattgtctccccgttctagaggctagaggtctgaaatcagagtgtcagtgggtttattctttttgagggctatgaaggagaatctgttccatgtgtctcttccagctttggtgatttgccagcaatctttggcattcggcttatagatgtgtcaccccaatctctgcctttatcttcctgtgttgttctctgtctttgtgcccaaattccccccttttataaaagatatgaaacattttggattagggcccaccttaatgatcttgccttaatttaattaagtctgtaaaaaccctacttccaaataaagtcactttcaaaagttctagagggtgaaatttcaacacatatttttgggaggacataagttggcccatgacagtaccagtagaaatgtaagtagttaaaacatataggactcttcagccgggcacggtggctcacgtctgtaatcctagcactttgggaggctgaggtggatggatttcctgagctcaggagtttgagaccagcctgggcaacatggtgaaaccccatctctgctgaaatacaaaaaaatcagccaggtgtcgtggcatgtgcctgtagtctcagctattcgggaggctgaggcaggagaattgcttgaacccgggaggcagaggctgcagtgagcggagatggcgccactgcactctagcctgggcaacagagtgagactccgtctccacaaaacaaacaaacaaacaaacaaaacaaaacgtataggactcttcaaaggagtactaaagtagattaaaaatataatgtcgactttgctaaagattattaatagctcattaccatttaaagtaaatttgaaaaaatacataaagtacattgcttattttgtaaatattaatgtattttataacaatatacaccacagctatagaaccaaatcattacagaggtacataaggaatagaaaggtatatgtacccagaagatgatgaagggaaaaataaaatgaaataattaaattattttaaaatgaaatctaataaaatatgaatatgaaatttataaataagaactggtcttacagaattgattagaattgctcatcctatactgagtaatattactaaattgagtttgtgttcctgaattcccaagtaaaaccaaaaatattaaaaaattaggagattcaaagcaaacattttttcttctatattttcttgaaaaactcaaaacttagcccactgtgtctttactcctttatggcaacaaaaacactgttcctgagtagcagctgtatctttgaaacgggacttatgttcttgtaatagcatccaattcggtttcactcatctgtaatcagtttggcacatgtaaacatgtgtttgagactatttcaaagtgtctagcagaacaggtgaggcgatatagataaatgagaattttgatcctgactagaatgtatcacgtttaaagtatgtttgtacagtcaaggtcagtaaattatcttgatttactgtctaagccctgttgcctacaatcttattttccaccttaatactgtttccaattcagagtctataggagaatctctttcatggcttccaatattatttattttacttgcatacacttattcctactatagtgttatgtatataaagaatgtctattgcaactggagctattgggaataatattcttattttggaatgtaataattttgctcatttgatataatgcattttaatctggccagtaaaatccaaccttctctaaactgcatgtatttttaaatttttaaactccttattcaggtgaaaacaattcataataatgttcactaagcattgtcatatttttccccggaatgtttgcactcattgaaatgtctaccaacagtacaggaaagtgtctattttccttcatctcctcttctgacttgtactttctgtacattattactttttaaaagatgtcaaactgtctatcaaactccaataattatctatgcaaatgcagtacacacacatgcacatgcacacacaccatcctttcttgtgatagcactttttgttttgtaatgctgttgaatttcatttattgccaacactcataagagacctggggattgttacacaaatggcatttcattagcagatcaactctctctaggcttcctgaaagccagaaaagaagactttaggcttattactttgggagtgatttaaccaaaattgtgtatcttctgctagaggtgagtggtgagtcatagaggtgatgtaattctaaatcttactgaagtaaaactgcatactttcatatttagagataaatgtggaggaaaaggagagagaatacattaggaaaagaaagaacagaactaagatttgcctctctgttcagtgaggacaaaattcaaactatctcctttgcaaataactttatgcattgcatttgatgtagaaataggattattgaaaccataaatatcaacttgatagagttgttaaaggcatatatgaatacatgaattagtgtttttttatggcagagaacataggcgttcccttcattacaaataagacccaatttttttttttcaaactagagttcctatgagaaatggcagctctcattgacttcactggatagtgctgatacgtatataaaatgtccttgaaggagctcaggcatgtgggtagaatgttaagaagtggggtgcaagcagtgacttgtatgcttgcttgttttgacctgccctttgtgttttcactattgttaagagaagggctgtcccaagaggctgctgcccttcagcctgggtctcagaatgagatgtggagcacacgtgagaagcctaggcccgtggagtgaagcagagctaccctgctaaatctagctgactcccagacatgtgagtgaacccagctgcgatcacagagctttactggtggatgtgtagatctgtgagaaaaaaaattcatattgtaatatgcggctggtatttggggactgtatattttgaagcaataactatcagctacatcctgcaacagaagttctgaatatttttgttttccatttgtatagtatagtcctttattatgtaaagacctgatttaaaagaccgttttatgtgaatgtaccattatgtaaatctcctattttttcttcacctcagaaaaacactcttctattatttctttgattattgcttctaaaccattgcttctgctttcttgttaaggaaactcaaatgtatttattggactttttattctttcttttttgctctttgttatctcagcattggtcacattttaacctgaattctgaatggacttactattacttccacatcattgattcaattttctatagcccagttcattttttttttttttttttttttttttttgctcacagcagagctttaagccctcaaatgtagctttcctttttaatgatacatttatgctttccttttcttaatatattcttttaacttttgaatttatttctcattattatgttcccataatttggactgagaacacaaacgattttgtttctaaaacattcttctgtttttcaaaacaaattcctgttggtgtgccctgctgttttaatgattgctctggaattccttgttttcagcgtttaagctaagagtgagtttctagtcagctgtctcctagttaaatgtgtgatgtttagtcctccgtgtgtatgtgctaccctaaggaggaaactcttagtttgtattctgttattgtttctcatgatttttgtgtcccaaatatagagaaggcagttaaaggggtaagggttggggttaaatttcagtaccagagttctcaataatagcctattaataaagcatttaattagtttttcccctaaaatgcacttgtctgttatagatattctatattcctgaaatatagtagttatttaacaaatactgcttttaaataaacaaataataaatatatcagagtgtttcccatttgactgacggaataaaaagccattttttttggtaaagtttctttgacttttagcagtcagttttctagaaaacctgtggtatttaccctgtacccactactgcaaattgtttgagaacagtctatcaatatctccacatagtactaaagtggctttcttagtacttattatctttaagctggaaaaaaatgtgttcaacagaatggagcaaatcattcatgaaacttttctattaaagctctactccggatgaaggaaggcttcgaatctctaatcaagattctgttttaattgtgttaaatattcccatttaaaatgaggtataacaaaaaggtattaaactgaaagtcctagcctggagaaaaatgtaaatgtcttcagtgttcatctctatatctgttcttaattcttccccatcttgcctactgttctaggagacagaacagaaacaagaaggaagggaagactggggaaaattgagtctgagggagctataagtgaatggacctttgagaatggttagaggctgtaatcgcagcacttggggaggccaaggcgggcaaatcacgaggtcaggagtttgagaccagcctggccaacgtggtgaaaccctgtctccactaaaaatacaaaaaaattagctgggcatggtggcaggcacctgtaatcccagctactcgggaggctgaggcaagagaatcacttgaacccgggaggtggaggttgcagtgagccgagatcacgccactacactccagcctgggccacaagagcgaaactccatctcaaaaaaaaaaaaaaaaagaaaaaaatggccagattatgaagatatttatgtttccttaaattaaacaactggcaatgagaaaaccagaggaagaaatttaattaactttctcaaatccacagaatggaatgcattataaatttgtacatgtagaagaaatacctttaatgtttgactctatattgaaataactgtaaaccccttcaggatggaacaaattacagacggtgggaaatacatattgagactgtgcaaaagagagaacctatgacaagagatctaggtctaggagtcatttaagatgaatctttaagtcacccaatgagactggccagaaagacatggggacatttgtatcaacagcacgcaagtaaatagagcagcacagacactaaaaaagaataacctaatatgggaattcacattccagagtgaaaatcatgagcaggagccacattctgaacaatcaggggataaagtggccacaggacacatgaggcagaaacaatggaggtgtaaataatctggtttaattctggaaaactaagtcttactcttacagtgttctttttcatgagagaattttaaagagataaaaattttaatcagtgctacttaccttaaatgctaaaccttattgttactacctgtcaagtgctatagcaaacccacaaaggtagaagattaagaagataccaccagattatagttgtaaaatatttgagatcagtacatgagctcatatgcagtgggtggagtgaaagtcaggtattagtggattgaggagtgagggatataatgaccactccgataacctctttagcaatttattgttatcatttaatgataatcctgtattcctacagtgcagtcatccaagaaatgcaatcctgtattcctacagtatagtcaatgcaatcctgtattcctacagtgtagtttaatgcaatcctgtattcctacagtgtagtcattgaagaattttggttttctgaatgttgaataagagtggaagtagagtataaaaatctacttttcatgcatctttcatgaaagaaagggttagagttagggccaactctgaggaaggggtaggatctttgtccttaaattcctaaaaatcaaaattaaaaaaaaataagaaagatgttttccagtgaaaaagacatcctacatcagatgttttttctgcccatcagaaacagagaatttccaatgaagtttaaaaagctttaaaaatatagtattaacaataactgaaataaaacaattttttcttgatttgcctttgaaatgtacacattagaataaaaacggttctgttacataaactcttgcctttcaggaatcaatcaattctgtaagttattgtgggagtccaaaagacaaaataatattacaataaaaactatgtcaagagtggtgtgtgatcattttatttatgtaactactaacaaattactgctttgaacacgggtgaattaactatcattgtgatgttttgtgatttaatacaagagctttgattccacagagtttgattttttagagcatttaattatgagaagtatttaatcatttcaaagaagtattatgccatttcctggactgtgaataatatgaatataagattataaatcacatttccttcaaaatcctcccattaacatttttacattaaaaacaagaacagaaaataatatatcaatagattaagttttagaaaatttagaaggaattataagtaaaggtactcctcttcccctctgccccaaaatatgtgtggccctcagggatcagcagacagcctcctgtggctcacacaacaatatggctttttatcccatgattttccacgctagatgctgtctttttttggaaatatgggtttttttttttttttttttttccttttcttgacccaggtctctcacctctctcataatgtcttagtcattaggccccgaacgtttggaaagcttccacatggaattgttttctctctgttttccatgtgcctggaacattttggattataagaagttgggaaaaagcagccagaaatgactgctgacaagtgagaggtcttctgtcctgactgaaatacaatataactggaacttcctgacattggtccccctgagcttaacccttcgccatgccttgccgctgagaaccttggggaaggttctggctttccttctacttagtgagcactctgctcatgtgtcttcaccctcctagtaagcctcttttaacatcaatttgtggtttaaaattgtcaggaaaccaaaaggcaagaaaagggacaagggagaagtgaataaagttatatggctttatattttagaaaatatggtccataaataacaaattacttgctgaagcgaggcagagcaaagaaaagccttgaaaacacatgtggaaattactgtttgtcgtagactccaatggttcagatacagaatcatgattaaaagcagaagcaatttatttcagtagaatcacaatagagagatctattagatgccagaaggtaactatctctctgaagttcaaagcctgcagacatggataatacataactttgtctcctgaaagattacatgtttagctagagctctcgttatctgaggaatggtagactaaaataaacaaaataaaaataaaaccattgtatttatgccaaataattgtaaaaaacagaagatgcatataccataagcatgctttagttgcatacaacaaaagcaaaatttaaacaattaacaaacggaaggtattagtatgtacccaaattgcagacatttattttttccacttatcaagtatttgtgtatacctttcctttccaggcctacccagagactaaaatagacatgttcattgactgcagatgtcatgagatgtacaaggtcagacataatcagatccatgcatgtttgtatctttttataaggtcaggcttttattgatgcttatttattcataaaagacacaagctacatggagttcccaaggaggcaaatctccttagtattatctgttcacttggcagtcacagccaagagcacacaggctcaagctgatctacaagttagtcaatatggcaaaccatacatagtagtataatgaatatatacatctgatagattaaaatttccacatcacagtaacatttaacattgagagaaaaccgtgtagtatggggaaagatgttaatgaaccagtccaaggatagcaacacggacaaggggagtgtcttggactaccatctttgcaacctctggtgagggctgtcttacacctctgtcttgacaaacatctggtcccactgatatgatgccatttgaaatataagatgaggtctttttctaaaatggagttactcgtcaatggtgcgctatacagtggatattgtaatttagaagaaaacaaacaactttttatagatatacttctggatattgtgaaccccgaaaatttgagacaggtatcatcagttaatttagaaagtttattttgccaagatggaggactcagccgcatgacacagcctcaggaggccctgacaacatgtgccaaggtggtcggggcacagcttagttttatacattttagagacacaggaaacatcaatcaatatatgtaagaagaacattggtatggtctggaaaggcagggcaacttgaagcaaaggcaggaagactggaagcagggacggggcttccaggtcacagataggtgagagacaacaaacagttgcattcttttgagtttctgattagcctttccaaaggaggcaatcagatatgcttctatctcagtgagcagagggatgactttgaatagagtgggaggcagatttgccctgagcagttcccagcttgaaagggcctaaggtattttcctttcacattttcccccttttcttcttaaaaatcttttggagaaagtattttagaagaaaatgagtctctgtttcatgcgcgtctgtgtgaagagaccaccaaacaggctttgtgtgagcaacaaggctgtctatttcacctgggtgcaggcgggctgagtccgaaaagatagtcagggaagggagataggggtggggccgttttataagatttgggtaggtaaaggaaaattacagtcaaaggggggttgttctctggcaggcaggagtgggggtcacaaggtgctcagtaggggagcttttgagccaggatgagccaggagaaggaatttcacaagataatgtcatcagttaaggcaggaacagaccattttcatttcttttgtggtggaatgtcatcagttaaggcaggaactgaccatctggatgtgtatgtgcaggtcacaggggatatgatggcttagcttgggctcagaagcctgacactctggtctcaggtttccacctgatctcttacggcgaggatggtttattcctagataggtaggtcccaaaagctcatttttagtaggttgtgaagtctcacatcctaagaagagaaattagggagaggaggagagaaaaacaaaacaaacaaaagaacaatcctgggaaattaatataagccacattactctgaagtctatacatcagtaggcaggtatgaaagtggcttatgtatgtaaataggttacggttattttcttttgaagtttaagttgtctggtttcagtctgcagggctttaaaaaagcacaagttagttttcagtgactcccaattaggataaatggaaaaaaagaaggaaatacaataaaacattattttgaagacttgtagccaagaaaaaattagaattcagcccaaactgtagaaataataaaaatggaaaaaacattacggcaagattagatcctgacaacaggtgtactatagtttttgaaacataatttttctctctccagtttcccattttactaaagacaaatcatggtaggactggttttctttattatactttacctaattattagtatgcattgcagcaagaataattatttttacataggcttttaaattgtctttaatggaactttgttccatagaaggaatctcagataagactttttaaaagctgagcagagccatggatttgtgccatcaaatatctatgagttgggtgaatttcctctcctcttgaggttccaagataaacctgggccttctgagcctgtcagaaggtgacattatttagcacaggtcagaaaccctgtacagggactgaatacacacaatacgaggccagtttttccaagggctttattggctccataactcaagtttgattccttaaaggagagcacaccattccagttaaagtcttggtaaaataacaagtttctccaattgtgtcctgttacaaatgaaaacagattcttttttgtttgtttgtttttttgagatggagtttcactcttgttgcccaggctggagtgcaatggcacgatcacggttcactgcaacctctgcctcctgggttcaagcaattctcctgcctccgcctcctgagtagctgggattacaggtgcccaccaccacacccagctaatttttgtattttaatagagatggggtttcaccatgttggacaggctggtcttgagctcctgacctcaggtgacccacctgccttggcctcccaaagtgctgggattacaggcattaaccaccaatcctggcctgaaaacagattcttattgcacttgtgcaaattactattttgccataagttgagaatactcacaaatagtttccaaattctggataaatcaggtagagagaaacaaatatgctccaaattttgttcacaggactatactaaattttttaaagctgtgagtagttcaaaggaaaagttttaagactctgaaaatcaaaacaaaggatcagcaaagattttaagcaaaaaattagaaagattagttcagtccatgcagttaatttctgttctgcttaatattcatgaacattttaactctccatgagtcctgaacattttttctctattccaatgttacaatcttcgaagttatcagaaacctgcattcaagatcacctgttaaagttttatagctgattgtaaaatcaccttctaaagagaaccaaaacgagacaacaattgtccatggataaaaaaaggttttagggcacccatagtcaaagacacaattgacgaagaaatttattacctctgtggtacacaataactttaacataacaattatgcttattactgataatgcactctaagtcatatcaaaataacaggagttttccacaattttggaacacataccaataacatattttacaaatacagcccaaagaaaatcaagcaccatttaatatttgacaattcttctggtataatttttataccaaataagccaaataatgtcatttttggactttagagaaattaatatcttaaaggattaattaggtcagaaaaagacataatttgtagtttgattttggaaagcttgtcaaatgtaaaagttttaaaacacttgatatcacaaaataggattacaggtcgttgtgaagtcattcatgtaaccaaagtgataactcaagcatttcaaaaaagtaaaaaccttccttctttgcgagatgagacttgattttccaaataagaagtcctaataaaattgggaggctgaggcgggtagatcacgaggtcaggaggtcgagaccatcctggctaacacggtgaaaccccatctctactaaaaatataaaaaattagccaggcatagtggcgggtgcctgtagtcccagctactcgagaggctaaggcaggagaatagcatgaacccaggaggcagaggttgcactgagctgagatcgcgccactgcactccagcctgagtgacagagacaccatctcaaaaaaaaaaaaaaaaaagtcctaataaaaatcgtatgaagccaattaaatttgtttttcaaaattttttaacaatctataaaatttaatattgatcataagatataacttccataagccttttataacctttataacatttattaaggagttggttagtgcttcaagaaaaccttgctaatccgacacaggggtccatatgctggtcttgcatcagtgtgtctttgacattaatgattaatttatggagaaactcaacttattttatctttcaaaattggcccttataatcttacgtgcccacctcttctgtgatagtccctgggtcttgagaagttgaatggctttaatttctggccctgtgtctcaggaatgcagtttattttgattggcatcttctacagggcctgaagatgaggctttaattgctgtcagtgtttaagatttagcaggacttggtgtcccttttagatccaggactcaaagccctgtaactcaatgccacaagaaatttaaaagcacatacaggaagataaatggatgtaataaccttaattcaaatattatcttagtttttttcctaagcaaactaaaatttaataataatatgacagcttgatcatactaaagttttttttttccaaaacaaatcctcttattgtgacttacaccaactgttcaaaacgtgcttgagactttctgttttttcctgaatatccctccttcttaaacaaccagtcattttatctaagactaaatctgccatacaagatgctttctcatataaaattgtttctctttaagctttcttaccacacacacaaaatctctttatttttataattttctttacatctcttttttatttcctggttccttttaccttgttttatatataacctttaaataagctttgaattagacaaaatttgttcacctttttttttttttttgcaagaacgttctcctacaatatagattggaaaatacccaaataatgaaatatctatttaacttaatacaactttagattataaattatgacatttgtctacaaggatttatcttattacttttacctaattattttattttaatggtttacctacattatttatgaaaactgtgacagttatgatttaaagttacagattaccattgcaaaaatataactaaggcagtgaaaatgatatgccttaactgactccatcttgcttctagcctccaagctgtccttgttcatttctggactttgggaggaacttagtttatggtttagctttgaaacaaagacagtaacagtcctttcccaaaacaaacctccttactgcctgtggactagactccctaaagccacaagattagaagtcatggtaatcttactaaatttaagaagcagcagttttcattaattaaacatcaatgtcttatttattaaaaattatacaagcaaagatcactctgttttgggctgggtttatagttttgtaatccctgtgccaaattttgacaccttatactatttggcaggggtaagtattaaattgcctgattaataaatgcaaaaaaaatgtatgctggcaatttctcagacatttctgatattactttactaataatttttaaagctagcttatttattaaagattttacttaatttgaaaaagcatttgactagacttttcttttttcctgataaagtatttgatttaaatgctttcatttttctttaagccaattaattagatccctttatgtattttcagtagtgaagcattgtatacacaatacataaatacatagatgtattggacaggtcgatggaagtacattttatagattcataaagaccatgtatttttcctatctgagacttttagatccttgataacctgttttacaatcctaggcagttgatagctaaatagccttaaatttgcatattaaaggaaacaactcaggtgaaaattaaatagcaaaatttccatcataaggtacagagagaaaaagtctggtggtgctagagggagatgcctttacagtgcacttaaaaagcctttttttaaacaaagaaatttctgagtgtctaaactacattattccttaaaaacccaagtgtagtctctgttgtaataactattttagtcaataaatcaggtgaaaacagaattcagtcaactgataagaaagaaaaaaaatgcttttgcttgaaaaaagacaagatcttagaagagaaaagcaaacaaacaaaaccaaaaccatgaaggccttttaaatacaaatatgcacacacgcacacatacacgtacacactttggatgttatccttttagttaagctgacttttaaccattaaactttttaaaacatctttttaaatctcattatgtatatcagctaggacaagatgctgctatttcagtagcactgccattgctctttcagtttggtttgactggcaaaaagtggtcttgttatgtaagtaaatcccctttagtagtcaaaatcaaaagtcttttctctttttctttttcctttttgctggcccttttcctcccacttcaaatgctttcttccccaaggaactcttcggatttaaccaagttgggacgtgtgtcagacccaaaatgtgctgctcacagacctagctcttcagggtcatgaccccctgaacctgtttggtccacccatgtctcagctacctggcacagggtgtcagggtctcaaggtgcaggaggggtcagctccttatatgtacctgctgtctgaggttaaaccccaagtatgttcttctgcaggggaagctatttagagccactgcttgtcttaggaagtgtttctcccagactccttcacatgattctcagtagctggagaatgccttgaaaggctgaggggagcaaggtgctcttatttctttggagtggaagaccacattaatgagctagaaggtttggagttgttcaaatatgataagggaaagcactgaaacacacacacacacaaacccaacaagaccagaaacaaacaacaaaacagttaaggaaaactaataaatgatcacacaaattgcatgatttctgagtgctctaagtgtaagcagaaattaacaccagctgcttgttaatgctaactttagttagtttaaaagaatttgcaagacagaatcccaaaccagcttcttagcttgtgatgggtctcaggctgtagactggtatctaccatcctagaagcagggaaaaaaaaaactcctcttccatgttggaagtgagctcaaactccataaaggagttacctgccttccatcgtcatgaaagtaggaagacatgccttccttgttggaagcaagtaggtctccaaaaaaagaggagttgtacagcaaaataaactttagatctcgaccaaattttgagagatcagggattcgctggagaaggtgttcaaatacctccacaaattgtcctattggtttgagccataaagttagctgatgcgggtaccaaacacctataggagatttgtgaaaggtcagcagcatcttcacttggaatccccctgtggttaccaaaatgtgaacccccaaaatctgagacaggtctcagttaatttagcaagtttattttgccgaggtcaaggaagcacgcctgtgacgcagcctcaggaagtcctgacgacatgtgccaagatggtcggggcacagcttagttttacacattttagggagacatgagacatcaatcaatatatgtaagaagcacattggttcagtctggaaaggcaggacaacttgaagcaaaggcaagaagactggaagccaggagagggcttccaggtcacaggtaggtgagcaacaatgaactattgcattcttttgagtttctgattagcctttccaaaggaggcaatcagatatgcatctatctcagtcagcatagcaataactttttaacagagtgagaggcagatttgtcctgagcagttcccagcttgaaagggcccaagatattttcctttcacaatctgtatgtgactcattacaagctgtaatttgcagtcagggttataggactatgaaagtcagagctaccatctgcacccttcttgcatggatttttttccatgtggtaagaagtaactcttgccacctctgggataacagtcctatagcactgggatccaagggggaaaaataaatcagtttatagttcactttggaaaaaaactcaggaaaaatctttgatggtcatgtctgagggcatatgcaaacaagatcaagatttttttttttttaatttgttatgtctcattctctatttttaagtttttagtcaaaatctaaaaaattgaaaatattttactagaaatatttatctagaaaaatgtagatgcaaaatgagcaagtttgtgatttctggaactagctaatcacagcagtagtgagaaaaagaatcacaaaggaaaatacagataacatttctaaacctttaaaattaaccataaaagaccaaaaacaaaattaaatgcaattgcaaacataagaatatagagaaaaggataaagaatgttcttatacattaagaataaaaacatgaattatccaaaataatatagataaaatctttttaaaaaaacaacaaaaaaggaaatacaaagagccaagaaccatatggaaaaatgtggagaaataatcagcatcataaacataaaaatagttttctgttgtaatcaaggcaatttaatattggtacaggaacagagcagcaaacagaatacagagcaacaaacccaataaagtccataaatagacccacatgtatatggtcttaaccttaaattttcacttctttggattaggccaagaatttttagatagtccacagaaggcatgggctatgaataaaaaatataagtttgcactttatcaaaatattgtattattaattccattatttgatgtctgtttctcctgttttctcctgcaagaatcctcatcaaatatatgttgacaacttgtatacatcttaactttgtctctcaatttctccgcgctccctttcctttcttgtgtaatttatttgcccatgacattttcttatatacataagtatatttctgagactattaaatacatgcaagggaggagaccacccctcatattgtcttatgcccaatttctgcctccaaagaaagaagaagtaaaaactaaaaaggcagaaatgaaatccagaagcagacagcccggcgccacaccctgggcctggtagttaaagatccacccctgacctaatcggttatgttatctgtagattacagacactgtatagaaaagcgctgtgaaaatccctgccctattctgttccgttctaattaccagtgcatggagcccccagtcccatacccgctgcttgctcaatcgatcacgactctctcaagcggacccccttagagttgtgagcccttaaaagggacaggaattgcttacttggagagctcagcccttgagacaggagtcttgtcaatgctcccggccgaataaaccccttccttctttaactcggtatctgaggggttttgtctgcggcttgtcctgctacacatgtatcttaatgtcaatttctgtttttaataatttttgtgtgtgtaaattcttccatgtgatggtttttatttttcttttattctgctgttttcttcaaacattttttggctattccttggtttttaccatctgtggcagaattgattctgctcttttccatacggccagagtagcagaatgccggcaggtccttggtggcttcccttgtgttacaagcaggtttgtgccttaaccttaaattagcatttgctaggagctcagccaagctggaagagagggttgaacttccagatattggagtagcttatgaaagcaaaaacacaggtcttattttagggaatgtcaacaaattaccttgtccattaagataatttctcatttgttcttttatgttttataaaagctatgtcttcattaacttattttgaacatttttaacatttctgttgacttggtgcatttgaatgggtgtaaacacatatctcaaagtttgtagactatgtccgtgtgcactgcttactatagttatatctggtgagtgggaagaataagatgatgtttcccaattgctagttcagacactttaacattatttgaattgttttcaattttgatgttaatattgtaatttttaaaaaagtctaagaagcagctgggcatggtggctcacccctgtaatcccagcactttgggaggccgaggtgggcggatcacgaggtcaggagatcgagaccatcctggctaacacgatgaaaccccatctctactaaaaatacaaaaaattagctgggcatggtggcgggcgcctgtagtcccagctactcaggaggctgaggcaggagaatggcgtgaacccaggaggcggagcttgcagtgagctgagatcgcgccacttcactccatcagcaaggtaaaattctgctgagaagtaaaataaaattgtgatttttcttatttactttttatttagcaaaataaaataggccattagtaaccttaagaacagtagttttattgatcaagtttagtaacatcagagaaaactttaaaaaaaattgttagggagttgtctggtttattaattcaaactattttaatattaattaaaacaattttcaagaaaagatagaatcccaaacaagcaaaattttaaggcatttaataaatacatggttgtctcacatatcttatgcttctctttagtgagtacatactaatatataaagaaaatttctgacaagaaattatatgttaaacattaaccacatttaatattcaattattaaatgtaacattaaaattatcacataaaagtattttatgaaactttaagtgtgtatatacattctttttgatatatgtataatttaatttcaacttttattttagatatgggggtacatgtataggtttgtaacatgggaatactgtgtaatgctgagttttggggtacagctcctgatatggtttggctctgtgttcccaaccaaatttcatctcgaattgtaatccccacatggagggagggacctggtgggaggtgattggataatgggggtggattcccccatgctgttctcgtggtagtgagtgagttcttatgagttatgatggtttaaatgtgtgtggtttccttcgctttcaatctctctctctcctgccaccttgtgaagaaggtgcttgcttccccttcaccttccaccaggattctaagtttcctgaggcctccccagcaatgtggaactgtaagtcaattagacctttataaattatccagtgtcaggtagttctttataacagtgtgaaaatggactaatacagatcccatcactcagagagtgagcatggtatcgatagatggttttctaacccatgaccaactccccgtctctctgttgagtatactgcagtgtctattattcttgtattaatgtccatgtatgctcaatgtttagttcccacttataagtgaaaacatgtagtatttggtttttctattcctaagttaattaacttaggattatggcccccaactatatccaagttgctgcaaagggcatgatttcatttttgttatggctgtatagtattccaaagtgtctatgtaccccattttctttatccaatctatgctgattagcatgtacgttgatttcatgtcttagctattgtgaatagtgcaacaatgaacatatgagtatatgtgtctttttggtggaatgatttattttcctttgggtacatagccagtagtgaaattgctgggtcaaatggtaggtgtctttaagttctttgtgaaatctccagactgttttctacagtggctggactaatttacattctcatcaacagtataaaatatttccttttctctaaagcctcaccagcatccgttattccttgactttttaataatagccattttgactgatgtgagatggtacatcattgtattaatttgcatttctctgatgattagtaatgatgagcattttttcatatgttcagtggccacttgtataccttcttttgagaagtatctgttcatgtgatttgcacatttttaataggctaaatgttttttgcttgttgatttgtttaagctctctatagatgcttgtattagcccattctcacactgctgtaaagaactacctgagactgggtaatttataaagaaaaaaggtttaattaaatcacagttctgcattgctggagaggcttcaggaaacttacaatcatagcagaagttgaagaggaagtaagcaccttcttcacaaagtggcaggagagagagagcaaagaaagccacacacttttgttttttttttgagatggagtcttgctcagtgacccaggctgaagtgcaatggtgcgatctcagctcaatgcaacctccgcctcctgggttcaattgatcctcccacctcagccttctgggtagctgggattacaggcacttgctaacatgcctggctaatttttgtatttttgtagagacgggggtttcaccatgttggccaggctggtcttgaactcctgacctcaggtgatctgcctgcctctgcctcccaaagtgctgggattacagacatggtgtaagccaccacgcccagtcagccacacacttttaaaccatgatatctcatgagaactcactattatgagaacaggcactggggagctgcccctgggagccagtcacctcccactaaatccttccttcaacatatggggattacaagatatgggtggggacacagagctaaaccgtatcaatactgggtatttgacttttgttgaaagaatggtttgtgaataacttctcctattctgcaggttgtttgctctgttataagtttcttttgctgtgcagaagctctttggtttaagtcccacgtgtctacttttggttttgttacaattgcttttcaagacttagccataaatgccctactaaggccaatgttgagaagagtatttcctaggttatcttctaggaattttatagtgggaagtcttacatttaaatagttgattcattttgtgttaatttttgtatatggtgaaaggtaggggtccagttttactctttgacatatggctagccagttattctagcaccatttattgaatagggggtcctttccccattgcttgttcctgtcagccttgtcaaagtttatgggtgtatggctttatttctgggttctctattctgctccattggtttatgcatctgcctttgtatggtgccatgctattttggtcactctacccttatcgtgtaatttgaagtcaggtagtgtgatgcctccagctttgttctttttgcttaggattcctttagctatttgggcccttttttggttccatatgaatgttctaatagtatttctaattatctgaagaataacattggtagtttgataggaatagtgttgaatctgtaaattgctttgagcattatggccattttaacaacagtgatttttccaatccatgggcatggaatgcttttctattgatttgtgttttctttcatttatttcagtagtgttttgtagttcttcttgtagagatctttcacctccttggttagctctattcctaggtattttattttccttttgactattgtaaatgggaatatgttcccgatttgatgctcagcttaaacattattggtgtacagaaattctactaatttttgtacattgattttgtatcctgaaattttactaaagtcatttatcagttctaggtatcatttggcagagtcttcaggattttccaggtgtagaatcatatcatcagcaaagggagatagtttgacttcttcttttcctatttggatgcccttatttctttctctttcctgaacgcttgaactaggacttccaggactaggttgaacaggagtgctgacagtgggcatccttgttttactccagttctcaaggaaaattgttagagcttttgtcagttgagtaagatactggccatgggtttgtcatagatggatcttattattttgtggtatgttcctttgatgccgagtctgttgagggtttttaccatgaagggatgttggatttatcgaaggctttctctgtatctattgagatgattatgtggtttttgcctttaattctgtttatgtggcgaagcacatttattgatttgcatatgttgaaacagtcttgtaatccaggaataaagccttcctaattgtgatatattaaaactttcttatgcgctgctggatttggtttgctagtattttttttgaagatttttctgtctgtgttcatcaggattattgggctgatggtttcttttttcaaatccagatttgcatgtctggctgatactggcttcacagaatgagttagggagaagcgcttccttccttgattttttggaatagttttgtgcaggattgctttcagtgtggtagagttcagctgggaaaccaactggtccaggatgtttttttgttggtaggtttttcattactgattccatttcagaagtttagatattggtctatttagggtaacagtcccttcctgattcaatcttggaaaattgtgtgcttacaggaaagtagccatttcctctagattttctaatttgtgtgcttagagttattcacaatagtttctgaggatattttgtatttctgtgggatcagtggtgatatggataaaaaccacctttttcatttctgattgtgcttttctggatcttctctttctttttctttgttaaactagtggcctatcgatcttatttatttttttgaaaaccaagtcttggttttatcgatcttttgtatggatttttacacatcaatttcattaagttcttctctaacttcagtgatttattattcttttgctagctttgggattttctccccccaccagttcctttcccttagttgccctaatttcttcctttccaaagttagattgttgatttgagatttttctaacttcttgatgaagacatttagggctataaactttcctgttaacactgccttggctgtatccagagattttaagttgtgtccctattttcattaatttcaaagaattttttttatttctgccttaattttgatggtggcccaggagttatgcgggagtaagttatttaatttcatgtatttgtatagtttggggagatgttgatattgatttctactgttattgtactgcgattcaagaatgtgcttggtatgacttcaatcattttgaatttattgagacttttttatgatcaagcatgtggttgatcttagaatatattctgtgtgcagacgagaaaaatgtatattttttggttgttgggtggagtgttctgtagctgtctgtggtccaattagtcaagtgtcaagtttaaatccagagtttctttgttaattttcttccttgatgatctaacactgtcagtaggatgttcaagcctcccactattattttgtgtttgtctaagtattttcattgaacaagaagagtttgctttatgaatctgggtgcttcaatgttgggtgcatatatatttagaatagttaaggcttcttgttggtttgtaccctttatcattatgtaatgccttttattgtccttcttaattcttgatttaaagtctgttttatctgatataagcatagtgactcctgctctcttttcctttcagtttgcatggtagaattttctccattcttttactttgagcctgtgggtgttattatatgtgagatgggtttcttaaagaaacctgacatttggcgcttgtctttttatcaagctttctgctctgtgtcttttaagtgtgcattaatcccatttatgtgcaaggttactgttgatatgaatgattttcactttgtcatcgtgtttttagctagctgttatgtagacttaattatgcagttgctttatagggcttgcgggctatgtgctgaggtgtgtttttgtggtagcaggctctttcaattctatgtttagcactccctcaataggtccccctcaccagggacctgaggaccttaggagcccctcaccaggtccacttctggggatctcttgtaagtctggtctagtctaaatatattccctcagactttgctttctgagtaggattttatttcctcttcacttaagaagcttagttgggcagcatataaaattcttggttggaattttttttctttaagttgctaaaaataggcccccactctcttttggcttataaggtttctgttgaaaggtctgctgtaagcctgatggattccctttgtaagttacctgccccatctttcttaaagcctttaagattttttcttttgtgttaactttcgtgaatctgatgaccatgtgccttgggaatggttgtcttgtatagtatctggctagggtcctctatattttttggatttgcaggtcaacctctctagtgaaattaaggaaattttcatggactatgtcctcaaatatattttcacagttgtttattatttctctttctcaagaatgcaaatgagtcatagatttggtctcttggcataactgcatatttctcagaggttttgttcatttttctttattcttttctctttatttttgtctgactgagttgactcaattacctgtcttcaagctctgagatttttttctctgcttggtctattctgctgttaatacttctgattgtattttgaaattctcgtagtgactttttcagctcaagaagtttaatttgggtctttcttaaaatggcttcttagtctttcaactcttgaatcattttactgaattgctttgcttccttggattgagtttcagctttctcctggtcttgataagcttcctagccaaccagattctgaattctatgtctgtcctttcagactaattaactgttgctgggaacctagtgggcctatctggagggaagcggacactctggctttttgaattaccagagttcttatgctgatattttcccatctgggaaggctggtgttcctttaactgtgatggaaatctagtatagtcagttggctttgtttctggaaattttcagagggctaaggctctgtacaggtctttgttgttgaattcttgcccttggtttataagcagggagaattagcagagtgactttttcgttgttgtagtttggggtgcgatccggtagatagtgcttgagagcaatggatggtagacgggctcttatttagcagcatggctcctttgtgtacccttggatttgcagctatgcaaagggggagagaggtgcaagggggagagaggtgacctctccaccaggtccactcctgggggttgggagagccacctctgatcactgacacttggccagcaattccatttatttatttatttatttatttttaatttgatgtttcagcctcagggctcccttggacagaggtccagtagggaaatagaccacatccttactggacctgccctgtggagggaggcacatctaggttctaggccaacttgtggacctgtgcaattcacttttctcagttttctgatagtgtgggctcctccccaactagagtgcagggcacagatcctggctagataatcctgagccatgggccatggccctggtgtaccaggacctgtttgcagctccctcctccagacccttgggactgggtcccaggtgtgctataggatctgaagggctcccatgcttctggaatgcacttaggtggcacaaagcacccaggctaggcagtggagctatgctgtgtacaggcttctgcagggtggccaggtaggagttctgggaggggctggcaggcaggtggcctgtgggacagatgtgcctcagtcccacagggaaggtggccctgctttctcctcagtggttagctagggccagagcctgtcaaagggagataggcagcccttggtgggttaggctccaccaaagctgtccctagcacacagattcctggcgccatgcttgtggcagctctgtctctgtctaatctctgaagacatccacctaccaactcaaatgtccatggcaggtgtgaggtccccaggctccaagtcccttcacttaccccttcctcagacactgtttgaggccaggaagcagccctagcattcagttaccccacacagagtttccagcttcctccctcttcagcctcactgtctgcatcttctttacatccacatttggcatcttctttacaaagatctgttcaaattatgttgatttagtcaaaatctcatcctctttccatgggagcagcaattcccagctgcattgagttggccgtcttaagaccccagttgatgtataatttttaaatatttaatagaaactttaaaatattggaaaaattaatcttacattgtcacattgctcattctgaactgtcagcttccatgagtttagtcattaatttaactgtctgaactatgtattcttcaaattaaaacaaatgacataattatttggaataatttttataaaggtggacaacatgatatttctgtagtattattaaattactaatatttgggcagcacttagcaagttagataattgacttaatagtttgtaagattaatctcattgacacgtcttctagatattattttctcccataaataaccattgtttataaaatcactgtcaaggaaagattaaaataatttgatttaatgaactaaaataagtggaaggtttgtttattaactgaaagagttcggagatctgagctcaatacaagatgagtatacatcttaaatgaaaaaaagggaataatgggaaagaaagaagtcaaatgaatatctcaacatttttcatcaaggaaaatatacgaaaaaacatttgcctgtattttcataaaggcaaaatgtagatatctaattaaagtgaagatgtaaagaaggacaggcaacgcagctttattaacctacagctgctttttattgactgtccaacatccttgatgaagattagattttatcacccaccgtctcctcagggtccatctgggaggtggtgggttttgacagttgacaaacacagctgaactttatctattattcacagtctgttttctatatgaatttctgtgaataaagttttctactgctaaatttttaatagtaaaattgagaatatttttcctattgccattttttcttttatttttatacaattacattcttttacggcatcttttaatgttgtcaacctatagaaaatagtcagaattttgttgtagttccttacaagttccacaactccacttttttttaatgacttgcatatatatatatcatttactgtcttccattgatccatttattggtctgtatactggtatcacaacattttgatacttttaacttcaaaatatgccttcatatctgataaggccattaaaaactgacactgtgtcagttaaaacacaaccggagaggaagaaccaagagatatatatattaagagatttatttcaaggaattggttaatgttattatgtaggctgggtaggcaggtatgaaacatatgaagcaagccattaggaagaacaggctggcaatctcgagctgttattcatgaggagaacaactttatcaggaatcctaggctgtgttcttaaagtctttcaactaattgaatcaggccccctcctcagattatctagaattgcttatttgtgataatctcccttatgtaaagtgaatttattatgtactttcatctcttcagaaaaaaatacctttacttctttgaatagattaatgtttgaataaatgactgggaactgtagtttaaacaagttggcataaggaaaggtaatcacaactcattacttttctttttcaatactatttactagcctctgtcttactccaaataaataccaaagttgctgaaatataataatataaaatgttataaaggtagtgtttattattgttaaaaattgctgtatcttttgcataagaaacagaaaatagccattataaaatgcaagacagtttaagcaaatagaaattgaatgacaattattatagtgaaagcaagctaaaatcattttgttacaaaattattcctaaagtgtaagtttgtctgccaaattgcaggtcaaagaatttcaatagaattgtctattcattaacactattttggaagccttctaatgtatcaactatctcttgagcacaaaacagtgtgacaagataaaacattatctgaaatgtatcagttaattagatattaagaattcctatcaggtactaatctttttttaaattaggaaaaatagtaggttatcatcaaacttttgaagaaaagaagcactgctgatcattgtatgaattaatgcaactgcagagattgttttatatagtgtatatatatatcatgttttatatgcatttgtgtaaaaacatatcatacacagacacacacacacacacataaaacaataccaaatcatctcttggtattcatgggacatgggtttcaggaggcccatggataccaaaaatctgtggatgttcaagccctttatagaaaatggcatagtatttgcatatatcctatgcacgtcctcctgtatactttatctctaggttacttataatacctaatgtaatttaaatgtgatgtaaatagttgtcatactgtattagttaggaaataatgacaagaaaaaaatctgtatgtggtcagtacagatgcaaccttcccaaccattcatttaaaaaaaaaaaaaatttttggtctgtggtttgttgaatccatgaatgtggaacccaaacaatatagaaggatgactatagatgttcacgtgtgtgtgtgtgtgtgtgcactgtgtgtaaatatgtgtgtatgtgtgtgtgtaggttttttaattatatatatagttatatacacatactcacatacattgttgaattatcttacattttaataatgggatttcaaataatgttaattttaatgtggacatgttataagtgtgtaattaatggaatttaaaattctgatatccaaggctcagagctgcatttgttagcttggtttatttgctgtcctaaataaatgattatggttcacaccaagaataatcaattggtatctgctggtaataatgaccctcagacatattttagtttgttgtgttgtttggcttaccccagtattttagaatgtagtgtaattaagatcacaataccagcatcttattatcatatacacactacacttgtcatgttttatgatcattgtatctcctctaccagcatgtaagtttctgaacacttctctaaaagtaaagcataatgttcattattagtaaaaataatgagaaaataaccactacatatgcttttactatgtaacaaataatctaaatgatttcatgtattaattaaaactctctgagtaagtactattattatgtctgctttcagataaggaaagggatgcatagcaagtttaaatatcttgcagaaggacacacagtttgcaagtgaaggagctctaattcgaagactggtggtctgcatccagagttgatcatcctaaataccatgctgaactggttgctcccaaagactgaacagtattttttacaataagatattcatttgtacgtcaacaaatagttgccaattctttgtaaaataaaatacaatgaactgaataaaatttaatacatcagagtaaattttacatagaaaagtatgtattattttcttttagttatgcaattccacttatatgagctatctagtgtagtcaaactcacaaaaacagaaagtaaaatagtgggctgggggaagaggggcaggggaggggaatgggaaggtttgattttgtaggatgaaaatgttctggagattggttaaacaacaatgtgaggatacttaatactattgaactatacacttaaaattaaaaaggttaagatggtaatttctatgttacgtgtgtattttaccaaagctaaaaattaaaaaaaattagtaaaattagtcagataactgtaaattctatacttctcaaataaatcacattatctataaaaaaaagaagaagaagaaaaagaaagtaattgagaacagttcatttttttacttggaactctccagtagtagcttttcatctcaggatgaaacacaatagttcttaacaatggtcttaaagggcctgttcagtgttcaagtctcagttttatgtcactctctcttacctcattctgctccaatcacactgacttctgtgttgtttcctgaccatttcaggtactttctggttcaacgtattgatacttgctcccctttcacctacccacacaggagaaccaagtttatttaagaacccagaagactagggaaaaaaagaagagcaacaatatcaaactgggaatcataaattatagattctaacagaaagccaacatattagtcctctgtaaaatgtgaggctttgtatattgtgtatttatattattctggttgtacctagctgcaaaggagattgggataggcacttcttattctacacaaccatgtgctacaccaaaagctgaagaaaaaaaaataaaagaacagatactgagtgataattagcattctataccatacaatattgaaggtgatggctaaccttttgtcccagtatgtcatgcttataaaaattttatcttatatgcttaattatcacctactacatccagagagtggtatatcctatacaaaaactcatattggtgaatgtttacctatttattagatttttcacactatactatctactattttgggggaaagttttccttatttattcagtaagtttgtgcattatctataaacatggatccatacctataacctttcaaaaacaatggctctgctatttgaatagaatatacatttagttttaaaaattgtacctccttgtgcaatctttgcaaaaaaaatcctttaatatttgccttcacgtttctaagctgagttattatgctactttcacctcttatattcacttttcacttcaaaactatacaacaaaaagagtagcattcaaatcatttctagaccccaaatttcttttaatggtactattaatgcctagcagttagcaggccagcaacaaagatctattcttttaagaatgatgtgcaagaatcagattcttggttatgcactggcttagcaatgacagttatgttacattcattcaactgatagaccctatttaaaattctaaagtagaaaataatagattagcttcaaatacatcctgagggaaataaggcttttcaaaatgtatttagtaaaagccactgtttcacacaaaggaaaaaagaagatggagatatgtgtgtgtgtgtgtatacatctatatatacacacacacataaaaatttaaatttatatatatataaatttatatatattattaatatatatattatatatataataaattttatatatataaaatttagtgggtttacatctttttttctgttccactgcctacagaacatgaatttgaaggcttacctattataatgagattattatatttctagccaacatacgctaattaacttcaatttaatgccttttggtacagtgttattgtatgggataagcattgcttctaaacccatgagtcagctatattaaataggatttggaatcttaccctgattaaaaaaatgacgtgaaaaccttatgttattatgaaaaccaagggaacattaaaaaaacattatgctgtgttcaataaatttttaaagttgtcttctacaaaattagaaaattatcatatcttaagctatgagtgttagaaaatgtatctcaagaatttaatccaggaaaaaagcctccattcagatacacaaaaagacatacaaatcgctctattgtttattctataaaatcatgaaatatactagaccagccactttagcaaacaaaagcaatattttataaaattaaataaacattatttagaaaaatttcctattatgatccaaaatcttacctatttgtacatgtacatagtttcatatgaaactactcctatgacatttaattcagaaataaacctacctactcagacaaatacaaagacacaggttgacccttttcaccctgtcttcatctcctcctattcctaggcctttaaaaattacgagataactggagcaaacattttgaataccaatattatgatatctagtatatatgaaggcactactttataatgtaagaagatgacaattgtacacacaaatacagacacacagaatatttgcttatatgtatataaggagaaatagcagtattcaaaaacatttccatcaatatgaaaataatgaacacccatggtgtagtgatatagtgcggtactataaacctctgataaaatgaatggactggagttaagtagacaaatcttatgaatattttattgagtgaaagaaaagcttaatctttcaaaacaaatacgttgcaggcctagaatacatatggaatttttactataactttaaagttgtatttgtaattttttaaaaaattggatcaatacttgaaatgtctttattgtaatatttttatattttagatgtagttaaattaatctagactgaaaaataagatgtctaaatattagttattaagatttagttaatattataaaaccttattcagagagatattaacatttcaataaggattacatggagaccaaaaattaacaaagtaaataaaaaaggataatagtaaaatgatagagtataaagttggtttttgaatttttaatttaaaaatcagatgaatgagaaatagtaactttttgtttaaatttgcattcccttgattgctaatgaggttaaattttttaatctaatttttgttaagcatctattcatatattttctttatattttcaattgggtttttctgtctttttctctttgatttgagaaagctctttgaaatcctctatatgaatgctttacctgttttatgggttatagataaattctcccaattagtgtctctttttttaaactttgtgatgttcttggctgtgattcttttgattctcttgtttttggtatgttgatacatgtacatatctttgccacaatattaatattgttttaaccataatagtttgacaaaaagtgttgatatctattagagaaaatacttccaccttttttcccctgaatattctttgctgcttttggtcagtcttccattgatcttaaattttaagatcatcttttgaaatctcattaaaaaactgatattttgaatggaattgcattgaatttataaattaatttggaaaagacttgacatctccataataaatctttccttccaggtacatggtgtaattttcaatattaaatttcaattttatatatttaaataattattttaagttttcccacaaatggcttatctctggtttaatagtttcctggggagcttaagactactttttttttattgtgactgtaaatttttattatgaaaattgattaatagtgatgcataggaatgcaattgattttgtatgttgaccttgaatccagtgaagttggtgaactgtttcataatggccactatctattcataaacattgtaaatatacaatatttcattagtagaggcaattatgtttattctttccaagttgatattactttattctttttcttttttctttctttttttttttttgagatggagtctcactctgtcacccaggctggagtgcggtggcacaatctcagctcactgcaagctctgcctcccgggttcacgccattctcctgcctcagcctcctgagtagctgggactacaggcgcctgccaccacgcccagctaattttttgtatttttagtagagacagggtttcaccatgttagccaggatggtctcgatcttctgaactcgtgatccgcctgcctcggcctcccaaagtgctgggattacaggcgtgagccaccgcgcccggcctactttattctttttcttatagttttttatgcaacctccaatgaaatattgactaaaaatagagttaacaaaagttttgtttacgtgtttttctgttcctggtttaatggaaattgttatgaattccacattatgaatgttgtttgctgctgagttttgaaagttatctttaacagagtaagaatgttacctttatgtcccggtttaagtgtcttttttcttttcctttcctctttttatggagaagaaagtgaggaataatatttttattaatcctatattattaaatgactgtttaagtagctatagaaattgacataaaaagctgttcaacatcattagtcactagggaaatgcaaaataaaatcacaatggcatgtaattacatacctattaaaataggtataataaaaaatatgacaataacaagtgttgacaaagaggtggagcaattggaaccactgtcctttgctgatgtgaatatgatatgttatggccgttttgaaaaacagcttgatagtcctttataaagctaaatatacatttacaatacaatacagcactggtagttctaggatttaacttagagaagtgaaaacaggttcacacaaatagctgtatagaagctttatccataatccccctaaattggtgagattcaaaatatcttctaactggtgaatacatgagcaacgtatgatacattcatacaatgaaacactaccctgcaattacaactgataagctaataatgtaggcaaaaacatgaatgaaatctcaaatgtgtgttactaagtaaaagaaagaggctatatagtcactggttccatttatatgccattctagaaaaaaaatcactatagaaatagagaacaaattagtggtattggaagttaaggtcagagtttgactaaaaaaggtaaagacaagaagattgtttgggtacgaacagttgtatttatgattgtggtactagctgaagaactctagacactgtaaagcccatagaacaaaaaccagtaggaaaaagaattgggttgttttcctatggttacattttcaatgttctttacattattttaatataagctctttcacaggcatgtactttgcaaatattttctctcagtctgcagcttattgttcaatgtcttaacagcaatttcacagagcaaaattttaattatgataaatgccaatttattttgttattgaaaatgcttttcatagcatgtctaaaatctctttacctaagccaaattaaaaaagatttccccccatgatgctatctaatacaagttttatagttttaagattaacatttagtgtgtccagagctggttcctgctggtgggttcatggtctggctgacttcaagaatggagctgcggaccttcacagtgagtgttacagcttttaaagatggcacagacccaaagagagaatggtagcaaggtttattgtgaagagcgaaaggacaaagctcccacagtatggaaggggatctgagcaggttgccactgctgactggggtgaccagcttttatttccttattggtccctcccatgttccatttccatcctatcagagtacccttttttcaatcctccccacgattggctacttttagaatcctgctgattggtgcattttacagagcgctgattggtgcattttatgatccccttgctagctacagagtgctgattggcgtgtttttacagagcgctgattagtgcattttacaatccccttgctagtacacagtgatgattggtgcttttttacagaacactgattggtgcattttacaatcttctttaaagacaggaaagttcctgactggtgcattttacaatcctcttgtaagacagggaagttccccaagtccccactcgacccaggaagtccagctggcctcacctctcattaggattatgaacatttcagttatctttaccataaaatgtgagttatgactcaaggtcctttttttttcatgtggatgctcagttatttcaactctatttgttgaaatgactgcattttccttgttgaattactattgttaattatcagttggtaataataatgtgtgtctatttctggacatcttattgtttcatagatctttgagtttgttgttctttaccaaaaccacactttcttgattactgtagctttagagtatactatagtacagtatgctaaatcttatatttcacttgtgtgactacaactttctccactttgataattttcttagtcattttaatttgtctgcccttccatataaaatttaaaatcagcttatctatattaatttttaaaaacttacttgtattttggttggtattgtgttacatctgtagataaatttggggagaatttatgtgtttactctgtgagattttctaatccatgaacacaagaagtctttctatttatttaggccttctttgctttcttttgtcaatgttttatagttttcagcagaacaatcttgtacatatattgttattatatctaaatattttatttcttaaagctaatgtaaatggcttaatttatataatttaattattgatatatttgaatgtatatcactttgctactttgtaatatttttcctatttttatgagttctttgtttctattttcctgcatcttctgccttagtttggactgttttttttggtgattccatttttgttagtacactggctccatttaaatttttaaattgttctaagttttacaatacacatctttaacatcacaatttacttcaaaccattttaaactgctcagaacattatgcaagcaatttactccaatatacttttatcttcatcttcctctctttttctgctatttttgttgtagattctacttctacatatgttatacattcaaacaatacattgttactaatgtttaaactgtcacttactcttaaaagaaattgaaaaataagaaaacgtactgcattcatcattcctttgtttccatatatttttaaaaactaacttatttttaaggaagtttacaaatgacaaattcttaacttttctgtgtctaagtttactttgccttcatttctgaaatataattttgatgatgagataatttaaggtgacacttttgttcagaatttaaaacttcattccgttgttatcttgcttgcagtttctgatgggataggtactatcatttttatctttgtttctctccatgtaaggcttctttctgggcttctaacaaaatttctttttcactggttttcagcaatgacattctattgtgcattgttttaggttttctatatttttaacccacttgatgctcattgaccttcataaatctgtgggtttttagtttacatctattttggaagaattccaattattattactttaaatatgctttccattttgcccctttcgaggaatctataaatgtgtgtgttatattgtttgatattgtatcacaggagaatgagacatctttataacattgtcctttattttttatttttatttatttatttatttatttagagacagagtctcgctccgtcgcccaggctggagtgcagtggagtgatctcggctcactgcaagctccacctcccaggttcatgccgttctcctgcctcagcttcccgggtagctgggactacaggcgcccaccaccatgcccagctaatttttttgtatttttagtagagacggggtttcaccctgttagccaggatggtctagatctcccgacctggtgatccacctgcctcggcctcccgaagtgctgggattacaggtgtgagccacggcgcctggccaacattgttctttataattatcttcatatctttgtgttcactaacttttttttactgtgcctaacctgctatttttcttatccattgaatttttcattacatttcattttgatatattctattttctttttcatgttttcttttaaatacttgaatatatttataatagcagttttaacacttttgtttcctaatctcatctctaatatttcttaattatttttaatttatatgtttcctgaacatttttacattttcttaattccggatctgtctactaatgtttgattacatattacacatcacaatttttatatatgtagtatttttataaggattttattgtctttttttaaaggccattggtttttgtccaacttatcagttgaattacttttattttttcttttgatgctattttaataaaaatttatgagtgtgggtctagagtagccttaattctagggatagctttagccaataccaaggtgtaggccttctagtgtctctactgcatgcctgaagtgaacgttgagggctctcttctcttgatgataggaattagaaataattttcaaccctgtttaagctttgagaactgttcagctcacatctcctcagtcattctttgactaatctcctagagtttcacccaatgcactcacatcttggtagtcattaaaaatgtaagaggaccactgtttagattttattctgcataactcctttcattgtggaactctgccctgtagtttccagcagcctcagacttctggaatgccaacatgtgtttcctcaactcggtctaccatattcaagtttttattaccttccctaccctgtagctctaagtgaaacttcaggcaaaaagtagggcaacctcaaggccatctcgtttgttcctcccatttcagatatcacagccctgtgctgcctattgtccagtgtctgaaatgtttgttttatacagtatgtcaatttttaaaaattacctaaagcattagagtaaatccatctctattactctaataaggtcaaaaactattctgaaattgtgttcctttctgagagaaaacatgtttccaaaaatatcatatattttggagtccattgttggctatgttttccaaacttggggtataaatttattccatatctgcttattgggtacctcaatagtaatatgtgaaaggtaagaatttaaaggatttttaagatttctgattgctctggtattcaatttggctttataatgtgtatatatatatatattttacatagaattagtagtttgataagagaaattagtgctttgggcttatgaaagcagtataatatgacaactaactgagtctgaattattactgacatgactggagcctggctctttcactactgtcttaatctgtttgggttgctataacagaatacctgagactgagtaacttataaggaattaaagttaattttctcatagttctggaggctgagaagtcaaagaccaacctgagactgagtaacttataaggaattaaagttaattttctcatagttctggaggctgagaagtcaaagaccaacctgagactgagtaacttataaagaattaaagttaattttctcatagttctggaggctgagaagtcaaagaccaaggcactggcaggtttagttgtcttacgagggtccactctctgcatctaaggtggcaggttaaatgctgcatcctctggaagggaggaagcccgtgtcttcacatggcaataggttgaagggcacaaagggacaaactcccttggcaaagccattttgtaaggacacttaatctcatttacgagggctttgtcttcatgactcattcacttcccagaggacgcaccttccaatactattactttgaggattgaattttaacatgaattttggagagtacaaaaacatcaaggcatagcacttataagccataaggacttgtataattttgtggaaaattacacaaattactcatactctccatccctcacattgctcagctgtaaaatgaggataataaaagtacctgctttaccgtgtttgaattacttaatcaaattaactatatttgctgcacttggtgttttatagtcatcggggatgccttgctgcagaatcttagggacatcattcacactgtattctattttttagcactcagttaatattatcatttgttatttttcttattaacattgcatgtgggagacatacttctgtacaaaataaaacctatatatataaatttaacttcaggccatataaaatatttagtcttctctgccaattgtttgtgcattttattttttcaatttactttaagattaaaagatttttttcctcctaaaatcctatttcatcatctaaattttatcattttcaagaagtggtaatattagcacacagttttctctaattttgtatattataaataagttcctataaagttatatgtaaataaatattagaaacaaacccttgaaaggcttactagttaaaacaaaagtacattatttagttactcaagtaaaatttttctataacttatattgatgcccaattaaagtttttctgtttttctccctgtttgatactgacagtaatcacagagagtaagaacaattactcatagggaaaagtcaattagatatataacaaatctgtcaacagctacactgaggctagagcacagaataacacatgttcagggaaagaaaagtcaaaataaaactgtaaaaccccaaaaaaggaatatttcaaaaaagatgtgaccacttgtgtcaaatattgggtttttgttaaaattgatcattgcatttagtaatgtagagtcatagatgacctcgacaaacaattttgataaagtgtttagaaaaatatctgattattttcaaatagaattagaaaaggaaattggaagtaaatatcacatatgaaacttctttatagtgttttactttaagaaattaagaaatgtgagtttttagctagaatgtaaagtgaacagaggatttgcatgcgtgtcttctctgtgagagaaataatagcatttctccagactaataatattgatctagtaaagagagaaaaattgtttttgcggaatagtcagaaaaaaaatatcctggagaaatgtctttgatgtgtttattttaaagctgttggtattggactgtggaaatgttcttctggaggataagaacagggatgcgatgttggggtttaatgagaaaagataaagtatgagaaaagttatctgttagagtgaaataataaatggcccaggaaaatacaataggctcatatggcatccttaaagagtcacttgaagctagtgatcatgaatttcaagtgacactaggcggcattgttgaaagtttttttccagccatatgcttctaggtgaagtgagccacagatatctggctgtgcggagtatataaagagatggcttaatgagaaacacatttttaacaattaagtgcaaaaatgggtaaaataggttgaggatacatgaaaggaagcaagtataatgactgactaagataagaaagaagacaagaacagacattagaggtacgaaagaaagggaaaatatggtaaatgcaactgattcaagataattgtgaggttactgcagtctacagatggattgatcactatgagtgggttgcatatgtttgtaatgataaagtcaagggtatgaccacagcagggaatggctgacataagattgaagacatgaccattggaggagacatgggacgaagataccagagtattggaaagaatcagcaaaatagagccaagtgcaatgactcatgcctgtaatcctagctactcaggaggctgaggtgggaggatccctggagcccacgagttcaaagctgtactgagctattcacaccactgcactccatcatgggtaacagaacaacactctagctcttaaaaaaaaaaaaaaagattcatcaaaatggacagacattgttgaaataatttttaagaactatgacaatagtttttctggaaagactgacagtgatctaagaggagtaaggtagaatggtaggtgattgggtgttgtagtctggtgacattatatacaaagattagtggttttatagggataaaagagagagtagacagtaacaagtgattattagcgaagaggacaccaaccttacctgcagaccccacctctgacatggggtgtgaggggtttgagaatgacaacattcaccacttgagattaacacaaaaaatgattattcatttaagtgagtgcacacacacacatacacacacacacaatcatgtttctggatacaaaaattcttaacaaattctgaaaaactcaagttatacacactacaagctgtgctctctgactataatgcaataaaatttaaaaaattgtataatcaaagttaaactcaattttcccatgtacttagaaactagaaatcacattttaagtttgagggttaaaacagaaattattattacaactatgtaatatttggagctcatttaaatgaaatcatcatatataaaggcaagcattatataacaaaaattatacttagaagaaaaatgtgtacccataatgtatgtattaaacaatgagtaacattactttctaaaaacataaccaccctgttaggcactttctaattcttaaagaaatgtcacattatagatatttagctgattttattaaacagccaagggctcagagagacttagcacctcagtcacgaagctacttagaagcaaagggcaaaggttggatttgattttatatctgttttataatccgccaatcatactgcagggaaatgaatacatagccttagcatgctgaacttactagtcatgcatcacttaactaagagatacattctgagaaatgtgtggtcgggcaatttcgtcatgatgtgaccgtcacagagtgtacctatgcaaacctagatggtagagcctatcatacctggactatacggcataacctgttgttcacaggctacaaacctgtacagcacattactgtaatgaatgttgtaggtagttgtagcacaatataaagtatttgtgtatctcaacatagaaaagctacagagaaaataatatattatgattttatggtactacatgtggttcttcattgacagaaacatgcagcacatgattgtacttgttcgcctgtttgtttgtttgtttttgagacagagtcttgttctgtcacccaggctggaatgcagtggcatgatctcagctcactgcaacctccgccttctgagttcaagtgattcttgtgcctcagtctccccagtagctaggattacacgcatgtgccaccacacctggctaatttttgtatttttagtagagacagggtttcaccatgttggcaggctggtctcaaactgcagacttcaagtggtctggctgcctcggcctcccacaatgctgggattacgggcatgagccaccgtgcccagccacaagactgtacttctttccacaaaaccatagtctttctttccctccgagaatgacttgttctccatcctaacatccaaccagaggaagatcgctgtcccagtatttagacatggattctgatgacttacatatgtgtatatatatttagatataatgttagcctcccttttcctccctgataaagctctgttgtgtgatgggaaatgaatgactcccatcagattggataactttggcttgcctaaagtgcaaggactacatactgctgcaagtgcctcaaagaaagttcatagaactctttgtttctgaccattttgtgatgtcattttctgaaaattcacatttctgtgtctcctgttgactagaataatacaaaatctggaacaatttgctactttcttatcgaaagtgttttgctgctgcttccctagtggccttgttccctgcagagcactctgaattgcatgatgcattttgcttttagagaaacaatattttcatggtctaaaatcattacttggtaaggaagaacttaatgtttgttccataatgcatttggctcagaaaacttatatttctttttccatatttttctttctctataaaagtccaattataattaggaaaggtgtttctccacaaccaccttatttctttctcttgccgttgttgaacctactcaataagtaaaagcaaaacaaaaacaacaatgacacaataatttaaataaaaaggaaaaggggcaagttttaaaatttgcttttcaaaaatttagaggcttcaaaatgggactgttcttttcctgcctgtatcttatttggtattagcatttaaacaatatccagtaaaacaatgcatttgcgttactacatttctatttaggaagcaaataaacattaatttctttgtggaaaaatatgcatattttagaactacagatattacagtgaaataattaaacccaagttaatgaaagttgagaattactatacataattactaaatataaaaatcagagagatctaaatcatggtatttccaatattttcagcttcccaaatatttggaatgtttcagaccaagtgaatttccctgttttatctatgttgagaaatgttttacttcatgtctttttgctttatgttcaagtattttttcttccactgatcatttacaaaagcttccacaagagataagaaaccctgtgtgatcacaaaaagaattgatagatgttggatgactttttagttttatgtatttttgtagttgtttcgaaatgcatcattatatttcttaataactttcagcagaaatctcagacatgaaaataactttgcttacttatgtattctgattagttaacaaagatacagatgcttggaagctagattccctcgtctaagtaagatatgtgttctttgtggagaaaactcattgagaaaagcaaatgatggattagaaggtggctaatgaagaaagaattaaagcaaaggcgactggatgtttttaacagctcttccatctggataatctcactgaatgtaacagataactctggaaaacttttttacaagtgtgagaaaattagactatcttaggccaggtgcagtggctcacacctataatcccagcactttgggaagtcaaggtgggcggatcacctgaggtcaagagttcaagaccagcttggccaacataatgaaaccctatctctactaaaaatgcagaaatcagctggggtgtggtggcacacacctctaatcccagctactttgggaggctgacgcaccagaatcacttgaacctgggagggggaggttctagtgagctgagatcatgccactggacaccagcctacacaccagcctgtgcaacagagtgagactgtctaaaaaaagaaaaagttgtgccattgcactccagccagggcaacaagagcgaaactccatctcagaaaaagaaaaaagaaaaaaaaaatttagactatcttttccttctaaataggctaaataggtaaaaggtggaaatttgctgttgtctttccattttccagattgctcattggattgcatcctttatattatgacaaaaccactatcaaagtcccattgtaattggtagtgttttcctggcttgtgtgaggaatattcctgtcatttcttgtttcttaaatgtatctcttaatgttatgaatcacattcatcaagatggcttcaatgtgtcaccaattactctatacataaacacatcaaatgagttattattgcttccttgtttgttaattaaataaaataatcacaaattattgcacatttgtgtatttttctttttccagcctgctttcttttttgtttcatccatagcttttcccagctatcagtacacatgcctgtcactgcctctccctcccactttctttgttacttctaacgtgttgctgagttagaaattagattgccaaggttgctgttgtctgtgtacaaaataaaaataaattactctgtgtgatggcgtaatggactcttctacatacattgccttgaatttagcataaagcagtattctattttctcaggagtgtcatgttaaaactgatgtcactggatgttaaaagctgcttagtataagagatttaaaagttgaatacaaacttataaattatggaatgaaaaaagagctaaagatgttcctttacgaaacaattaatcagggcctggaacatgtagagttcatagtgaataaggaggaggcgaagatttcattggtatttccacacatactaggtcatgtaattttgtgttgtttttcttcagaacatcttttaggacagtattctcaggaggctagtttaaaaaattttggcttatgaacattatgatatccattttataactgtaatattaacattatgatatccattttgtgcttattacctgggctgtttttaaaaaaaaaaaaaaactcttatttttaaacaagtaatgcgttcacatgtaacaaagtttgaaggttttgaaagactagtaggtgaacaacgtttctttctccttataaaccccaggcccccagtttccctccttaaagtcagcaatgtacattctttgattgttctggagatacatagaatatatcttttagacagcatactttttttacgtattactttttcacttcacaagataacaaagaccattctgagttgacagagtgtctgtttacattttttttctttttttttttggagacagagtcttgctctattgcccaggctggagtgcagtggcaccatcttggctcactgcaacctctggctcctggattcaagcaattcttgtgcctcagtctccaaagtagctgggactacaggcgcttgctaccacacccagctaatttttctatttgtactagagacagggttttaccgtgttggacaggatggtctcgatctcctgacctcgtgatctgcctgccttggcctcccaaagttctgggattacaggcctgagccactgcgcccggcctcaaatctttttctattacaaaatatgctgtcaatgaatacacatatctataaatataaatgtttgcacatacatgtgaactgtttaaatatgtctgaagtcttacaatagtaagactgttacagtcttgtgttacagaaacatgagtgggtgagaatgagataaatcataaatataagggaatataaatttctgatttagggtgtgtgtgctttatatatacatacatatatctaatgtatatgtatacaaggagagggagaaagactttaagtattgtaaattttggcatttataaaatattttataacagaaaaacataaaccattaaagaaaaaggagaagggattagtgtggagcttgcctgagtactggtttggcaggcttgcacggcacataattaggcaacatattagcactggcttctaattcttatcttacgttgtatggattatggtaaactttctgaaagcttaatcacatgtaatgtaggaaattatctgacccttcccaataattactataaagaataaatgaagttacattggtgaaaacattcctagaactttattttcaaacatgttgtttcagaagacttgtgtcagaaaaatcttagttattaaaaatctttaatcaggattaaaaaagaggtatgtttccttagataagttttcccttatcttgttttattttttttaaatattgcattgtcatagactttttttttccctaaatatgtgaggtaagaaatccaggtagcttaatttattataggtacccccattgtcctgggtatatttgaaagacattcaatattgaggtgggaccaagggaatttctaatggcagtgcattattctgttcaatctattgttcttacatgagtaccatgtcccatccatcacctaaagttctctccaggccttgctgttgtgttgtgaaataggcatttgctgttatagttctaggatcactgcttacagccttctttggtgtatcaagcagcattccaaaagaaaaagacagactgctttaagctcatggatatcgtgattatttattcagaggagaaatgtaaggctatgcttattgtcacagagaaaatatctctattgccaagttgctcttttttttggtggggggaaggtatatttaacacttcacactgaagatgtaactctcatggcatcttggggaccatctggtctgaattaggtacaggacaataaaggaggcagttaatttataagaaagatcagtgattcggatggggagggcctggcctctgatctctcctagtcatttatagaataaaaacaatgacgaagagagttaagctacaatctaagaagcagaattgcaaacctgctaggtgactcagtctccagagcttaccttccccctttacataataaatttagagagtcctgaaatgttattttctttgacaacttaaataccatagtgttgtcatctctcagtaaccatgggagattgattccaggaccttccacagatgccaaaatccaagaatgctcaattccttgatatacaatggcatggtattcgcatataatctaagcacatcctccagtatactgaaatcatctctagactacttatgatggctaatacaatgtaaatactatgtaaatagcagttatattgtattgattagggaataagaaaaaaagtctgcacatattcagtgtgtatgcaatttatatatagatagatatacagaaatttttatgtagatatatttttcttctttttttttcctctctctgctgttggttgaatccaaagatgtggaacccatggatacaaagggctgactgtattctgaaaaaaagaaagaagggtgtgggcaagacccagtttagatgagatggccagggaaagtaagttttgctatagatatttaagttggtttcttctccattgataagagtctctaatgatttagtcatacttctcttcctggtgcagaaagaaagacacttttactaatggaaatttcattcatagataaaactttcccctataaaagggcaatttcttagagcttcaatgttacagtttctcaaaatgagcagatcaaattaattctgatgccagaagggtatattttagagtggcatattctaatctcctacagtcatattttggtgttatgggtcctaagccccatcagtttatttgggttttagtttcctcattttaaatgggtgtaagaattatatgtatctcaacaacaattgtgaaaattaagtgaactagtatagaaagtactcaaaaggttgcctagcatatagttataagaaataaaagtacaatcataagtccctcaactgactgagccccctcttggccatggggatcccagagaaaccttggaagctgagttgctggtcatgatgggataggaagtctgacacaccccattatacccctcccctgttaagagcccttaggctttcttccctaagggctaaatggaaaccagcctttcaaaaggctccaccactgatttcaaccaaccacctgatgctgcccctccctttgtggttctcacacaaaagccaatcagcattccttcctgattagagatcaccaatcacagagtggttctggccagtctacagaggccacacagagaggattttcttgttctctgcttcatatttttatgttggagagctgaaaacttcacccttggatcatattaaggctgccatttctgaacatgggactcatggagagtcataaagctcaattgtgcatgcacatgtttctccttttataaatatttgtgactcatcccatagcttattgaatatgtatatttggccaccccattgagcataaattcttgtcttgttcttcctactcttaaagtgcttgtttttggcttctggcaggaggctacccttcccagcctgtcagaatggcgcccataggctgcaaccctttatgagaaataaaactctcctttccaaatttatgaacctcatcattctagagttgatagtacacacagacacacataaaatcagttgttatgaaaattaagttgataataaactgtattagcatcaaatagaaatgaaaagtgaggtcttaatgtagctagcacagacacagcaactactcacatattgaaacaaagatgataaacacattccgagcgaatatgaagatatctagacacatattttagaacaaaattaggttgaaaatttaagcaagttaaagtgcaataaagtataattagaaaaaagaaaatattaatctcaaaaattacaagccatgtggtgaatccccaaaacatacatatagcttcatctagcaaatactatgaaatacaatatagtaatcacatatagacctatatatgtatattatatatgtataaacgagcttctttactcaaataaagatactgatagattttacgacacacctccctaaaagaaaagcagaacatgccacctcagatatgcctctttgtgtaaggattattttcatctgatcattttgagaaactgcagatacaggataagctttaaaaagctaccctcttgtaagagaagggtacatgtatgaaagaaatcttcatttctaagggtgtctccctctttgcaccaggaagggaaggatgaatgagtcactgagactcatcaatggagaaggaactgagagttaagtccgcatgataaatcttgccttttttgaccacctgatcctaactgtgcttttccccacattctttttttctttgtttttgaaaaccattgtactagagcttagagacagagctacaatggttgactcatgaacaccatgggtttaaactgcaagggcccaccactagtggactttcttttgcctcttctagccttgagagagcaagatgaattttttctctttctcctcctcctcagcttaatgtgaagacaacaatgatcaagacatttatgatgatccacttttatttaataaatagtaaatacattttcttttcctacgattttcttaatattttcttttatctagcttattttattgtaaggatacagtatatcatacatataacatacaaaatatgtgttaattgactgcttctcttgtcattaaggcttcaggtcaatagcaggctattgggagagctgaaagttgtgagcaaattttcagctgactagaaattcagtgcccctaatgcctgtgttgttcaagggtcaactgtactttgaaatctactttagagatttactcatttctctgggttaactcccatgtatataggagttacacacgttattaaacatttgtgtatttcttgttaatctgtatctttttacaggggctcctagctaagaactcaagaggggtagagaggaaaattattccttctcccctacaatatgctttaatattttcatataaagtataatgagtcattatcttataacactgggtacaataactatttttagtgtaaactacaatattcatctcccacttactactgagctttatactttttaagctcaaagaagtcattatttatatattaaaagcaatatttaacataagtattttctgagtctgacaatttctcactttgaaatgtaaaaacaaaatttggcattctatgatttgacaacttattatttatgatcctctttcagaccattatgtatttgctttctctgcccttcagggagataaaaatatcaatcttttctctggggtagtctgcatttcatctgcctgtgtc

SEQ ID NO: 2 - DNA, 6456 bp, Homo sapiens
gagttgtgcctggagtgatgtttaagccaatgtcagggcaaggcaacagtccctggccgtcctccagcacctttgtaatgcatatgagctcgggagaccagtacttaaagttggaggcccgggagcccaggagctggcggagggcgttcgtcctgggactgcacttgctcccgtcgggtcgcccggcttcaccggacccgcaggctcccggggcagggccggggccagagctcgcgtgtcggcgggacatgcgctgcgtcgcctctaacctcgggctgtgctctttttccaggtggcccgccggtttctgagccttctgccctgcggggacacggtctgcaccctgcccgcggccacggaccatgaccatgaccctccacaccaaagcatccgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacaggccaaattcagataatcgacgccagggtggcagagaaagattggccagtaccaatgacaagggaagtatggctatggaatctgccaaggagactcgctactgtgcagtgtgcaatgactatgcttcaggctaccattatggagtctggtcctgtgagggctgcaaggccttcttcaagagaagtattcaaggacataacgactatatgtgtccagccaccaaccagtgcaccattgataaaaacaggaggaagagctgccaggcctgccggctccgcaaatgctacgaagtgggaatgatgaaaggtgggatacgaaaagaccgaagaggagggagaatgttgaaacacaagcgccagagagatgatggggagggcaggggtgaagtggggtctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagggaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggagatgctggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacggtctgagagctccctggctcccacacggttcagataatccctgctgcattttaccctcatcatgcaccactttagccaaattctgtctcctgcatacactccggcatgcatccaacaccaatggctttctagatgagtggccattcatttgcttgctcagttcttagtggcacatcttctgtcttctgttgggaacagccaaagggattccaaggctaaatctttgtaacagctctctttcccccttgctatgttactaagcgtgaggattcccgtagctcttcacagctgaactcagtctatgggttggggctcagataactctgtgcatttaagctacttgtagagacccaggcctggagagtagacattttgcctctgataagcactttttaaatggctctaagaataagccacagcaaagaatttaaagtggctcctttaattggtgacttggagaaagctaggtcaagggtttattatagcaccctcttgtattcctatggcaatgcatccttttatgaaagtggtacaccttaaagcttttatatgactgtagcagagtatctggtgattgtcaattcattccccctataggaatacaaggggcacacagggaaggcagatcccctagttggcaagactattttaacttgatacactgcagattcagatgtgctgaaagctctgcctctggctttccggtcatgggttccagttaattcatgcctcccatggacctatggagagcagcaagttgatcttagttaagtctccctatatgagggataagttcctgatttttgtttttatttttgtgttacaaaagaaagccctccctccctgaacttgcagtaaggtcagcttcaggacctgttccagtgggcactgtacttggatcttcccggcgtgtgtgtgccttacacaggggtgaactgttcactgtggtgatgcatgatgagggtaaatggtagttgaaaggagcaggggccctggtgttgcatttagccctggggcatggagctgaacagtacttgtgcaggattgttgtggctactagagaacaagagggaaagtagggcagaaactggatacagttctgaggcacagccagacttgctcagggtggccctgccacaggctgcagctacctaggaacattccttgcagaccccgcattgccctttgggggtgccctgggatccctggggtagtccagctcttcttcatttcccagcgtggccctggttggaagaagcagctgtcacagctgctgtagacagctgtgttcctacaattggcccagcaccctggggcacgggagaagggtggggaccgttgctgtcactactcaggctgactggggcctggtcagattacgtatgcccttggtggtttagagataatccaaaatcagggtttggtttggggaagaaaatcctcccccttcctcccccgccccgttccctaccgcctccactcctgccagctcatttccttcaatttcctttgaacctataggctaaaaaagaaaggctcattccagccacagggcagccttccctgggcctttgcttctctagcacaattatgggttacttcctttttcttaacaaaaaagaatgtttgatttcctctgggtgaccttattgtctgtaattgaaaccctattgagaggtgatgtctgtgttagccaatgacccaggtgagctgctcgggcttctcttggtatgtcttgtttggaaaagtggatttcattcatttctgattgtccagttaagtgatcaccaaaggactgagaatctgggagggcaaaaaaaaaaaaaaagtttttatgtgcacttaaatttggggacaattttatgtatctgtgttaaggatatgtttaagaacataattcttttgttgctgtttgtttaagaagcaccttagtttgtttaagaagcaccttatatagtataatatatatttttttgaaattacattgcttgtttatcagacaattgaatgtagtaattctgttctggatttaatttgactgggttaacatgcaaaaaccaaggaaaaatatttagtttttttttttttttttgtatacttttcaagctaccttgtcatgtatacagtcatttatgcctaaagcctggtgattattcatttaaatgaagatcacatttcatatcaacttttgtatccacagtagacaaaatagcactaatccagatgcctattgttggatattgaatgacagacaatcttatgtagcaaagattatgcctgaaaaggaaaattattcagggcagctaattttgcttttaccaaaatatcagtagtaatatttttggacagtagctaatgggtcagtgggttctttttaatgtttatacttagattttcttttaaaaaaattaaaataaaacaaaaaaaaatttctaggactagacgatgtaataccagctaaagccaaacaattatacagtggaaggttttacattattcatccaatgtgtttctattcatgttaagatactactacatttgaagtgggcagagaacatcagatgattgaaatgttcgcccaggggtctccagcaactttggaaatctctttgtatttttacttgaagtgccactaatggacagcagatattttctggctgatgttggtattgggtgtaggaacatgatttaaaaaaaaactcttgcctctgctttcccccactctgaggcaagttaaaatgtaaaagatgtgatttatctggggggctcaggtatggtggggaagtggattcaggaatctggggaatggcaaatatattaagaagagtattgaaagtatttggaggaaaatggttaattctgggtgtgcaccagggttcagtagagtccacttctgccctggagaccacaaatcaactagctccatttacagccatttctaaaatggcagcttcagttctagagaagaaagaacaacatcagcagtaaagtccatggaatagctagtggtctgtgtttcttttcgccattgcctagcttgccgtaatgattctataatgccatcatgcagcaattatgagaggctaggtcatccaaagagaagaccctatcaatgtaggttgcaaaatctaacccctaaggaagtgcagtctttgatttgatttccctagtaaccttgcagatatgtttaaccaagccatagcccatgccttttgagggctgaacaaataagggacttactgataatttacttttgatcacattaaggtgttctcaccttgaaatcttatacactgaaatggccattgatttaggccactggcttagagtactccttcccctgcatgacactgattacaaatactttcctattcatactttccaattatgagatggactgtgggtactgggagtgatcactaacaccatagtaatgtctaatattcacaggcagatctgcttggggaagctagttatgtgaaaggcaaatagagtcatacagtagctcaaaaggcaaccataattctctttggtgcaggtcttgggagcgtgatctagattacactgcaccattcccaagttaatcccctgaaaacttactctcaactggagcaaatgaactttggtcccaaatatccatcttttcagtagcgttaattatgctctgtttccaactgcatttcctttccaattgaattaaagtgtggcctcgtttttagtcatttaaaattgttttctaagtaattgctgcctctattatggcacttcaattttgcactgtcttttgagattcaagaaaaatttctattcttttttttgcatccaattgtgcctgaacttttaaaatatgtaaatgctgccatgttccaaacccatcgtcagtgtgtgtgtttagagctgtgcaccctagaaacaacatattgtcccatgagcaggtgcctgagacacagacccctttgcattcacagagaggtcattggttatagagacttgaattaataagtgacattatgccagtttctgttctctcacaggtgataaacaatgctttttgtgcactacatactcttcagtgtagagctcttgttttatgggaaaaggctcaaatgccaaattgtgtttgatggattaatatgcccttttgccgatgcatactattactgatgtgactcggttttgtcgcagctttgctttgtttaatgaaacacacttgtaaacctcttttgcactttgaaaaagaatccagcgggatgctcgagcacctgtaaacaattttctcaacctatttgatgttcaaataaagaattaaact

SEQ ID NO: 3 - protein, 595 aa, Homo sapiens [sequence omitted]

The invention claimed is:

1. An in-vitro method of identifying a tumor resulting from a proliferative breast disease as responsive to anti-estrogen treatment, comprising:
    a) detecting in a cell sample from said tumor whether a nucleotide sequence portion of the nucleotide sequence of SEQ ID NO:1 or a nucleotide sequence having at least 95% sequence identity to such portion is amplified in the genome of said tumor cells;
    b) classifying said tumor as responsive to anti-estrogen treatment, if the nucleotide sequence portion of SEQ ID NO:1 or a nucleotide sequence having at least 95% sequence identity to such portion is amplified in the genome of said tumor cells.

2. An in-vitro method of identifying a candidate patient with a tumor resulting from a proliferative breast disease as suitable for anti-estrogen treatment, comprising:
    a) detecting in a cell sample from said tumor whether a nucleotide sequence portion of the nucleotide sequence of SEQ ID NO:1 or a nucleotide sequence having at least 95% sequence identity to such portion is amplified in the genome of said tumor cells;
    b) classifying said patient as one that is suitable for anti-estrogen treatment, if the nucleotide sequence portion of the nucleotide sequence of SEQ ID NO:1 or a nucleotide sequence having at least 95% sequence identity to such portion is amplified in the genome of said tumor cells.

3. The method according to claim 1 or claim 2, wherein the anti-estrogen treatment comprises administration of an estrogen antagonist.

4. The method according to claim 1 or claim 2, wherein the anti-estrogen treatment comprises administration of an agent which interferes with estrogen synthesis.

5. The method according to claim 4, wherein the agent which interferes with estrogen synthesis is an aromatase inhibitor.

6. The method according to claim 1 or claim 2, wherein the anti-estrogen treatment comprises administration of an agent which downregulates expression of an estrogen receptor.

7. The method according to claim 1 or claim 2, wherein the anti-estrogen treatment is to be performed as a mono-therapy.

8. The method according to claim 1 or claim 2, wherein the proliferative breast disease is selected from the group consisting of ductal hyperplasia, papillomas, sclerosing adenosis, mastopathy, Phylloides tumor, fibroadenoma, DCIS, LCIS and apocrine metaplasia.

9. The method according to claim 1 or claim 2, wherein the proliferative breast disease is breast cancer.

10. The method according to claim 1 or claim 2, wherein said nucleotide sequence portion comprises at least a part of the ESR1 coding sequence ranging from nucleotide positions 1048135 to 1343855 of SEQ ID NO : 1.

11. The method according to claim 10, wherein said nucleotide sequence portion is located within the ESR1coding sequence ranging from nucleotide positions 1048135 to 1343855 of SEQ ID NO:1.

12. The method according to claim 1 or claim 2, wherein detecting whether said nucleotide sequence portion or nucleotide sequence having at least 95% sequence identity to such portion is amplified comprises DNA analysis using a probe which hybridizes to said nucleotide sequence portion or to a nucleotide sequence having at least 95% sequence identity to such portion.

13. The method according to claim 12, wherein the probe hybridizes to the ESR1 coding sequence ranging from nucleotide positions 1048135 to 1343855 of SEQ ID NO : 1 or a part thereof.

14. The method according to claim 12, wherein detecting whether said nucleotide sequence portion or nucleotide sequence having at least 95% sequence identity to such portion is amplified comprises Southern-Blotting.

15. The method according to claim 12, wherein detecting whether said nucleotide sequence portion or nucleotide sequence having at least 95% sequence identity to such portion is amplified comprises fluorescent in-situ hybridization (FISH).

16. The method according to claim 12, wherein detecting whether said nucleotide sequence portion or a nucleotide sequence having at least 95% sequence identity to such portion is amplified comprises a polymerase chain reaction (PCR).

17. The method according to claim 16, wherein the PCR uses at least one primer which hybridizes to the ESR1 coding sequence ranging from nucleotide positions 1048135 to 1343855 of SEQ ID NO : 1 or a part thereof.

18. The method according to claim 16, wherein detecting whether said nucleotide sequence portion or nucleotide sequence having at least 95% sequence identity to such portion is amplified comprises quantitative PCR.

19. The method according to claim 18, wherein detecting whether said nucleotide sequence portion or nucleotide sequence having at least 95% sequence identity to such portion is amplified comprises quantitative real-time PCR.

* * * * *